US012545900B2

(12) United States Patent
Whiteley et al.

(10) Patent No.: US 12,545,900 B2
(45) Date of Patent: Feb. 10, 2026

(54) CGAS/DNCV-LIKE NUCLEOTIDYLTRANSFERASES AND USES THEREOF

(71) Applicants: Dana-Farber Cancer Institute, Inc., Boston, MA (US); President And Fellows Of Harvard College, Cambridge, MA (US)

(72) Inventors: Aaron Whiteley, Brookline, MA (US); Philip J. Kranzusch, Brighton, MA (US); John Mekalanos, Newton, MA (US); James Eaglesham, Boston, MA (US)

(73) Assignees: Dana-Farber Cancer Institute, Inc., Boston, MA (US); President and Fellows of Harvard College, Cambridge, MA (US)

( * ) Notice: Subject to any disclaimer, the term of this patent is extended or adjusted under 35 U.S.C. 154(b) by 1220 days.

(21) Appl. No.: 17/270,234

(22) PCT Filed: Sep. 4, 2019

(86) PCT No.: PCT/US2019/049478
§ 371 (c)(1),
(2) Date: Feb. 22, 2021

(87) PCT Pub. No.: WO2020/051197
PCT Pub. Date: Mar. 12, 2020

(65) Prior Publication Data

US 2022/0127586 A1 Apr. 28, 2022

Related U.S. Application Data

(60) Provisional application No. 62/769,163, filed on Nov. 19, 2018, provisional application No. 62/727,647, filed on Sep. 6, 2018.

(51) Int. Cl.

| | |
|---|---|
| ***C12N 9/12*** | (2006.01) |
| ***C12N 1/20*** | (2006.01) |
| ***C12N 11/06*** | (2006.01) |
| ***C12N 15/10*** | (2006.01) |
| ***C12N 15/113*** | (2010.01) |
| ***C12N 15/70*** | (2006.01) |
| ***C12N 15/85*** | (2006.01) |
| ***G01N 33/50*** | (2006.01) |
| ***G01N 33/573*** | (2006.01) |
| ***G16B 15/30*** | (2019.01) |

(52) U.S. Cl.
CPC ............ *C12N 9/1241* (2013.01); *C12N 1/20* (2013.01); *C12N 11/06* (2013.01); *C12N 15/10* (2013.01); *C12N 15/1137* (2013.01); *C12N 15/70* (2013.01); *C12N 15/8509* (2013.01); *G01N 33/5023* (2013.01); *G01N 33/573* (2013.01); *G16B 15/30* (2019.02); *C12N 2015/8527* (2013.01); *C12N 2310/14* (2013.01); *G01N 2333/91245* (2013.01)

(58) Field of Classification Search
CPC .............................. C12N 9/1241; G16B 15/30
See application file for complete search history.

(56) References Cited

U.S. PATENT DOCUMENTS

2019/0183917 A1 6/2019 Birkus et al.

FOREIGN PATENT DOCUMENTS

| | | | | |
|---|---|---|---|---|
| CN | 105969754 A | | 9/2016 | |
| WO | WO-2017/049127 A1 | | 3/2017 | |
| WO | WO-2018/115149 A1 | | 6/2018 | |
| WO | WO-2018115140 A2 | * | 6/2018 | ........... A61K 38/162 |
| WO | WO-2020/051197 A1 | | 3/2020 | |

OTHER PUBLICATIONS

Rossolini et al. Characterization and sequence of the Chryseobacterium (Flavobacterium) meningosepticum carbapenemase: a new molecular class B b-lactamase showing a broad substrate profile. Biochem J. 332: 145-152. (Year: 1998).*
NCBI Blast (Nucleotide Sequence Elizabethkingia meningoseptica). https://blast.ncbi.nlm.nih.gov/Blast.cgi#alnHdr_1403377878 (Year: 2020).*
NCBI Blast (Protein Sequence Elizabethkingia meningoseptica). https://blast.ncbi.nlm.nih.gov/Blast.cgi#alnHdr_WP_016200549 (Year: 2020).*
Fisher Scientific (BD Difco BHI Agar). https://www.fishersci.com/shop/products/ bd-difco-dehydrated-culture-media-brain-heart-infusion-agar-3/p-4902056 (Year: 2024).*
Thaller et al. Characterization and sequence of PhoC, the principal phosphate-irrepressible acid p hosp hatase of Morganella morganii. Microbiology 140: 1341-1350. (Year: 1994).*
GenBank (*Rhodothermus marinus*): https://www.ncbi.nlm.nih.gov/nuccore/CP003030 (Year: 2016).*
Corrales et al., "Direct activation of STING in the tumor microenvironment leads to potent and systemic tumor regression and immunity," Cell Reports, 11(7): 1018-1030 (2015).
Diner et al., "The innate immune DNA sensor cGAS produces a noncanonical cyclic dinucleotide that activates human STING," Cell Reports, 3(5): 1355-1361 (2013).
Extended European Search Report for EP Application No. 19857772.8 dated May 10, 2022.
Govande et al., "Molecular basis of CD-NTase nucleotide selection in CBASS anti-phage defense," Cell Reports, 35(9): 109206 (2021).
Kranzusch., "cGAS and CD-NTase enzymes: structure, mechanism, and evolution," Current Opinion in Structural Biology, 59: 178-187 (2019).

(Continued)

*Primary Examiner* — James D Schultz
*Assistant Examiner* — Keenan A Bates
(74) *Attorney, Agent, or Firm* — Foley Hoag LLP

(57) ABSTRACT

The present invention is based, in part, on the discovery and characterization of the CD-NTase family of proteins, as well as compositions comprising CD-NTases, methods of producing nucleotide-based second messengers using such polypeptides, and methods of screening for modulators of the structure, expression, and/or activity of such polypeptides.

12 Claims, 52 Drawing Sheets

Specification includes a Sequence Listing.

(56) References Cited

OTHER PUBLICATIONS

Launer-Felty et al., "Enzymatic synthesis of cyclic dinucleotide analogs by a promiscuous cyclic-AMP-GMP synthetase and analysis of cyclic dinucleotide responsive riboswitches", Nucleic Acids Research, 46(6): 2765-2776 (2018).
Zhou et al., "Structure of the Human cGAS-DNA Complex Reveals Enhanced Control of Immune Surveillance," Cell, 174(2): 300-311. e11 (2018).
Zhu et al., "Structural biochemistry of a Vibrio cholerae dinucleotide cyclase reveals cyclase activity regulation by folates," Molecular Cell, 55(6): 931-937 (2014).
International Preliminary Report on Patentability for International Application No. PCT/US2019/049478 mailed Mar. 3, 2021.
International Search Report and Written Opinion for International Application No. PCT/US2019/049478 dated Dec. 27, 2019.
Kato et al., "Structural Basis for the Catalytic Mechanism of DncV, Bacterial Homolog of Cyclic GMP-AMP Synthase," Structure 23(5):843-850 (2015).
Kranzusch et al., "Structure-guided reprogramming of human cGAS dinucleotide linkage specificity," Cell 158(5):1011-1021 (2014).
Whiteley et al., "Bacterial cGAS-like enzymes synthesize diverse nucleotides signals," Nature 567(7747):194-199 (2019).
Sadler et al., "Synthetic strategies toward carbocyclic purine-pyrimidine hybrid nucleosides." Bioorg Med Chem. Aug. 1, 2009; 17(15): 5520-5525.

* cited by examiner

CdnE = orf27

Cyclic UMP–AMP
Expected $[M+H]^+$ *m/z* = 636.085
Found *m/z* = 636.085

(SEQ ID NOS 166, 198, 201, 4 and 5867, respectively, in order of appearance.)

(SEQ ID NOS 166, 1482, 1484, 5868, 1624, 1516, 163, 198, 168, 5869, 5870, 1643, 1437 and 1450, respectively, in order of appearance.)

Em-CdnE with GTP, Ap(c)pp (1st state)

Em-CdnE~pppApA (2nd state)

Cyclic di-UMP
Expected $[M+H]^+$ $m/z$ = 613.057
Found $m/z$ = 613.057

Cyclic CMP–UMP
Expected $[M+H]^+$ $m/z$ = 612.072
Found $m/z$ = 612.074

Cyclic AMP–AMP–GMP
Expected $m/z$ $[M+H]^+$: 1,004.159
Found $m/z$: 1,004.159

CGAS/DNCV-LIKE NUCLEOTIDYLTRANSFERASES AND USES THEREOF

CROSS-REFERENCE TO RELATED APPLICATIONS

This application is the U.S. national phase of International Patent Application No. PCT/US2019/049478, filed on 4 Sep. 2019, which claims the benefit of priority to U.S. Provisional Application Ser. No. 62/727,647, filed on 6 Sep. 2018, and U.S. Provisional Application Ser. No. 62/769,163, filed on 19 Nov. 2018; the entire contents of each of said applications are incorporated herein in their entirety by this reference.

Statement of Rights

This invention was made with government support under grant number R01AI018045, R01AI026289, P41 GM103403, S10 RR029205 and 5T32CA207021-02 awarded by the National Institutes of Health and under grant number DE-AC02-06CH11357 awarded by the Department of Energy. The government has certain rights in the invention.

SEQUENCE LISTING

The instant application contains a Sequence Listing which has been submitted electronically in ASCII format and is hereby incorporated by reference in its entirety. Said ASCII copy, created on Sep. 30, 2019, is named DFS-256_01_Sequence_Listing.txt and is 18,068,075 bytes in size.

BACKGROUND OF THE INVENTION

Second messenger signaling molecules allow cells to amplify stimuli, and rapidly control downstream responses. This concept is illustrated in human cells where viral double-stranded DNA stimulates the cytosolic enzyme cyclic GMP-AMP synthase (cGAS) to synthesize the cyclic dinucleotide (CDN) 2'-5'/3'-5' cyclic GMP-AMP (2'3' cGAMP) (Sun et al. (2013) *Science* 339:786-791; Wu et al. (2013) *Science* 339:826-830). 2'3' cGAMP diffuses throughout the cell, activates the receptor Stimulator of Interferon Genes (STING), and induces type I interferon and NF-κB responses to elicit protective anti-viral immune responses (Wu & Chen (2014) *Annu. Rev. Immunol* 32:461-488). Most recently, synthetic CDN analogues have emerged as promising lead compounds for immune modulation and cancer immunotherapy (Minn & Wherry (2016) *Cell* 165:272-275). Enzymatic synthesis of 2'3' cGAMP transforms local detection of limited stimuli (i.e., cytoplasmic dsDNA) into a spatially-disseminated response. Nucleotide triphosphates like the ATP and GTP used for 2'3' cGAMP synthesis are ideal building blocks for second messengers due to their abundance and high-energy bonds (Nelson & Breaker (2017) *Sci. Signal* 10: eaam8812). CDNs were first identified in bacteria (Ross et al. (1987) *Nature* 325:279-281), and established the foundation for later recognition of the importance of CDN signaling in mammalian cells (Danilchanka and& Mekalanos (2013) *Cell* 154:962-970). Nearly all bacterial phyla encode CDN signaling pathways, yet enigmatically, all known CDN signals are constructed only using purine nucleotides. CDNs control diverse responses in bacterial cells. For example, cyclic di-GMP coordinates the transition between planktonic and sessile growth, cyclic di-AMP controls osmoregulation, cell wall homeostasis, and DNA-damage responses, and 3'-5'/3'-5' cGAMP (3'3' cGAMP) modulates chemotaxis, virulence, and exoelectrogenesis (Krasteva & Sondermann (2017) *Nat. Chem. Biol.* 13:350-359). The human receptor STING also senses these bacterial CDNs as pathogen (or microbe) associated molecular patterns (PAMPs), revealing a direct, functional connection between bacterial and human second messenger signaling (Burdette et al. (2011) *Nature* 478:515-518). However, the understanding of the true scope of immune responses to bacterial second messenger products is limited and restricted to cyclic dipurine molecules.

Accordingly, there remains a great need in the art to understand the diversity of the bacterial second messenger products and their functions in modulating immune responses in order to design better therapeutics.

SUMMARY OF THE INVENTION

The present invention is based, at least in part, on the elucidation of the diversity of products synthesized by a family of microbial synthases related to the *Vibrio cholerae* enzyme dinucleotide cyclase in *Vibrio* (DncV) and its metazoan ortholog cGAS.

For example, in one aspect, a modified polypeptide that catalyzes production of nucleotides, wherein said polypeptide comprises an amino acid sequence having at least 70% identity to any one of CD-NTase amino acid sequences listed in Table 1, or a biologically active fragment thereof, and further comprises a nucleotidyltransferase protein fold and an active site, wherein the active site comprises the amino acid sequence $GSX_1X_2[\ldots]X_nA_1Y_1B_1$, optionally wherein the active site comprises the amino acid sequence $GSX_1X_2[\ldots]X_nA_1Y_1B_1Z_1Z_2[\ldots]Z_mC_1$, wherein: $A_1$, $B_1$, and $C_1$ independently represent amino acid residue D or E; $X_1, X_2, \ldots, X_n, Y_1, Z_1, Z_2, \ldots$, and $Z_n$ independently represent any amino acid residue; and n and/or m is any integer, optionally wherein n is 5-40 residues and m is $10^{-200}$ residues, is provided.

Numerous embodiments are further provided that can be applied to any aspect of the present invention and/or combined with any other embodiment described herein. For example, in one embodiment, the polypeptide comprises an amino acid sequence having at least 90% identity to to any one of CD-NTase amino acid sequences listed in Table 1, or a biologically active fragment thereof, and further comprises a nucleotidyltransferase protein fold and an active site, wherein the active site comprises the amino acid sequence $GSX_1X_2$ [ . . . ] $X_n$ $A_1Y_1B_1$, optionally wherein the active site comprises the amino acid sequence $GSX_1X_2$ [ . . . ] $X_n$ $A_1Y_1B_1Z_1Z_2$ [ . . . ] $Z_mC_1$, wherein: $A_1$, $B_1$, and $C_1$ independently represent amino acid residue D or E; $X_1, X_2, \ldots, X_n, Y_1, Z_1, Z_2, \ldots$, and Z, independently represent any amino acid residue; and n or m is any integer, optionally wherein n is 5-40 residues and m is $10^{-200}$ residues. In another embodiment, the polypeptide functions as a monomer. In still another embodiment, the active site of the polypeptide comprises at least two magnesium ions. In yet another embodiment, the magnesium ions are coordinated by a triad of acidic amino acid residues. In another embodiment, the GS motif in the active site interacts with the terminal phosphate of a nucleotide and participates in magnesium ion coordination. In still another embodiment, the polypeptide comprises one or more domains selected from the group consisting of Mab-21 protein domain, PAP_central domain, CCA domain, and transcription factor NFAT domain. In yet another embodiment, the polypeptide comprises an N-terminal Pol-β-like nucleotidyltransferase core domain. In another embodiment, the polypeptide comprises a C-terminal OAS1_C domain or a C-terminal tRNA_NucTransf2 domain, optionally wherein the C-terminal OAS1_C domain or a C-terminal tRNA_NucTransf2 domain are contiguous with an N-terminal Pol-β-like nucleotidyltransferase core domain. In still another embodiment, the polypeptide comprises an alpha helix that braces the N-terminal Pol-β-like nucleotidyltransferase core domain and the C-terminal domain. In yet another embodiment, the polypeptide catalyzes production of nucleotides, optionally wherein the nucleotides are cyclic or linear nucleotides. In another embodiment, the polypeptide catalyzes production of nucleotides in the absence of a ligand, such as a double-stranded DNA ligand. In still another embodiment, the nucleotides are cyclic nucleotides, optionally wherein the cyclic nucleotides are selected from the group consisting of cyclic dipurines, cyclic dipyrimidines, cyclic purine-pyrimidine hybrids, and cyclic tri-nucleotide molecules. In yet another embodiment, the cyclic dipurine is c-di-AMP, cGAMP, or c-di-GMP. In another embodiment, the cyclic dipyrimidine is c-di-UMP or cUMP-CMP. In still another embodiment, the cyclic purine-pyrimidine hybrid is cUMP-AMP or cUMP-GMP. In yet another embodiment, the cyclic tri-nucleotide molecule is CAMP-AMP-GMP. In another embodiment, the active site of the polypeptide comprises an amino acid sequence of GSYX10DVD (SEQ ID NO: 1), wherein X is any amino acid. In still another embodiment, the active site of the polypeptide comprises an amino acid sequence of GSYX10DVDX72D (SEQ ID NO: 2), wherein X is any amino acid.

In some embodiments, the polypeptide comprises amino acid residue N at the position corresponding to N166 of Em-CdnE shown in FIG. 5A. In another embodiment, the polypeptide comprises an amino acid sequence having at least 70% identity to any one of the sequences shown in FIG. 5A and further comprises amino acid residue N at the position corresponding to N166 of Em-CdnE shown in FIG. 5A. In still another embodiment, the polypeptide comprises an amino acid sequence having at least 90% identity to any one of the sequences shown in FIG. 5A and further comprises amino acid residue N at the position corresponding to N166 of Em-CdnE shown in FIG. 5A. In yet another embodiment, the polypeptide comprises an amino acid sequence having the amino acid sequence of any one of the sequences shown in FIG. 5A and further comprises amino acid residue N at the position corresponding to N166 of Em-CdnE shown in FIG. 5A. In another embodiment, the polypeptide catalyzes production of cyclic purine-pyrimidine hybrids, such as cyclic UMP-AMP. In still another embodiment, the cyclic UMP-AMP binds to RECON and inhibits activity of RECON. In another embodiment, the polypeptide comprises amino acid S at the position corresponding to N166 of Em-CdnE shown in FIG. 5A. In still another embodiment, the polypeptide comprises an amino acid sequence having at least 70% identity to any one of the sequences shown in FIG. 5A and further comprises amino acid residue S at the position corresponding to N166 of Em-CdnE shown in FIG. 5A. In yet another embodiment, the polypeptide comprises an amino acid sequence having at least 90% identity to any one of the sequences shown in FIG. 5A and further comprises amino acid residue S at the position corresponding to N166 of Em-CdnE shown in FIG. 5A. In another embodiment, the polypeptide comprises an amino acid sequence having the amino acid sequence of any one of the sequences shown in FIG. 5A and further comprises amino acid residue S at the position corresponding to N166 of Em-CdnE shown in FIG. 5A. In still another embodiment, the polypeptide catalyzes production of cyclic dipurines, such as c-di-AMP. In yet another embodiment, the polypeptide comprises an amino acid sequence having at least 70% identity to the amino acid sequence of Lp-CdnE02. In another embodiment, the polypeptide comprises an amino acid sequence having at least 90% identity to the amino acid sequence of Lp-CdnE02. In still another embodiment, the polypeptide comprises an amino acid sequence having the amino acid sequence of Lp-CdnE02. In yet another embodiment, the polypeptide catalyzes production of cyclic dipyrimidines, such as c-di-UMP. In another embodiment, the polypeptide comprises an amino acid sequence having at least 70% identity to the amino acid sequence of Ec-CdnD02. In still another embodiment, the polypeptide comprises an amino acid sequence having at least 90% identity to the amino acid sequence of Ec-CdnD02. In yet another embodiment, the polypeptide comprises an amino acid sequence having the amino acid sequence of Ec-CdnD02. In another embodiment, the polypeptide catalyzes production of cyclic trinucleotides, such as cyclic AMP-AMP-GMP. In still another embodiment, the cyclic AMP-AMP-GMP binds to RECON and inhibits activity of RECON. In yet another embodiment, the polypeptide further comprises a heterologous polypeptide. In another embodiment, the heterologous polypeptide is selected from the group consisting of a signal peptide, a peptide tag, a dimerization domain, an oligomerization domain, an antibody, or an antibody fragment. In still another embodiment, the peptide tag is a thioredoxin, Maltose-binding protein (MBP), SUMO2, Glutathione-S-Transferase (GST), calmodulin binding protein (CBP), protein C tag, Myc tag, HaloTag, HA tag, Flag tag, His tag, biotin tag, V5 tag, or OmpA signal sequence tag. In still another embodiment, the antibody fragment is an Fc domain. In yet another embodiment, the polypeptide is immobilized on an object selected from the group consisting of a cell, a metal, a resin, a polymer, a ceramic, a glass, a microelectrode, a graphitic particle, a bead, a gel, a plate, an array, and a capillary tube.

In another aspect, a composition comprising a modified polypeptide described herein, and a pharmaceutically acceptable agent selected from the group consisting of excipients, diluents, and carriers, is provided.

In still another aspect, an isolated nucleic acid molecule encoding a polypeptide described herein, is provided.

In yet another aspect, an isolated nucleic acid molecule comprising a nucleotide sequence, which is complementary to a nucleic acid sequence described herein, is provided.

In another aspect, a vector, such as an expression vector, comprising a nucleic acid molecule described herein, is provided.

In still another aspect, a host cell transfected with an expression vector described herein, is provided.

In yet another aspect, a method of producing a polypeptide described herein, comprising culturing a host cell described herein in an appropriate culture medium to, thereby, produce the polypeptide, is provided.

As described above, numerous embodiments are further provided that can be applied to any aspect of the present invention and/or combined with any other embodiment described herein. For example, in one embodiment, the host cell is a bacterial cell or a eukaryotic cell. In another embodiment, the host cell is genetically engineered to express a selectable marker. In still another embodiment, the method further comprises isolating the polypeptide from the medium or host cell.

In another aspect, a method for detecting the presence of a polypeptide described herein in a sample comprising: a)

contacting the sample with a compound which selectively binds to the polypeptide; and b) determining whether the compound binds to the polypeptide in the sample to thereby detect the presence of the polypeptide in the sample, is provided. In one embodiment, the compound which binds to the polypeptide is an antibody.

In still another aspect, a non-human animal model engineered to express a polypeptide described herein, is provided. In one embodiment, the polypeptide is overexpressed. In another embodiment, the animal is a knock-in or a transgenic animal. In still another embodiment, thee animal is a rodent.

In yet another aspect, a method of synthesizing nucleotides comprising contacting a polypeptide described herein, or biologically active fragment thereof, with nucleotide substrates.

As described above, numerous embodiments are further provided that can be applied to any aspect of the present invention and/or combined with any other embodiment described herein. For example, in one embodiment, the method further comprises adding a ligand, such as a double-stranded DNA, to the mixture. In another embodiment, the method further comprises purifying the synthesized nucleotides. In still another embodiment, the nucleotide substrates are selected from ATP, CTP, GTP, UTP, and any combination thereof. In yet another embodiment, the nucleotide substrate is modified or unnatural nucleoside triphosphates. In another embodiment, the nucleotide-based second messenger is a cyclic or linear nucleotide-based second messenger. In still another embodiment, the synthesized nucleotides are selected from the group consisting of cyclic dipurine, cyclic dipyrimidine, cyclic purine-pyrimidine hybrid, and cyclic tri-nucleotide. In yet another embodiment, the cyclic dipurine is c-di-AMP, cGAMP, or c-di-GMP. In another embodiment, the cyclic dipyrimidine is c-di-UMP or cUMP-CMP. In still another embodiment, the cyclic purine-pyrimidine hybrid is cUMP-AMP or cUMP-GMP. In yet another embodiment, the cyclic tri-nucleotide molecule is cAMP-AMP-GMP. In another embodiment, the synthesized nucleotides comprise modified or unnatural nucleoside triphosphates. In still another embodiment, the step of contacting occurs in vivo, ex vivo, or in vitro.

In another aspect, a method for identifying an agent which modulates the expression and/or activity of a polypeptide described herein, or biologically active fragment thereof, comprising: a) contacting the polypeptide or biologically active fragment thereof, or a cell expressing the polypeptide or biologically active fragment thereof, with a test agent; and b) determining the effect of the test agent on the expression and/or activity of the polypeptide or biologically active fragment thereof to thereby identify an agent which modulates the expression and/or activity of the polypeptide or biologically active fragment thereof, is provided.

As described above, numerous embodiments are further provided that can be applied to any aspect of the present invention and/or combined with any other embodiment described herein. For example, in one embodiment, the activity is selected from the group consisting of: a) nucleotide-based second messenger synthesis; b) enzyme kinetics; c) nucleotide coordination; d) protein stability; e) interactions with DNA; f) enzyme conformation; and g) STING and/or RECON pathway regulation. In another embodiment, the step of contacting occurs in vivo, ex vivo, or in vitro. In still another embodiment, the agent increases the expression and/or activity of the polypeptide, or biologically active fragment thereof. In yet another embodiment, the agent is selected from the group consisting of a nucleic acid molecule described herein, polypeptide described herein, and a small molecule that binds to a polypeptide described herein. In another embodiment, the agent decreases the expression and/or activity of the polypeptide, or biologically active fragment thereof. In still another embodiment, the agent is a small molecule inhibitor, CRISPR guide RNA (gRNA), RNA interfering agent, nucleotide-based second messenger, peptide or peptidomimetic inhibitor, aptamer, antibody, or intrabody. In yet another embodiment, the RNA interfering agent is a small interfering RNA (siRNA), CRISPR RNA (crRNA), CRISPR guide RNA (gRNA), a small hairpin RNA (shRNA), a microRNA (miRNA), or a piwi-interacting RNA (piRNA). In another embodiment, the agent comprises an antibody and/or intrabody, or an antigen binding fragment thereof, which specifically binds to the polypeptide or biologically active fragment thereof. In still another embodiment, the antibody and/or intrabody, or antigen binding fragment thereof, is chimeric, humanized, composite, or human. In yet another embodiment, the antibody and/or intrabody, or antigen binding fragment thereof, comprises an effector domain, comprises an Fc domain, and/or is selected from the group consisting of Fv, Fav, F (ab') 2, Fab', dsFv, scFv, sc (Fv) 2, and diabodies fragments.

In still another aspect, a crystal of a polypeptide described herein, wherein the crystal effectively diffracts X-rays for the determination of the atomic coordinates of the polypeptide to a resolution of greater than 5.0 Angstroms, is provided.

As described above, numerous embodiments are further provided that can be applied to any aspect of the present invention and/or combined with any other embodiment described herein. For example, in one embodiment, the polypeptide is crystallized in apo form. In another embodiment, the polypeptide is crystallized in complex with nucleotide substrates. In still another embodiment, the crystal has a space group P $2_1 2_1 2_1$. In yet another embodiment, the crystal has a unit cell of dimensions of $\alpha=\beta=\gamma=90.0°$. In another embodiment, the crystal has a set of structural coordinates listed in Table 3+/−the root mean square deviation from the backbone atoms of the the polypeptide of less than 2 Angstroms. In still another embodiment, the crystal is obtained by hanging drop vapor diffusion. In yet another embodiment, the crystal is obtained by incubating hanging drops at a ratio of 1:1 to 1.2:0.8 (protein:reservoir) at 18° C. In another embodiment, the conformation of the complex is the conformation shown in FIGS. 3A-3B, 4B, and/or 5F-5H.

In yet another aspect, a method for identifying an agent which modulates activity of a polypeptide described herein, comprising the steps of: a) using a three-dimensional structure of the polypeptide as defined by atomic coordinates according to Table 3; b) employing the three-dimensional structure to design or select an agent; c) synthesizing the agent; and d) contacting the agent with the polypeptide, or biologically active fragment thereof, to determine the ability of the agent to modulate activity of the polypeptide, is provided.

As described above, numerous embodiments are further provided that can be applied to any aspect of the present invention and/or combined with any other embodiment described herein. For example, in one embodiment, the step of employing the three-dimensional structure to design or select an agent comprises the steps of: a) identifying chemical entities or fragments capable of associating with the polypeptide; and b) assembling the identified chemical entities or fragments into a single molecule to provide the structure of the agent. In another embodiment, the agent is designed de novo. In still another embodiment, the agent is designed from a known agonist or antagonist of the polypeptide. In yet another embodiment, the activity of the polypeptide is selected from the group consisting of: a) nucleotide-based second messenger synthesis; b) enzyme kinetics; c) nucleotide coordination; d) protein stability; e) interactions with DNA; f) enzyme conformation; and g) STING and/or RECON pathway regulation.

In another aspect, a method of using the three-dimensional structure coordinates of Table 3, comprising: a) determining structure factors from the coordinates; b) applying said structure factor information to a set of X-ray diffraction data obtained from a crystal of a CD-NTase family enzyme; and c) solving the three-dimensional structure of the CD-NTase family enzyme, is provided.

BRIEF DESCRIPTION OF THE DRAWINGS

FIG. 1A shows that the dncV operon from the *Vibrio* Seventh Pandemic Island-I (VSP-I) was identified with similar genetic architectures of varying completeness in other organisms. A genomic island homologous to the *Vibrio cholerae* dncV operon was identified in the *E. coli* strain ECOR31. In addition to the conserved 3'3' cGAMP synthase (dncV) and phospholipase receptor (capV) genes (Severin et al. (2018) Proc. Natl. Acad. Sci. U.S.A. 115: E6048-E6055), the ECOR31 island encodes a second cap V-like gene (BHF03_01995 encoding WP_001593459, renamed capE) next to a gene of unknown function (BHF03_01990 encoding WP_001593458, here renamed cdnE). FIG. 1B shows PEI-cellulose TLC of reactions incubated with purified enzyme and [a-$^{32}$P] radiolabeled ATP, CTP, GTP, and UTP, and treated with alkaline phosphatase. Standards were 2'3' cGAMP (cGAS), 3'3' cGAMP (DncV), c-di-AMP (DisA), c-di-GMP (WspR). FIG. 1C shows biochemical deconvolution of the CdnE reactions as in (FIG. 1B), visualized by incubating with [a-$^{32}$P] labeled and unlabeled NTPs, separated by PEI-Cellulose TLC. FIG. 1D shows anion exchange chromatography of CdnE reaction with ATP and UTP. Indicated fraction was concentrated for mass spectrometry (MS) analysis. FIG. 1E shows the CdnE product, confirmed by MS and NMR (see FIGS. 2D-2F and 2J-2N). FIG. 1F shows the activation of CapV and CapE by CDNs, tested with no nucleotide added (–) or at 0.1, 1, and 10-fold molar ratios of nucleotide to phospholipase. Enzyme activity is reported in Phospholipase $A_1$ units mL-1.

FIG. 2A-FIG. 20 show detailed characterization of CdnE, a cUMP-AMP synthase. FIGS. 2A and 2B show the titration of reaction buffer pH in steps of 0.2 pH units. Recombinant DncV or CdnE was incubated with [a-$^{32}$P] radiolabeled ATP, CTP, GTP, and UTP at varying pH and the reactions were visualized by PEI-cellulose TLC. CdnE was optimally active at ~pH 9.4, and this reaction condition was used in further experiments.

FIGS. 2G-2I show that incubation of CD-NTase enzymes with nonhydrolyzable nucleotides trapped reaction intermediates and identified the reaction order. Left shows PEI-cellulose TLC analysis of reactions as in FIG. 1B where individual NTPs have been replaced with nonhydrolyzable nucleotides; right shows published reaction mechanisms (DncV and cGAS) (Kranzusch et al. (2014) *Cell* 158:1011-1021; Gao et al. (2013) *Cell* 153:1094-1107) and proposed reaction mechanism for CdnE.

FIG. 20 shows PEI-cellulose TLC of products after incubation of indicated enzyme, wild type CdnE, or active site mutant CdnE with [a-$^{32}$P] radiolabeled ATP, CTP, GTP, and UTP as in FIG. 2A. Mutations that ablate the CdnE Mg2+-coordinating, active-site residues eliminated all detectable activity.

FIG. 3A shows Rm-CdnE in complex with nonhydrolyzable ATP and UTP analogs (Rm-CdnE-Ap (c) pp-Up (n) pp) crystal structure determined to 2.25 Å, and zoom-in inset of key N166-uridine contacts controlling pyrimidine specificity. Greem dotted lines indicate hydrogen bonding and 2Fo-Fc electron density map is contoured at 16. FIG. 3B shows zoom-in cutaway of FIG. 3A, Rm-CdnE active site. Blue mesh indicates 2Fo-Fc electron density contoured at 1 σ and red dotted lines indicate hydrogen bonding. FIG. 3C shows cladogram of CdnE sequence homologs and the analogous residue to N166 determined by sequence alignment (FIG. 5A). Red "S" highlights cGAS/DncV-like serine residues, and legend is 0.3 substitutions per site. FIG. 3D shows CdnE homologs and mutants incubated with [a-$^{32}$P] radiolabeled NTPs, separated by PEI-Cellulose TLC as in FIG. 1B. "N" vs red "S" indicates asparagine or cGAS/DncV-like serine at the N166 analogous position in the tested allele. Side-chains are numbered according to Rm-CdnE sequence. For detailed deconvolution and purine vs pyrimidine migration pattern analysis see FIG. 4 and FIG. 5. FIG. 3E shows X-ray crystal structures of Rm-CdnE-Ap (c) pp-Up(n)pp (2.25 Å) compared to Em-CdnE-ApAppp (1.24 Å) and similar Pol-β-like NTases: Pol-μ, 4YD117; Pol-β, 4KLQ16; CCA-adding enzymes, 4X4T14; Poly (A) Polymerase gamma (PAP), 4LT615; OAS1, 4RWO38; hcGAS, 6CTA28; DncV, 4TY013. Structure-based comparison demonstrates that Rm-CdnE and Em-CdnE are cGAS/DncV like nucleotidyltransferase (CD-NTases) with a similar architecture to DncV (4TY0 (Kranzusch et al. (2014) *Cell* 158:1011-1021)), cGAS (6CTA (Zhou et al. (2018) *Cell* 174: P300-311)), and OAS1 (4RWO (Lohofener et al. (2015) *Structure* 23:851-862)). CD-NTases are more distantly related to Pol-β-like NTases: Pol-μ (4YD1 (Moon et al. (2015) *Proc. Natl. Acad. Sci.* U.S.A. 112: E4530-E4536)), Pol-β (4KLQ (Freudenthal et al. (2013) *Cell* 154, 157-168)) CCA-adding enzyme (4X4T (Kuhn et al. (2015) *Cell* 160:644-658)), and Poly (A)

Polymerase gamma (PAP, 4LT6 (Yang et al. (2014) *J Mol Biol* 426:43-50)). Nucleotidyltransferase core domains are similarly colored and organized based on structural homology to Rm-CdnE (according to Z-score (Holm & Laakso (2016) *Nucleic Acids Res* 44: W351-W355)).

Figure 4A:
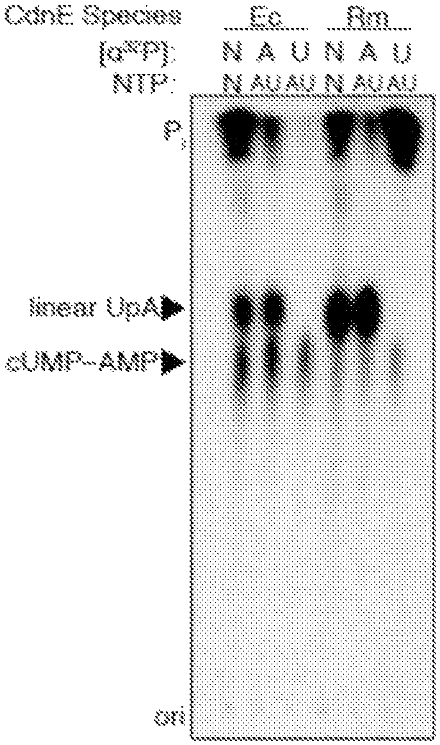
Figure 4B:
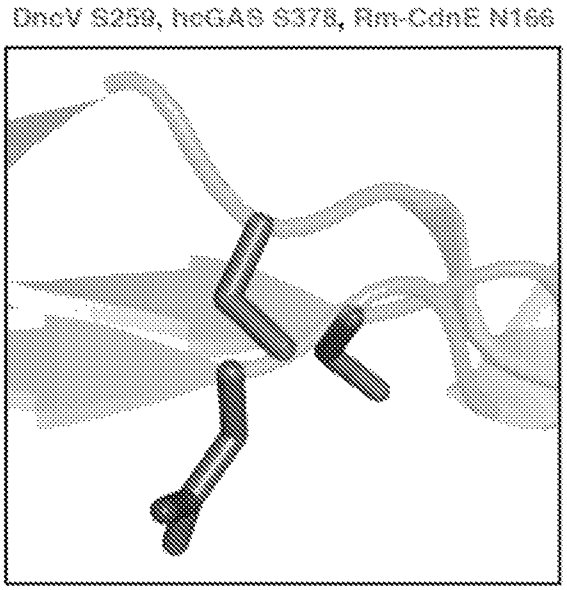
Figure 4C:
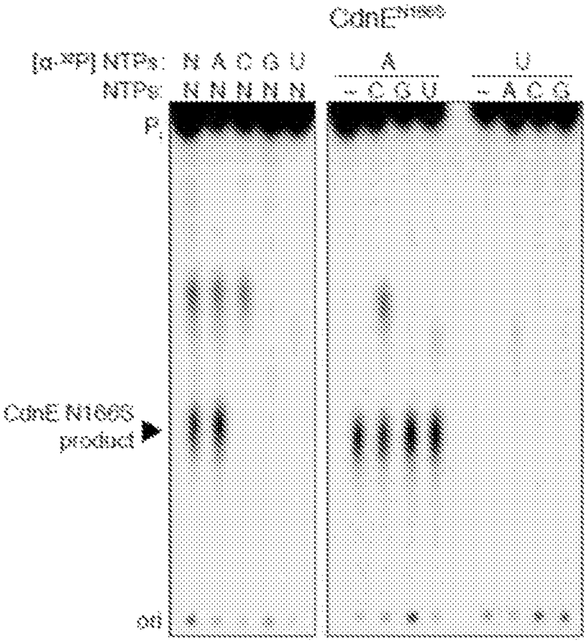
Figure 4D:
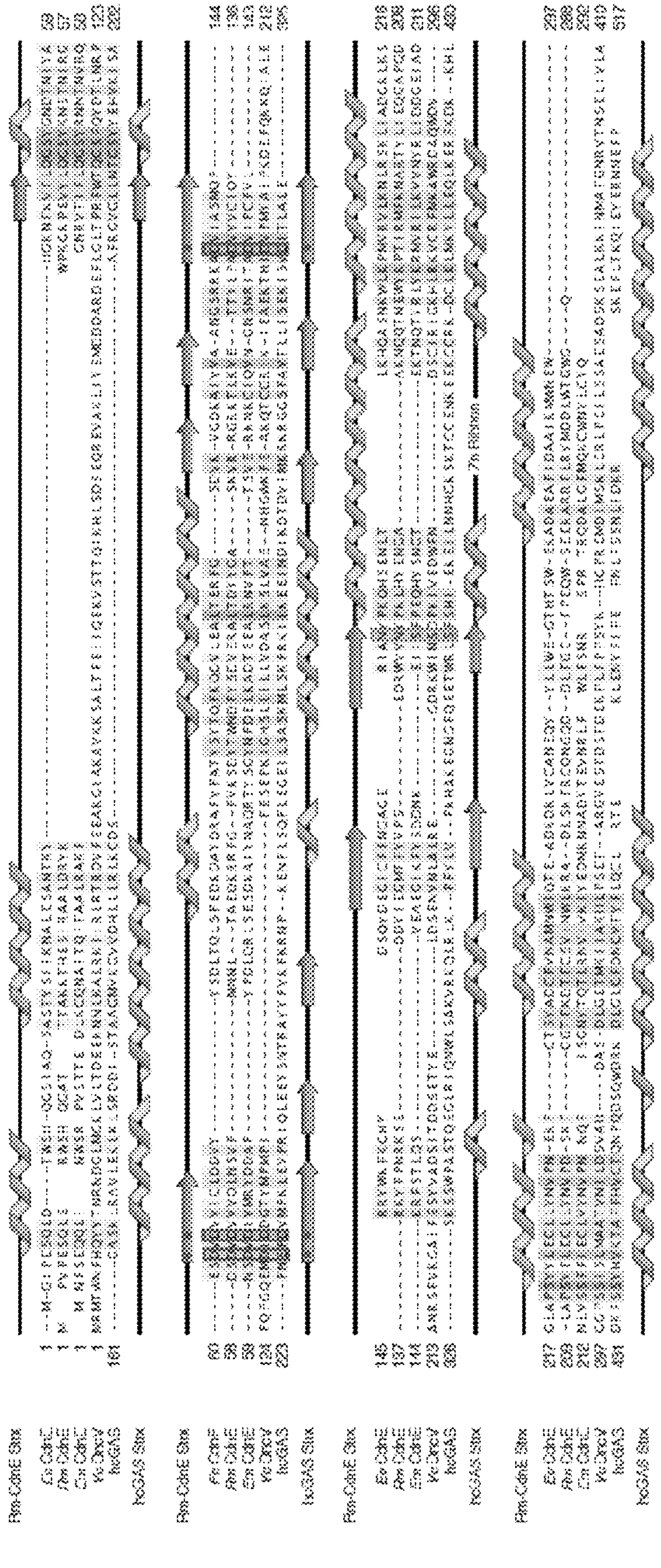

FIG. 4A-FIG. 4D shows detailed structural analysis of Rm-CdnE. FIG. 4A shows a thermophilic homolog of CdnE (Rm-CdnE) synthesized cUMP-AMP. Recombinant proteins were incubated with [α-$^{32}$P] radiolabeled NTPs as indicated at either 37° C. (CdnE) or 70° C. (Rm-CdnE) and the reactions were visualized by PEI-cellulose TLC as in FIG. 1B. FIG. 4B shows the active site of Rm-CdnE-Ap (c) pp-Up (n) pp superimposed with structures of cGAS (6CTA) and DncV (4TY0). FIG. 4C shows that the analogous position to N166 was mutated in CdnE to a serine and that protein CdnE$^{N166S}$ was characterized in depth. Reactions were separated by PEI-cellulose TLC, and analyzed as in FIG. 1B. Reactions demonstrated that CdnE$^{N166S}$ loses pyrimidine-specificity. FIG. 4D shows structure-corrected sequence alignment of nucleotidyltransferases, annotated with secondary structure features of Rm-CdnE and hcGAS (6CTA). Red highlights $Mg^{2+}$-coordinating active site residues, and orange highlights analogous residues to Rm-CdnE N166. FIG. 4D discloses SEQ ID NOS 166, 198, 201, 4 and 5867, respectively, in order of appearance.

Figure 5A:
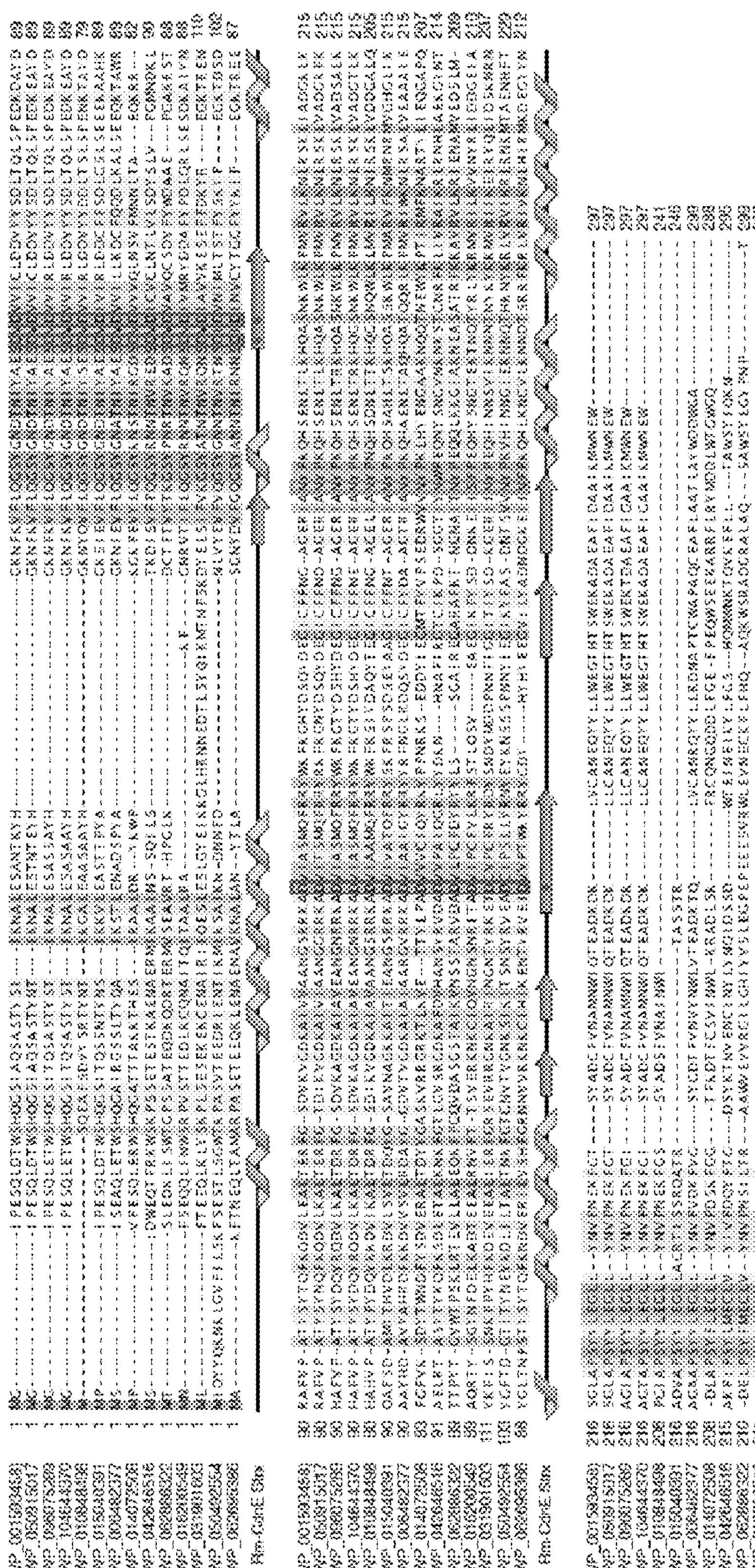
Figure 5B:
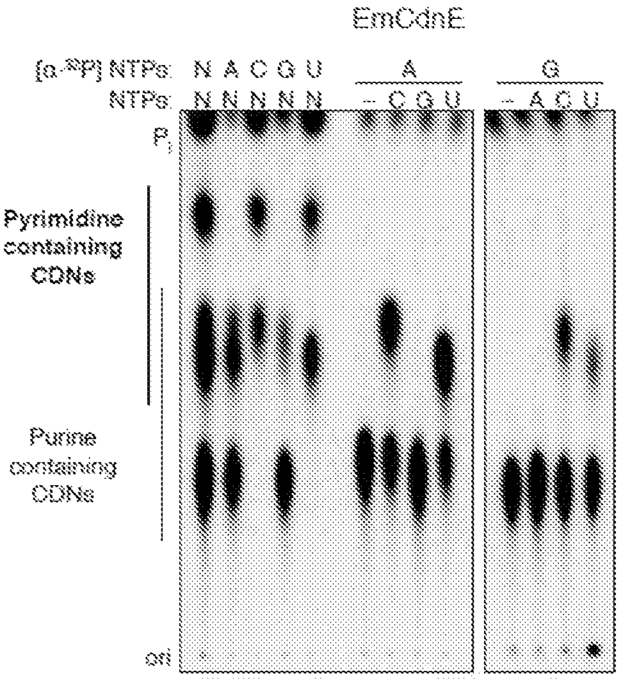
Figure 5C:
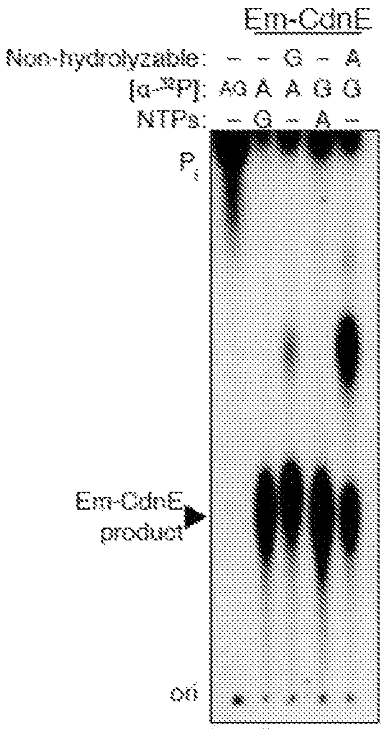
Figure 5D:
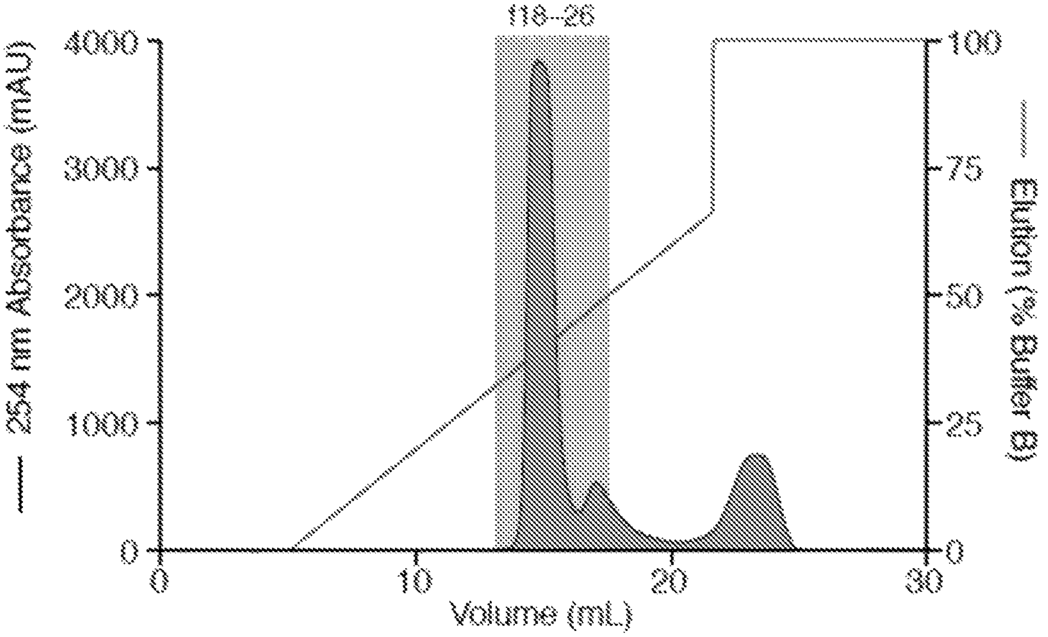
Figure 5E:
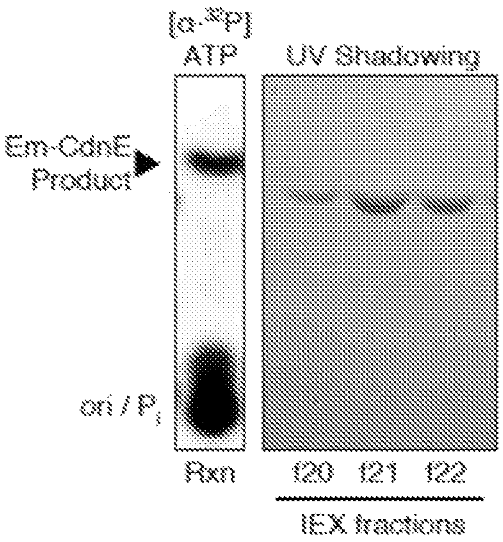
Figure 5F:
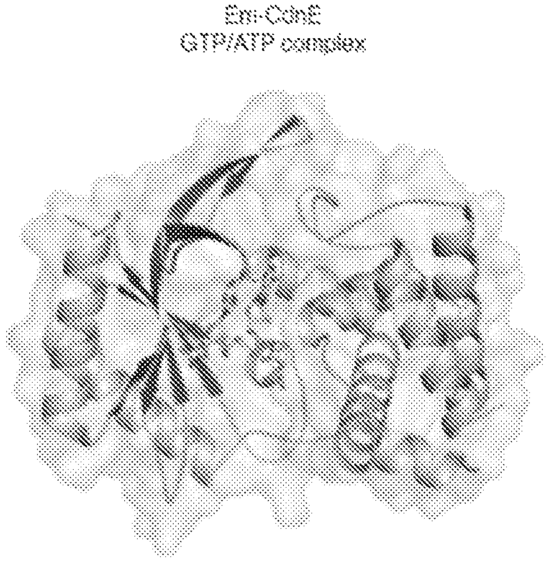
Figure 5G:
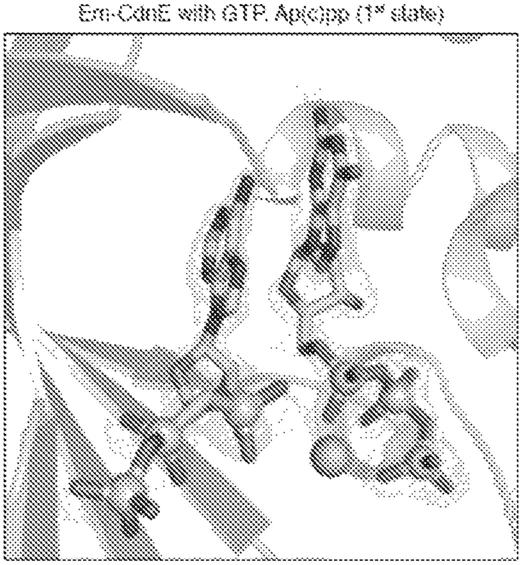
Figure 5H:
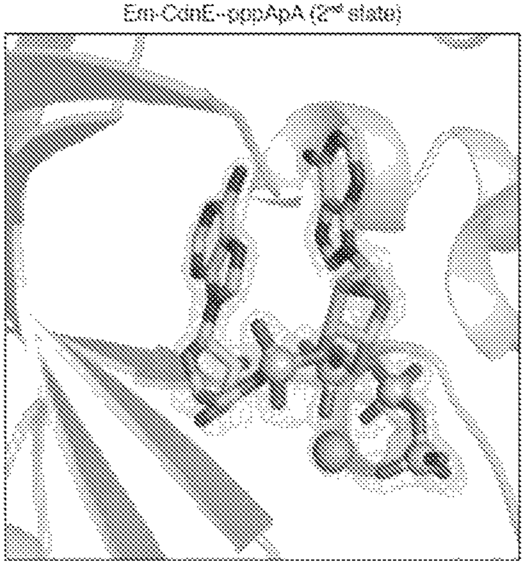
Figure 5I:
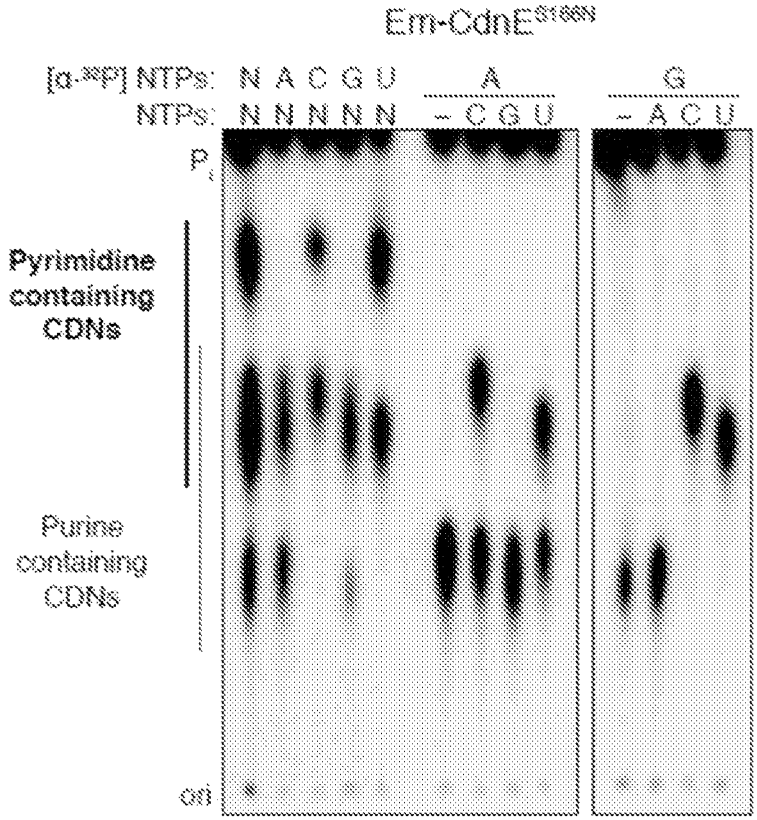

FIG. 5A-FIG. 5I show detailed structural analysis of Em-CdnE. FIG. 5A shows sequence alignment of CdnE homologs in FIG. 3C, annotated with Rm-CdnE secondary structure features. Red highlights $Mg^{2+}$-coordinating active site residues, and orange highlights analogous residues to Rm-CdnE N166. WP_050915017 is a CdnE homolog from *Yersinia enterocolitica*; WP_096075289 is a CdnE homolog from *Pseudomonas aeruginosa*; WP_104644370 is a CdnE homolog from *Xanthomonas arboricola*; WP_010848498 is a CdnE homolog from Xenorhabdus nematophila; WP_015040391 is a CdnE homolog from *Bordetella parapertussis*; WP_006482377 is a CdnE homolog from *Burkholderia cepacia* complex; WP_014072508 is a CdnE homolog from Rhodothermus *marinus*; WP_042646516 is a CdnE homolog from *Legionella pneumophila*; WP_062886322 is a CdnE homolog from *Mycobacterium avium*; WP_016200549 is a CdnE homolog from Elizabethkingia meningoseptica; WP_031901603 is a CdnE homolog from *Staphylococcus aureus*; WP_050492554 is a CdnE homolog from *Enterococcus faecalis*; WP_062695386 is a CdnE homolog from *Bacteroides* thetaiotaomicron. FIG. 5A discloses SEQ ID NOS 166, 1482, 1484, 5868, 1624, 1516, 163, 198, 168, 5869, 5870, 1643, 1437 and 1450, respectively, in order of appearance. FIG. 5B shows the biochemical deconvolution of Em-CdnE, which harbors a natural serine substitution at the N166 analogous site. Recombinant protein was incubated with NTPs as indicated and reactions were visualized as in FIG. 1B. FIG. 5C shows incubation of Em-CdnE with [α-$^{32}$P] radiolabeled NTPs and nonhydrolyzable nucleotide analogs as indicated, and visualized as in FIG. 1B. FIG. 5D shows anion exchange chromatography of an Em-CdnE reaction with ATP and GTP, eluted with a gradient of Buffer B (2 M ammonium acetate) by FPLC. Individual fractions were concentrated prior to pooling for further analysis. FIG. 5E shows that anion exchange chromatography (IEX) fractions from FIG. 5D were separated by silica TLC, visualized by UV shadowing, and compared to a radiolabeled reaction to confirm the appropriate peak. Fractions were pooled and concentrated prior to mass spectrometry analysis. Mass spectrometry confirmed synthesis of c-di-AMP, cGAMP, and c-di-GMP. FIG. 5F shows overview of Em-CdnE crystal structure in complex with GTP and nonhydrolyzable ATP (1.50 Å), capturing the so-called "1st state" structure prior to NTP hydrolysis. Mg2+ ions are shown in green. FIG. 5G shows the zoom-in cut-away graph of the active site of FIG. 5F, confirming the position of a serine at the analogous site to Rm-CdnE N166. Nucleotide 2Fo-Fc electron density is contoured at 1 σ. FIG. 5H shows the zoom-in cut-away graph of the active site of Em-CdnE-pppApA structure (1.24 Å), capturing the "2nd state" after the first reaction has occurred to form a linear intermediate, but prior to CDN formation. 2Fo-Fc electron density is contoured at 1 σ. FIG. 5I shows the biochemical deconvolution of mutant Em-CdnE reverted to the ancestral asparagine at S169, the N166 analogous site. Reactions were visualized as in FIG. 1B. Recombinant protein was incubated with NTPs as indicated.

Figure 6A:
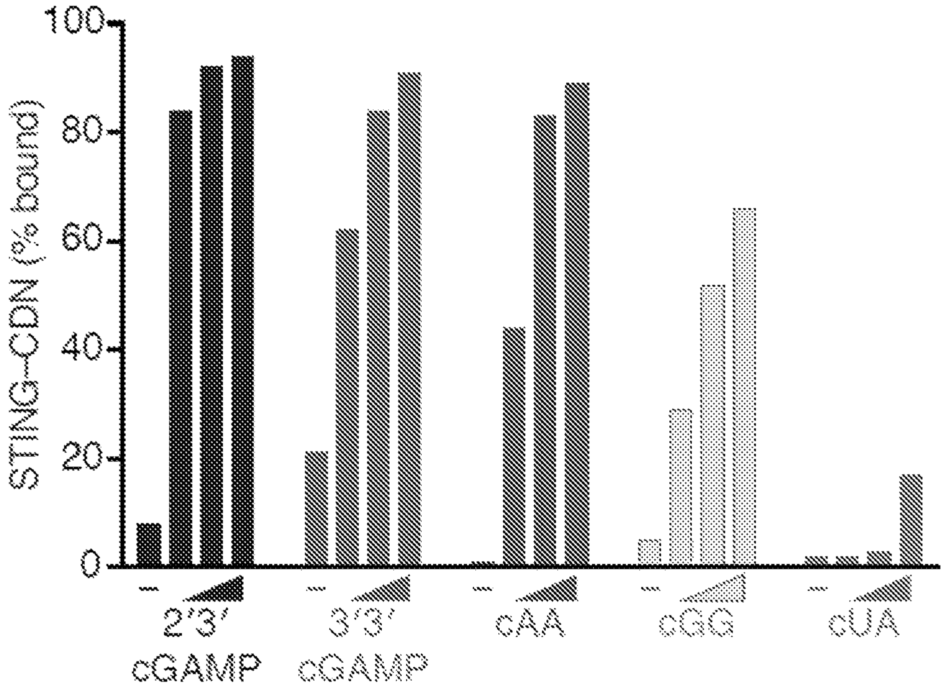
Figure 6B:
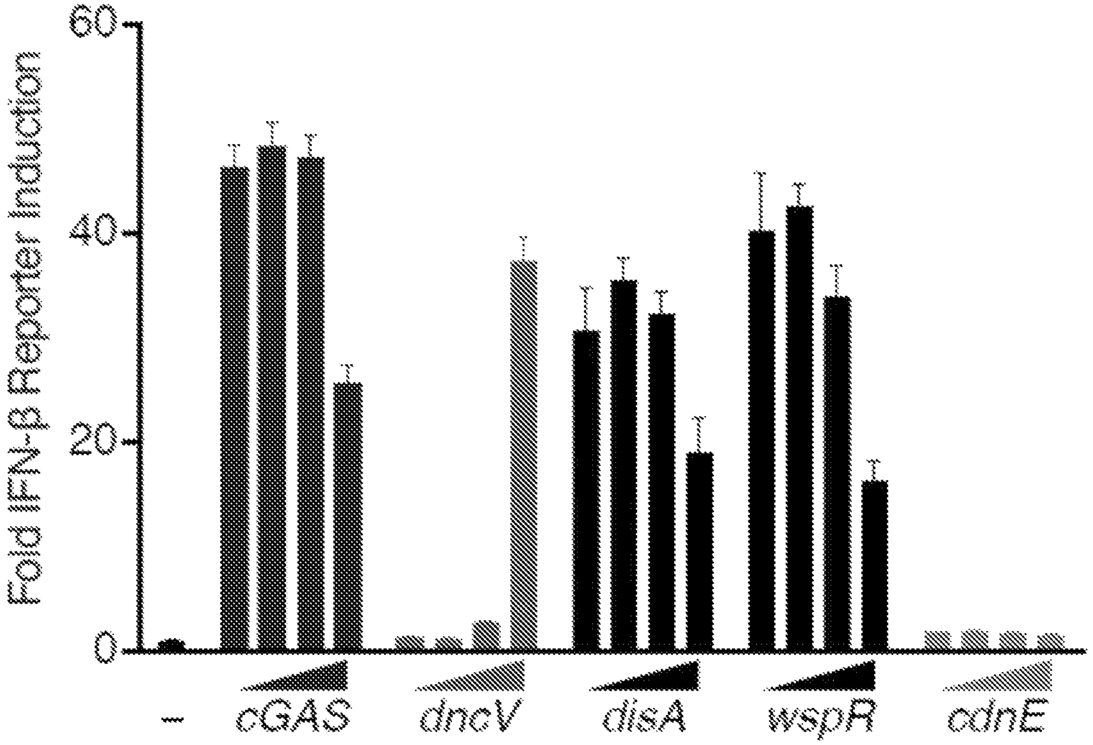
Figure 6C:
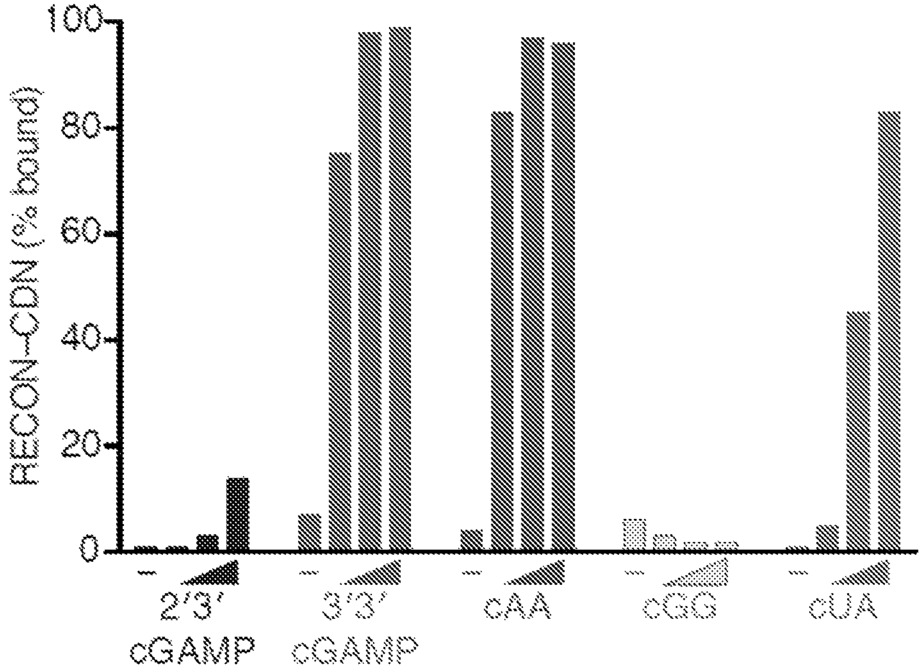
Figure 6D:
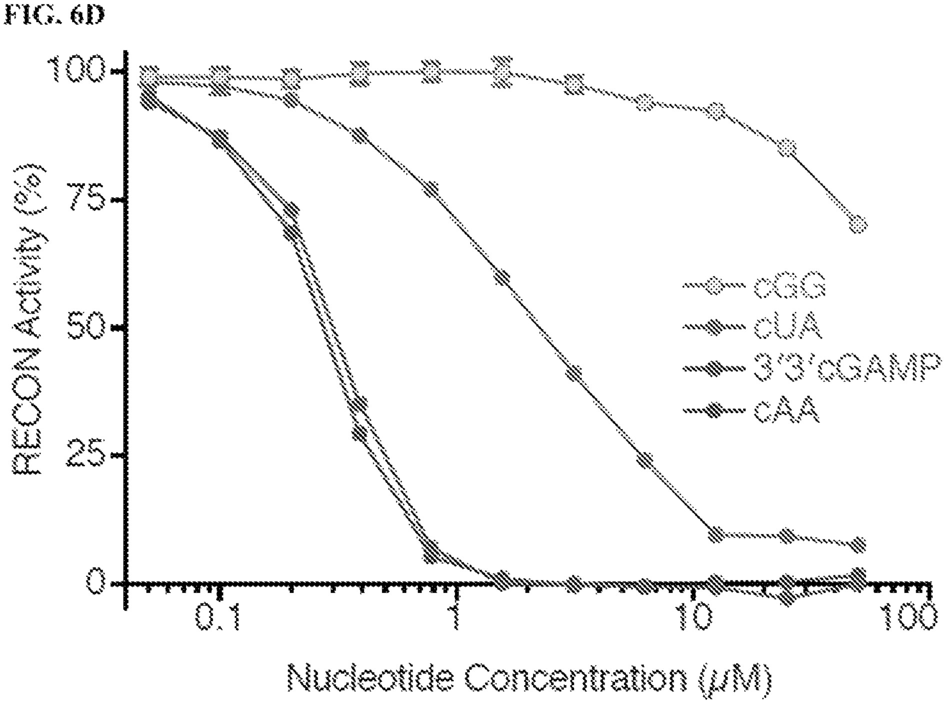

FIG. 6A-FIG. 6D show the immune detection of a pyrimidine containing CDN. FIGS. 6A and 6C show the quantification of nucleotide interactions with the host receptors STING or RECON, measured with radiolabeled nucleotide bound to a concentration gradient of host protein, separated in a native PAGE gel shift (0, 4, 20, 100 μM protein). See FIG. 7 for additional details. FIG. 6B shows the induction of an interferon-β reporter in HEK293T cells transfected with a concentration gradient of plasmid overexpressing the enzyme that synthesizes the indicated nucleotide using In-cell STING reporter assay. cGAS synthesizes 2'3' cGAMP, DncV synthesizes 3'3' cGAMP, DisA synthesizes c-di-AMP, WspR synthesizes c-di-GMP, and CdnE synthesizes cUMP-AMP. Data are fold induction over vector only shown as (−). FIG. 6D shows nucleotide inhibition of RECON enzymatic activity, as measured by oxidation of NADPH cosubstrate.

FIG. 7A-FIG. 7E show that cUMP-AMP defines innate immune receptor specificity.

Figure 7A:
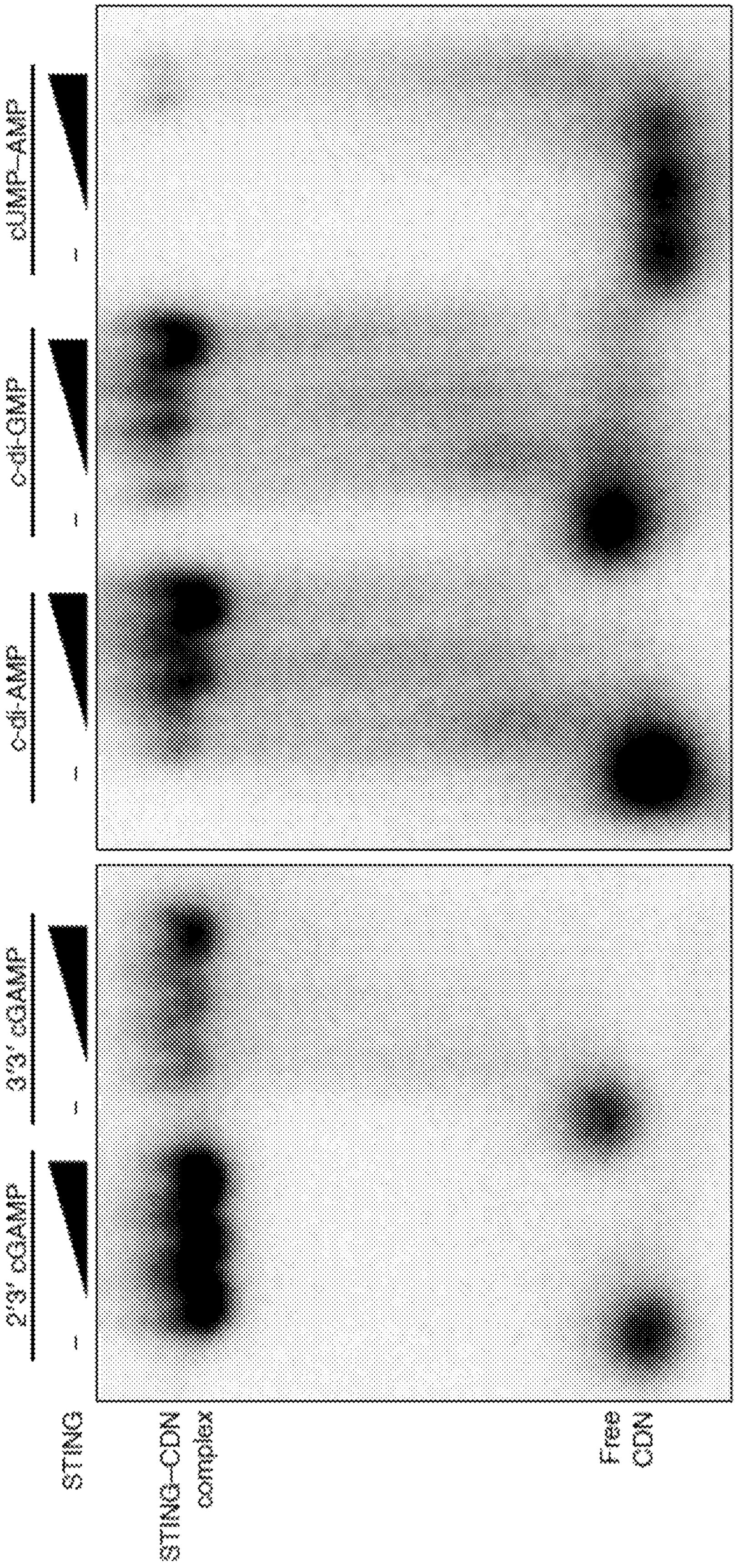
Figure 7B:
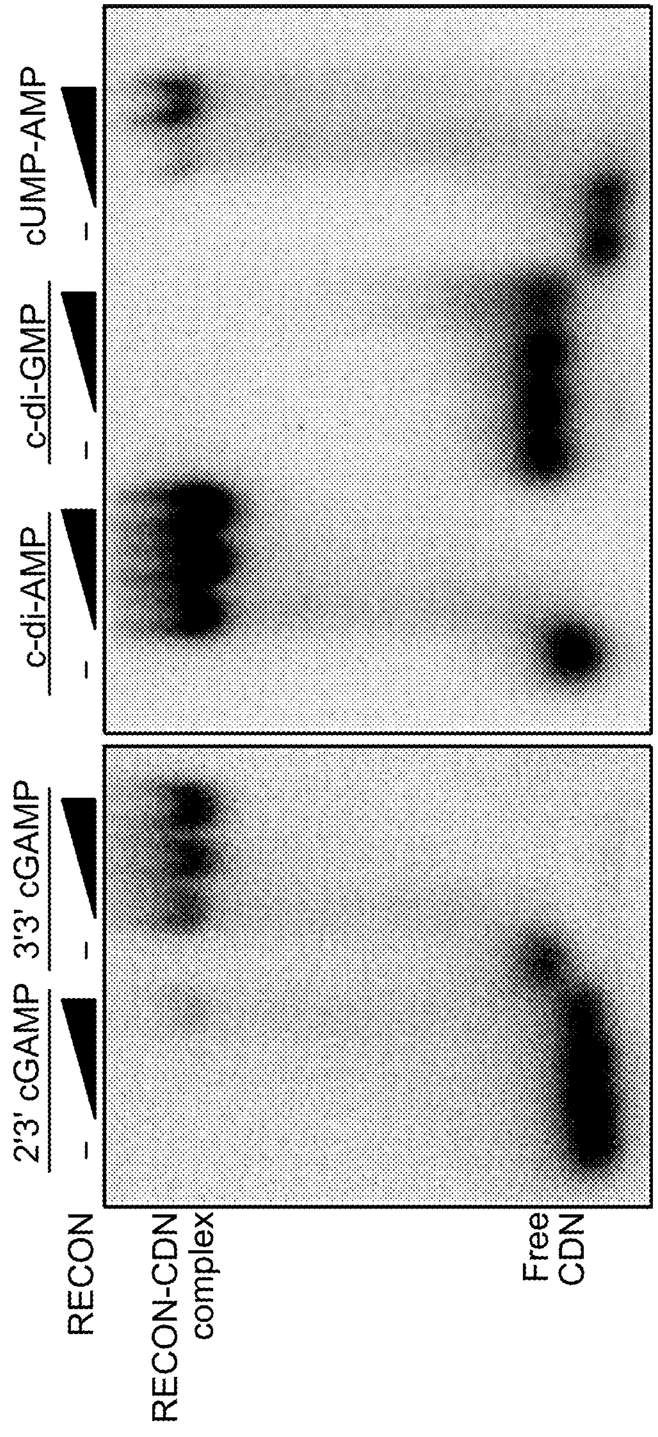
Figure 7C:
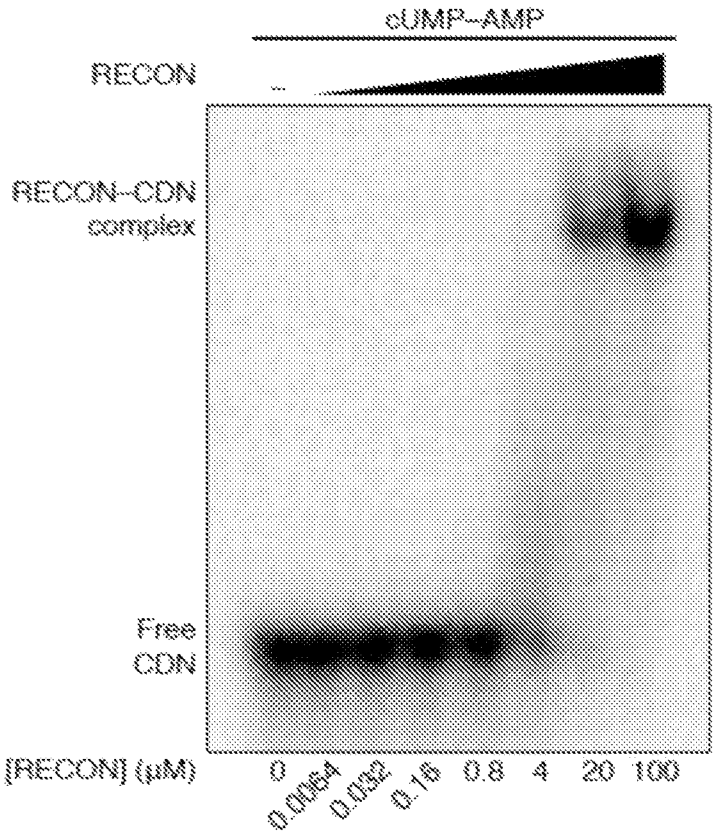
Figure 7D:
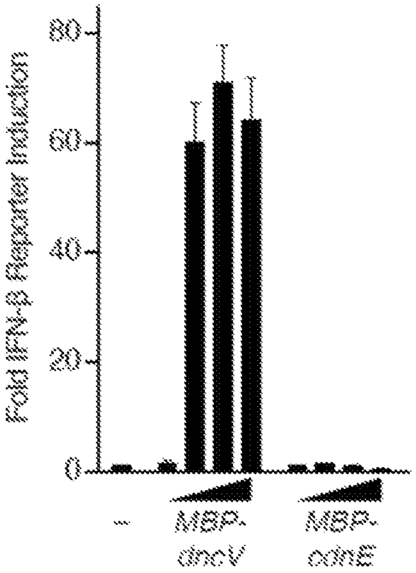
Figure 7E:
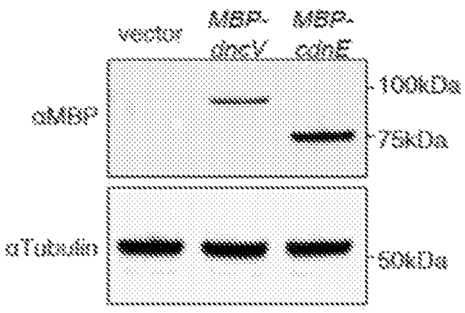

FIGS. 7A and 7B show gel shift analysis of the indicated radiolabeled nucleotide interactions with STING or RECON, separated by native PAGE. Proteins were titrated at 0 (−), 4, 20, and 100 μM. See FIGS. 6A and 6B for quantification. FIG. 7C shows detailed gel-shift analysis of the relative affinity of the cUMP-AMP interactions with RECON similar to FIG. 7B with protein concentrations listed below. FIG. 7D shows In-cell STING reporter assay. Induction of an IFN-β reporter in HEK293T cells transfected with a concentration gradient of plasmid overexpressing enzymes as indicated was shown. DncV and CdnE were expressed with N-terminal MBP tags and IFN-β was compared as fold over empty vector shown as (−). FIG. 7E shows western blot of MBP-tagged DncV and CdnE expressed from plasmids analyzed in FIG. 7B to validate in vivo expression.

Figure 8A:
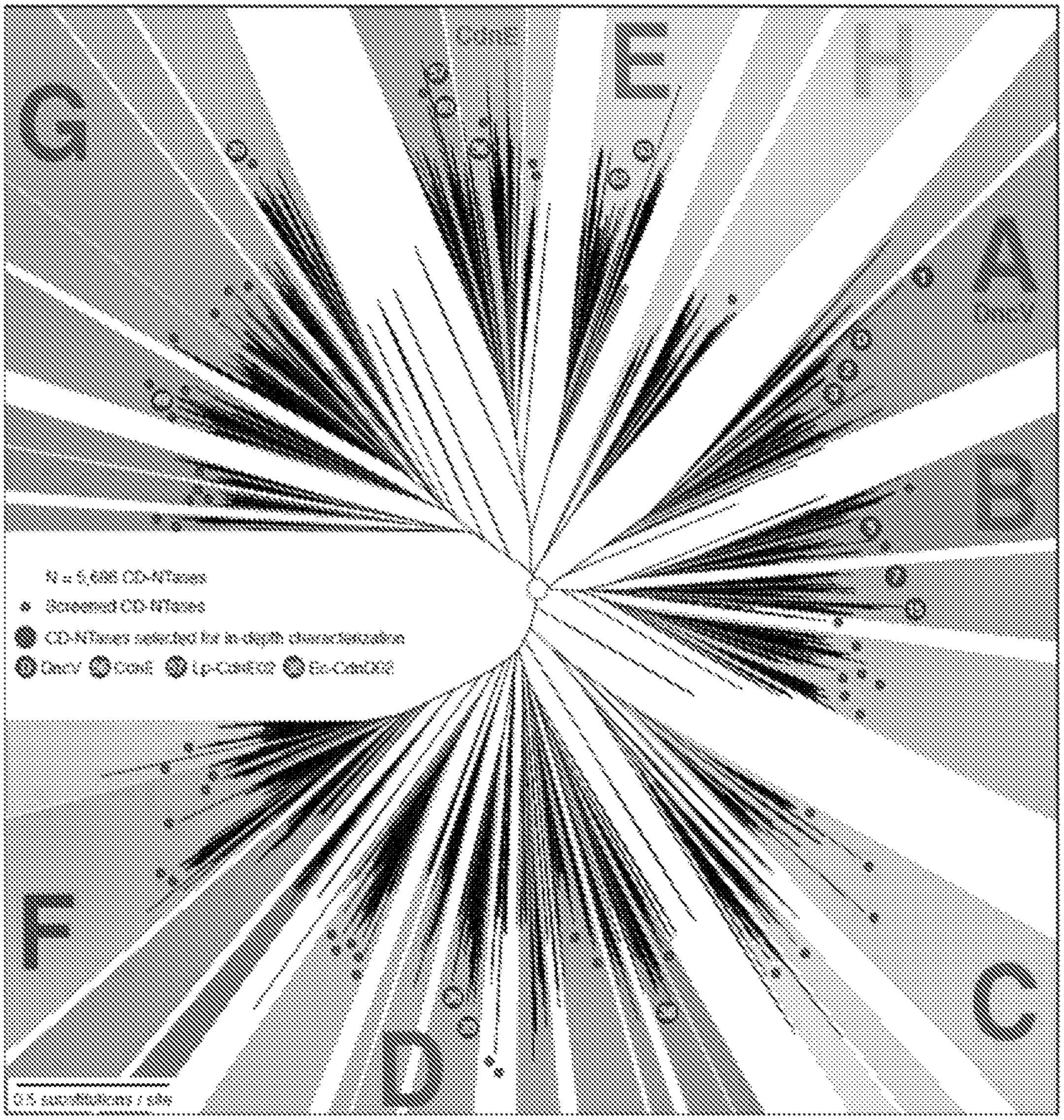
Figure 8B:
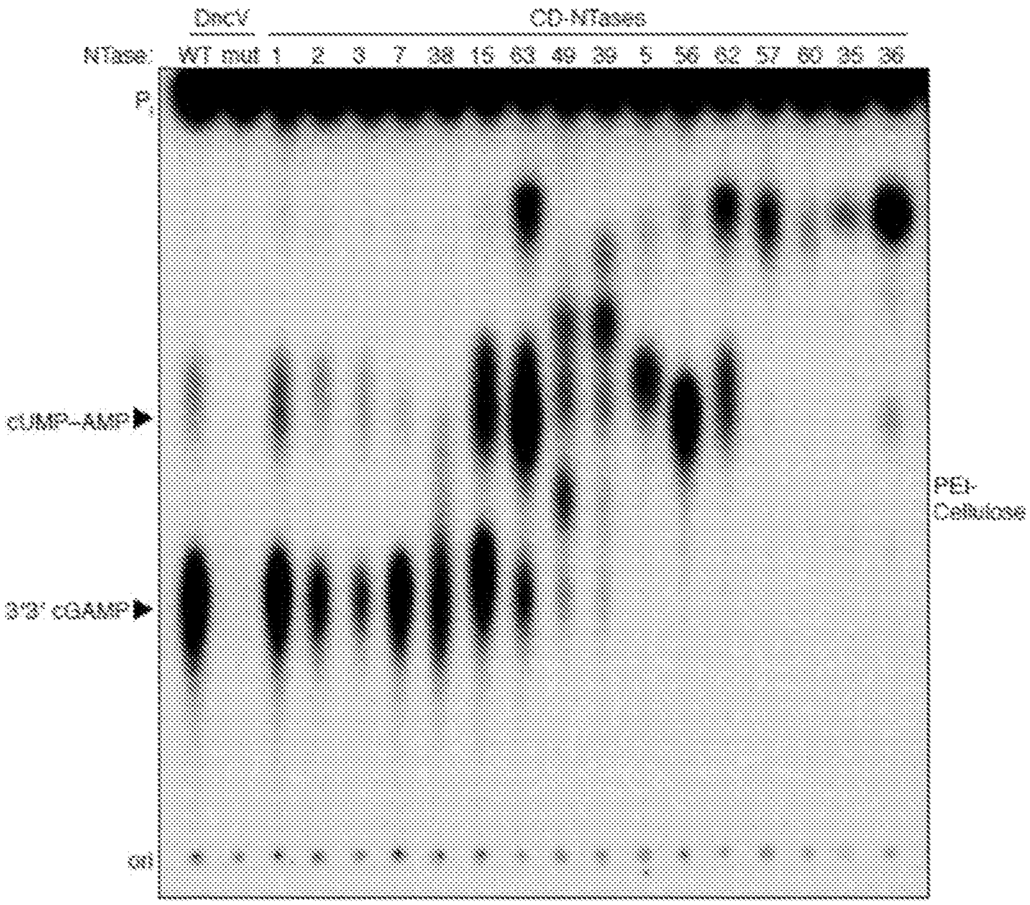
Figure 8C:
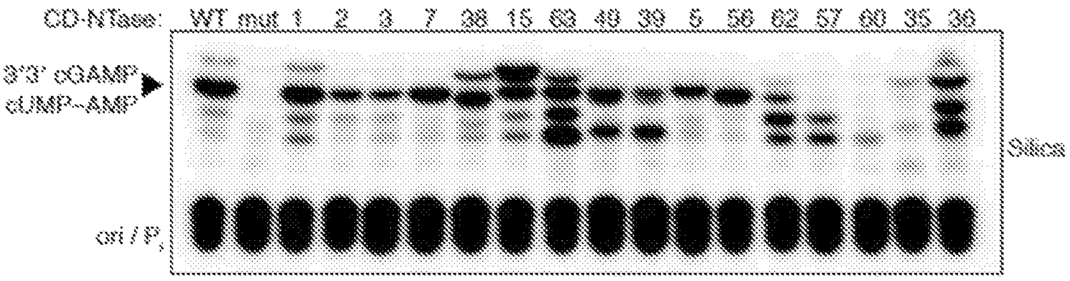
Figure 8D:
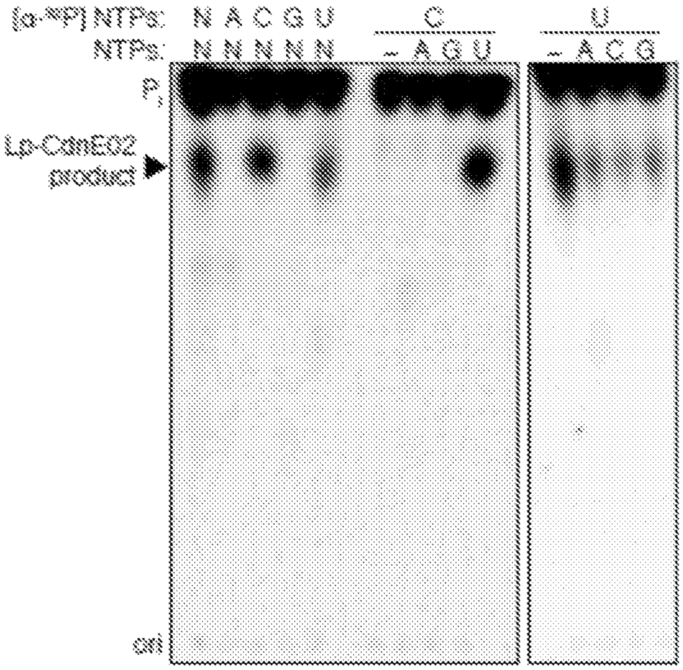
Figure 8E:
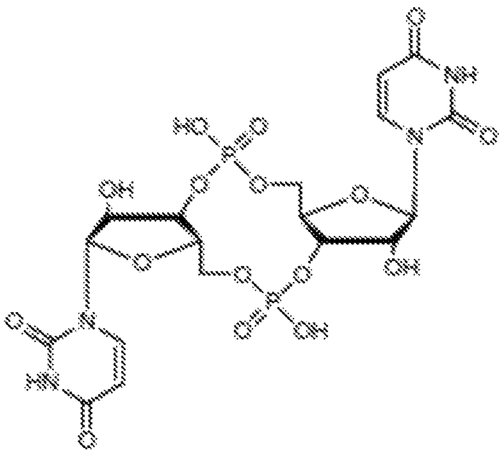
Figure 8F:
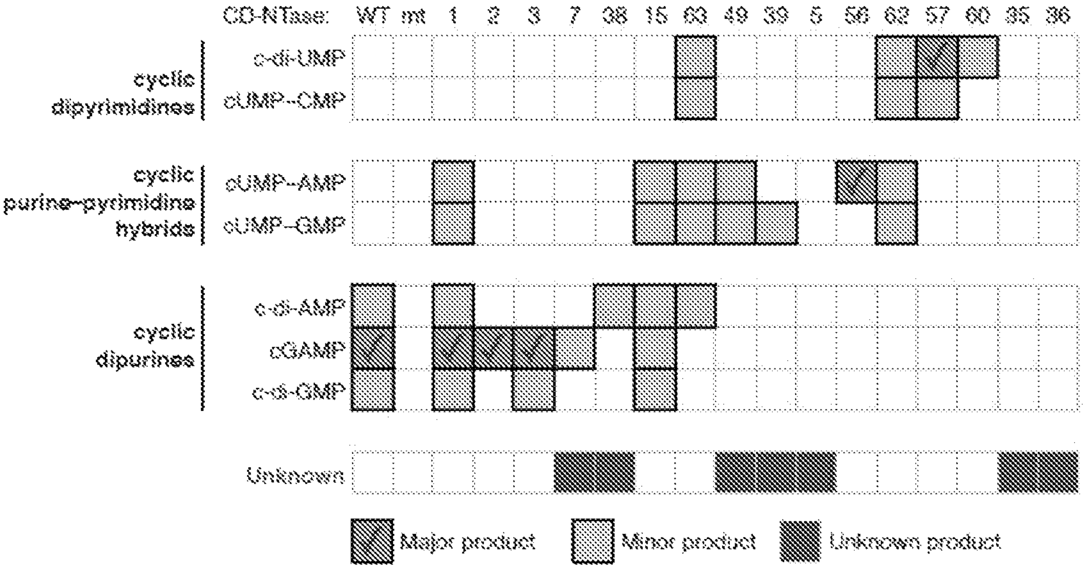

FIG. 8A-FIG. 8F show that CD-NTases synthesize 7 CDN combinations, and CD-NTases are a family of enzymes conserved in many bacterial phyla that synthesize diverse nucleotide products. FIG. 8A shows the bioinformatic identification and alignment of ~5,600 predicted CD-NTases found in nearly every bacterial phylum shown as an unrooted tree. Sequence-related enzymes with ~10% identical are grouped by lettered clade and similarly colored. Enzymes with ~25% identical are grouped by cluster in a similarly shaded color. Circles represent CD-NTase001-066 that were selected as type CD-NTases for a biochemical screen. Colors identify DncV, CdnE, and sequences were selected for in-depth characterization. See FIG. 9 for additional details. Blue circles denote CD-NTases selected for in-depth characterization and labeled with CD-NTase numbers from the biochemical screen (see FIG. 4*b*, CdnE is "56" and DncV is "D"). FIGS. 8B and 8C show PEI-Cellulose or Silica TLC analysis of the 16 most active enzymes identified in the CD-NTase screen incubated with [α-$^{32}$P] radiolabeled NTPs. Wild type (WT) and catalytically inactive (mut) DncV reactions are included as controls. Screened CD-NTases were numbered CD-NTase001-066. CD-NTase056 is CdnE, CD-NTase057 was renamed Lp-CdnE02, and CD-NTase038 was renamed Ec-CdnD02. FIG. 8D shows the biochemical deconvolution of Lp-CdnE02 (CD-NTase057) as in FIG. 1C, which demonstrates specific synthesis of cyclic dipyrimidine products. Recombinant protein was incubated with NTPs as indicated. FIG. 8E shows that MS confirmed synthesis of c-di-UMP as the major product of Lp-CdnE02. FIG. 8F shows the identification of CD-NTase products by combining TLC and MS data. CD-NTases that synthesize a major product that could not be matched with a predicted cyclic dinucleotide are denoted as "unknown."

Figure 9A:
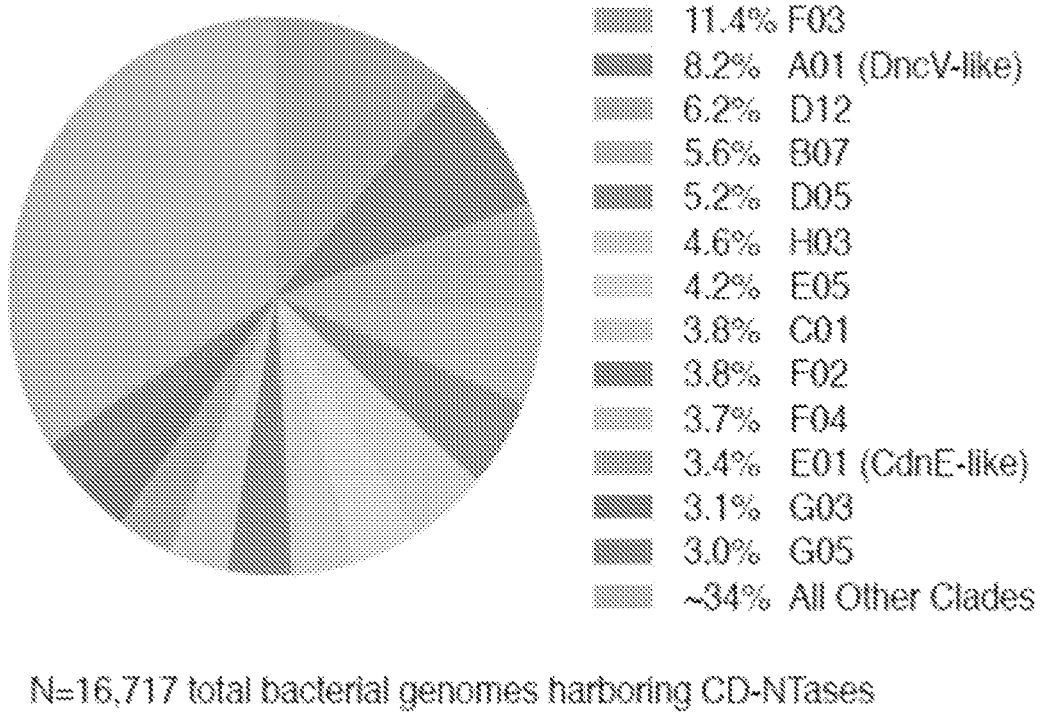
Figure 9B:
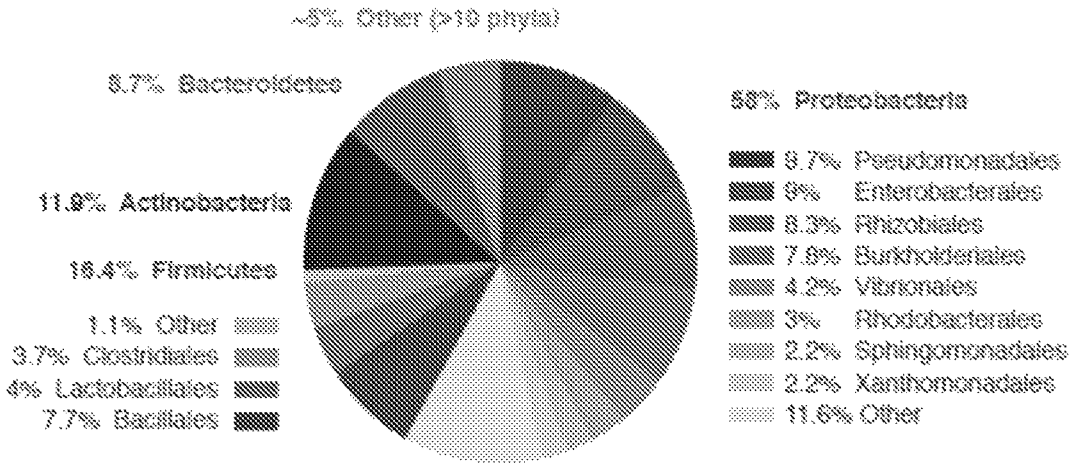
Figure 9C:
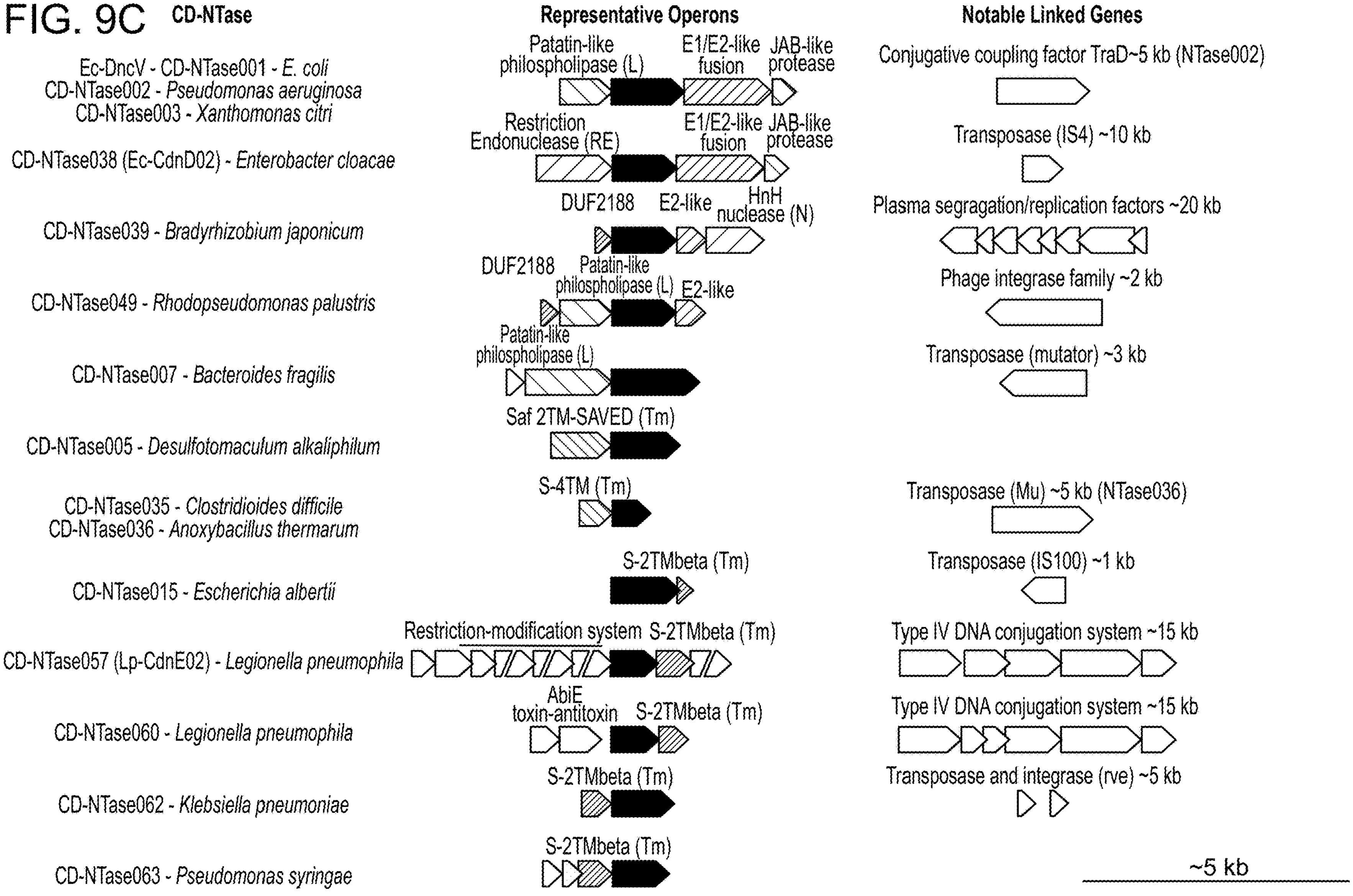
Figures 9D, 9E:
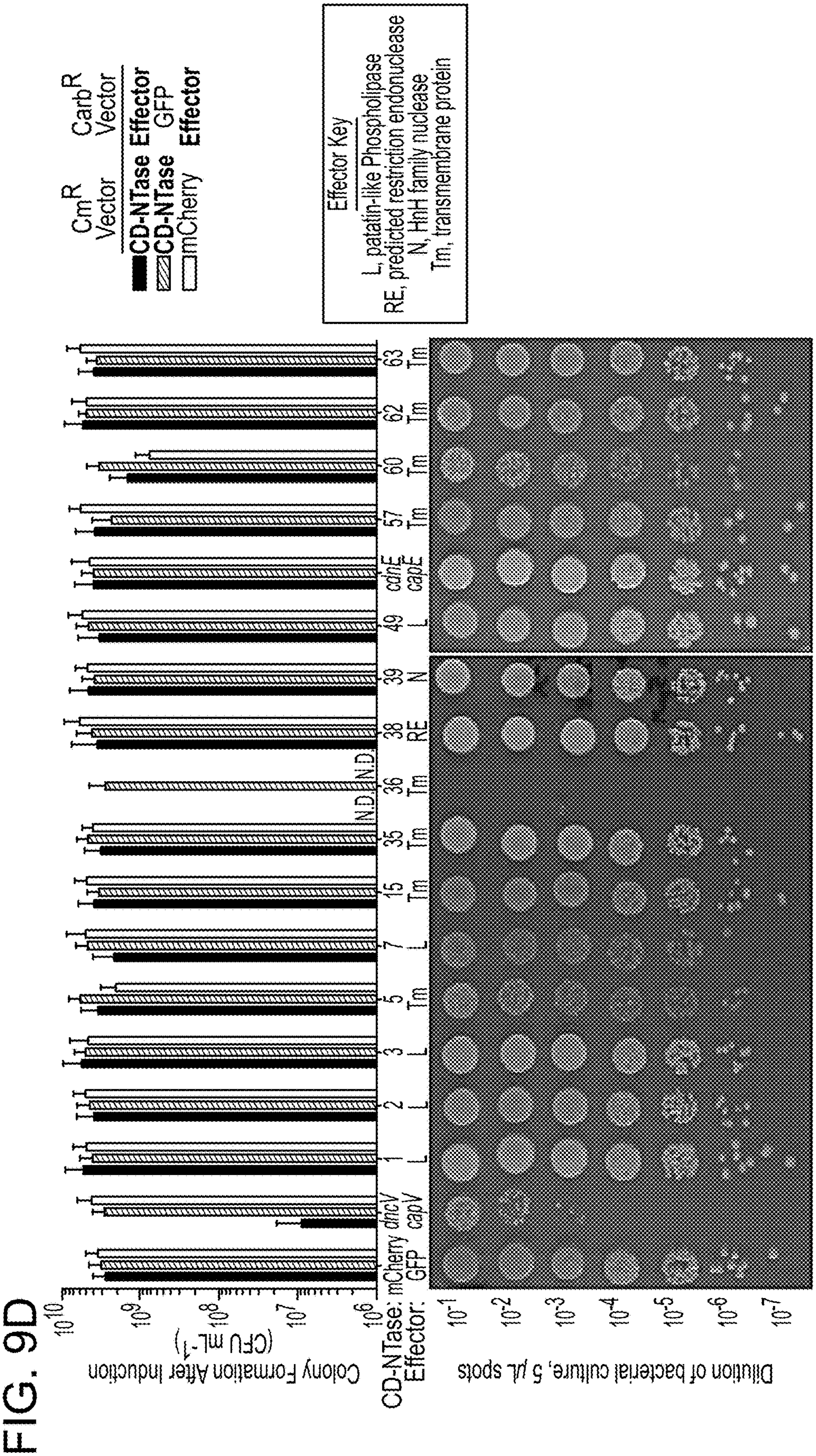

FIG. 9A-FIG. 9E show that CD-NTases are wide-spread and appear in similar operons. FIG. 9A shows the chart of the number of bacterial genomes (N=a total>16,000) that harbor CD-NTases from clusters in FIG. 8A. See also Tables 4A-4C. FIG. 9B show taxa of genome-sequenced bacteria from which unique CD-NTase genes were isolated. Bold indicates type and colors indicate phyla. Proteobacteria and Firmicutes are further divided by order and visualized by shades of color. FIG. 9C shows operon structure and adjacent genes encoding conserved protein domains for CD-NTases selected for in-depth characterization (see FIGS. 8A and 8B). Conserved operons were first identified by Burroughs et al. and operons are vertically organized by similarity to one another (Burroughs et al. (2015) *Nucleic Acids Res* 43:10633-10654). Where found, linked genes demonstrating CD-NTases are encoded on mobile genetic elements are indicated. FIG. 9D shows that CD-NTases and their adjacently encoded "effector" proteins were coexpressed in *E. coli* and bacterial colony formation was quantified. CD-NTases were inducibly expressed from a chloramphenicol resistant (CmR) vector and effectors were inducibly expressed from a carbenicillin resistant (CarbR) vector. Bacteria harboring cognate CD-NTase/effector plasmids or control plasmids were plated on inducer and incubated for 24 h at 37° C. Data were not determined (N. D.) for CD-NTase036 because the effector was toxic to *E. coli* under non-inducing conditions. FIG. 9E shows the spot dilution analysis of bacteria harboring the cognate CD-NTase-Effector pair as indicated. The CD-NTase036/effector pair was not analyzed in this assay. Colony morphology indicates a potential interaction for some combinations.

Figure 10A:
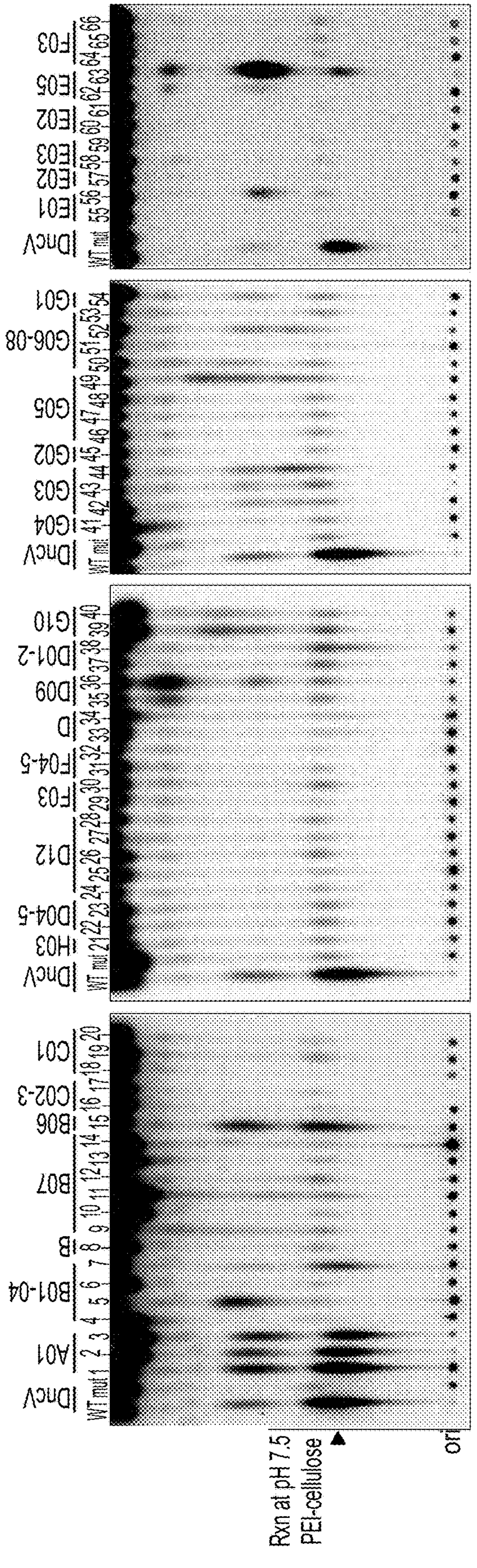
Figure 10B:
Figure 10C:
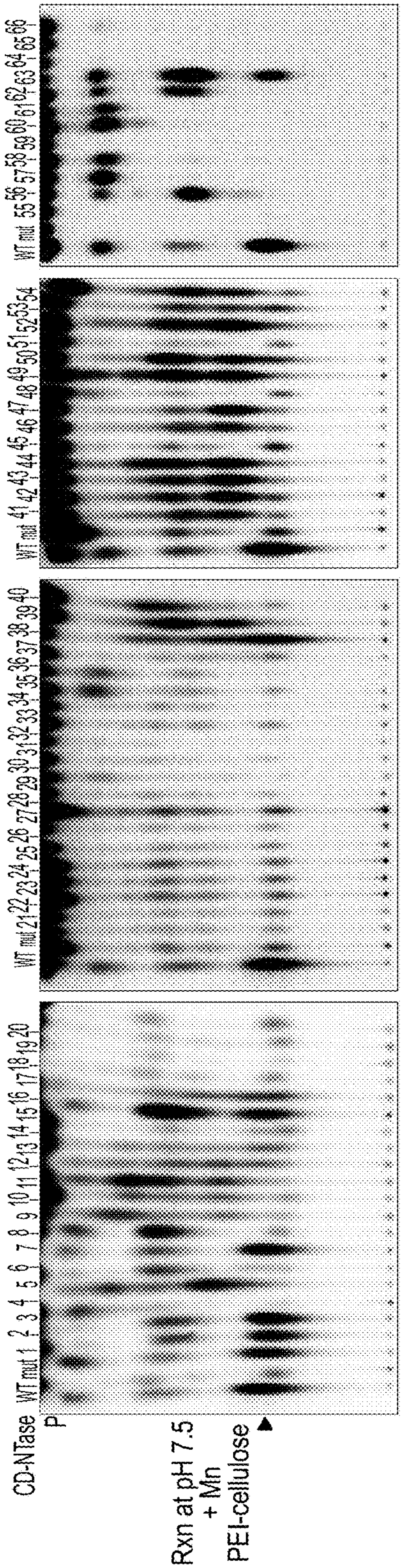
Figure 10D:
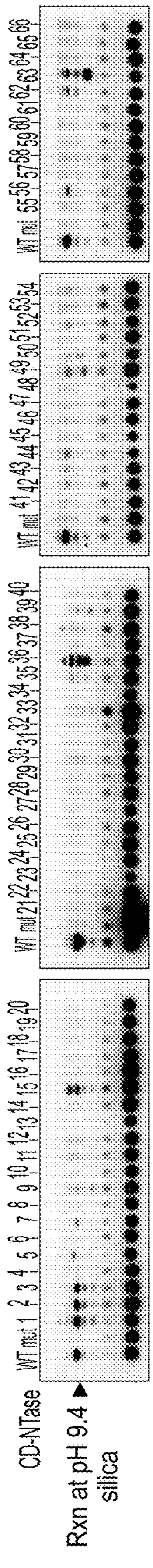
Figure 10E:
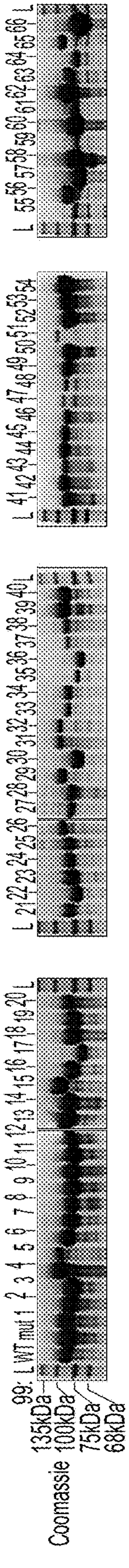

FIG. 10A-FIG. 10E show a biochemical screen of 66 CD-NTases from bacteria. FIGS. 10A-10D show that different types of CD-NTases were interrogated for product synthesis. Purified proteins were incubated with [α-$^{32}$P] radiolabeled NTPs under different reaction conditions (i.e., indicated pH and divalent cation) and reaction products were visualized by either PEI-cellulose or Silica TLC as in FIG. 1B and FIG. 8C. FIG. 10E shows the expression level and purity of each CD-NTase. Coomassie stained SDS-PAGE gels estimated CD-NTase levels in each reaction.

Figure 11A:
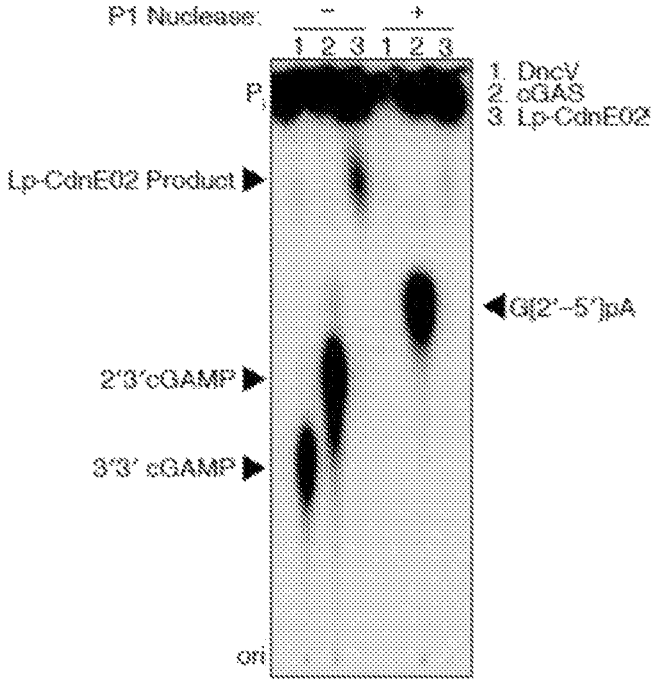
Figure 11B:
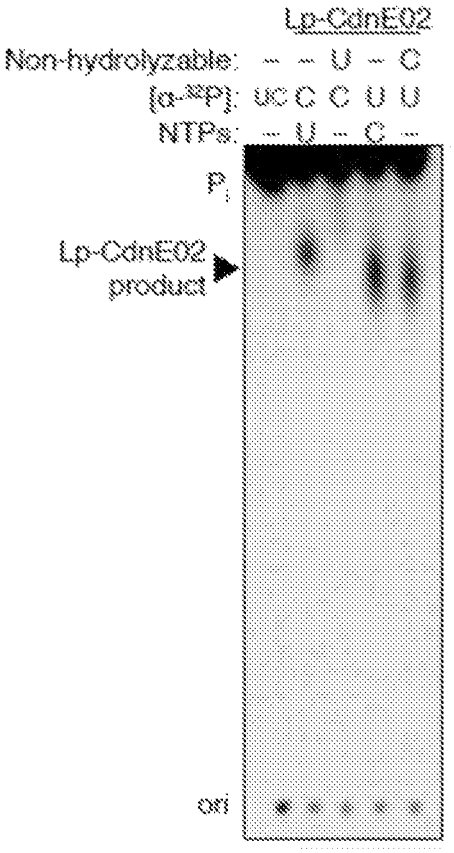
Figure 11C:
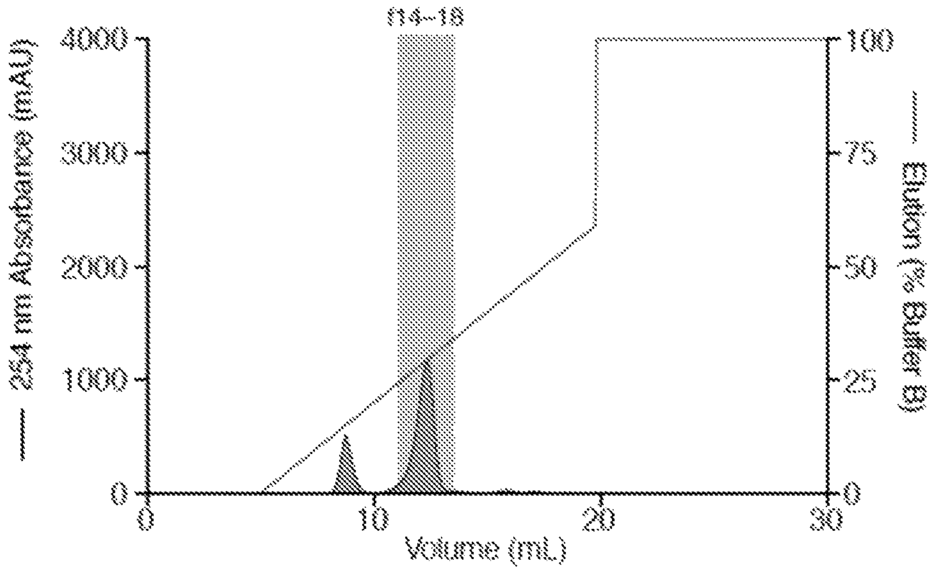
Figure 11D:
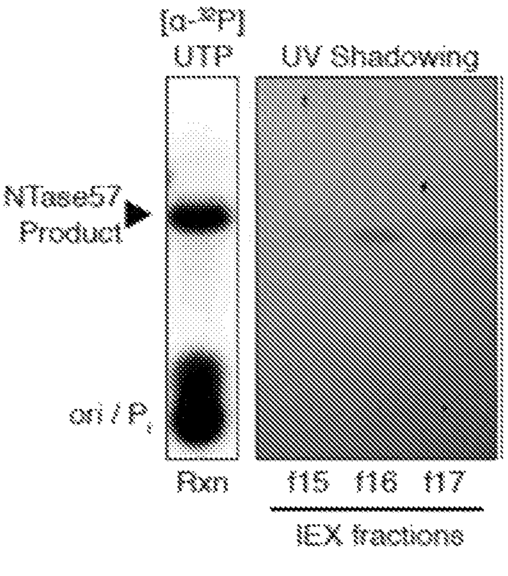
Figure 11E:
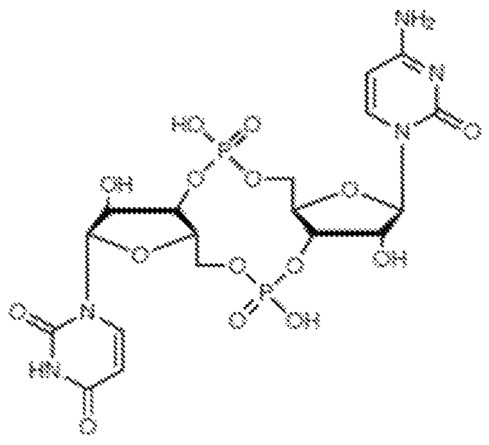

FIG. 11A-FIG. 11E show the detailed biochemical analysis of Lp-CdnE02. FIG. 11A shows the nuclease sensitivity of the Lp-CdnE02 product, as described in FIG. 2C. FIG. 11B shows incubation of Lp-CdnE02 with nonhydrolyzable nucleotides, as described in FIG. 2G-2I. Nonhydrolyzable UTP completely blocked the reaction, indicating the first step requires attack of the a-P from UTP. FIG. 11C shows the anion exchange chromatography of an Lp-CdnE02 reaction with UTP and CTP, eluted with a gradient of Buffer B (2 M ammonium acetate) by FPLC. Individual fractions were concentrated prior to pooling for further analysis. FIG. 11D shows anion exchange chromatography (IEX) fractions from FIG. 11C were separated by silica TLC, visualized by UV shadowing, and compared to a radiolabeled reaction to confirm the appropriate peak. Fractions were pooled and concentrated prior to MS analysis. FIG. 11E shows that mass spectrometry confirmed synthesis of c-di-UMP as the major product (see FIG. 8E) and cCMP-UMP as a minor product of Lp-CdnE02, cCMP-UMP shown here.

Figure 12A:
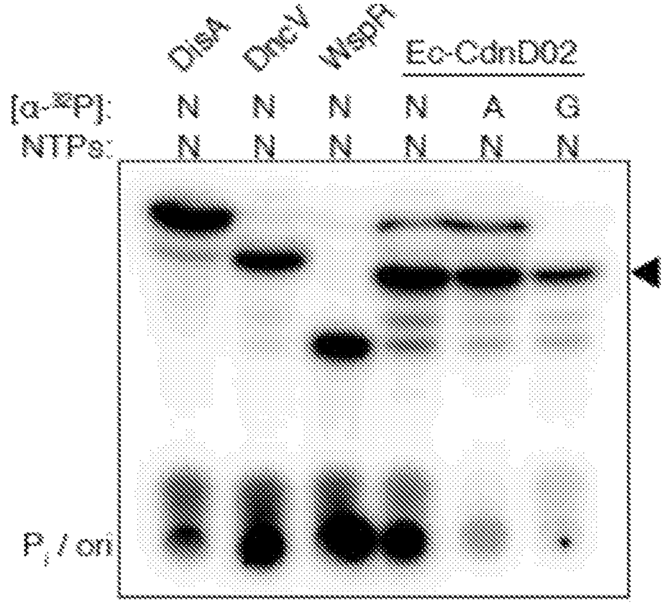
Figure 12B:
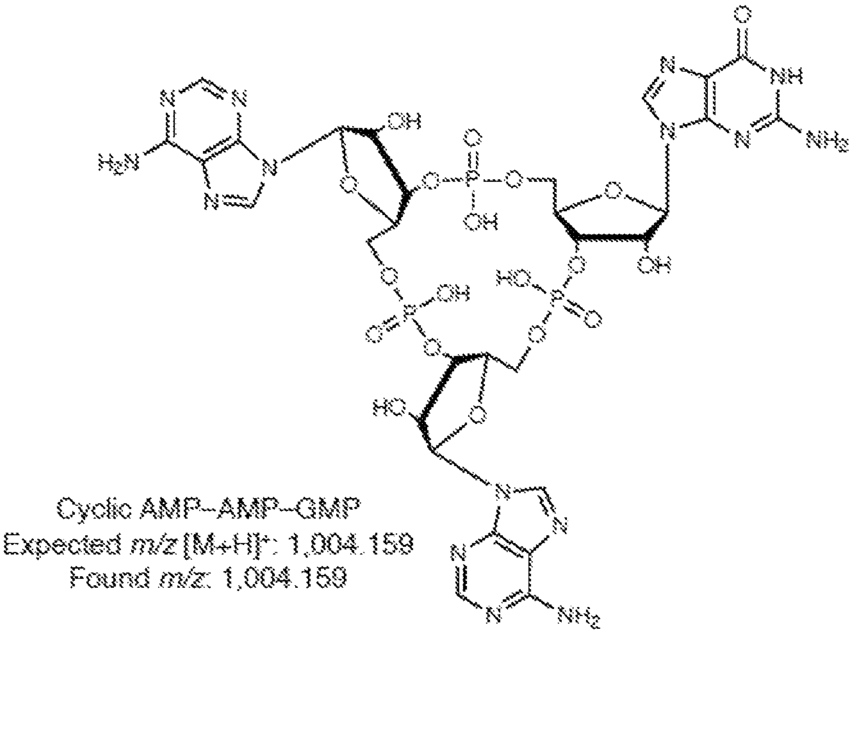
Figure 12C:
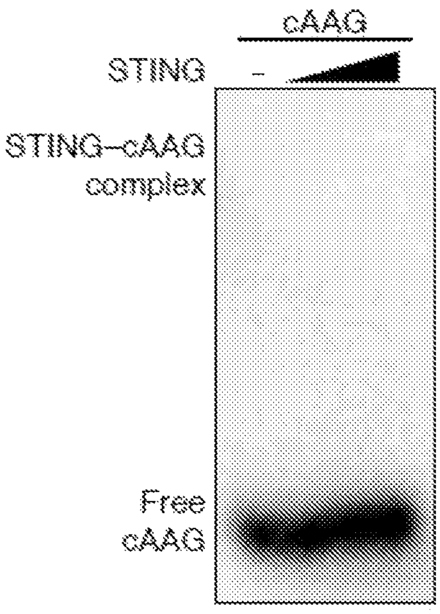
Figure 12D:
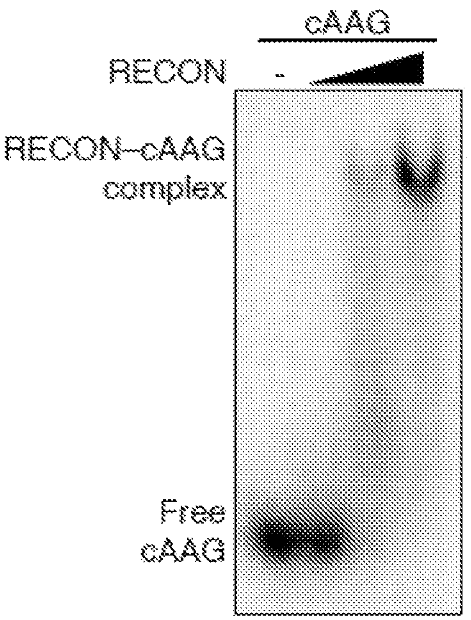
Figure 12E:
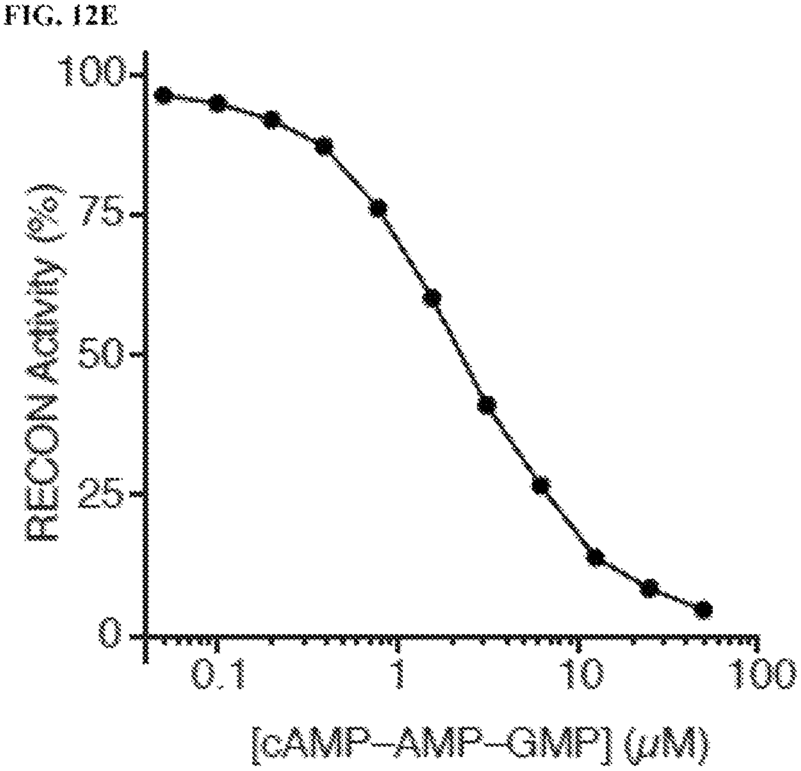
Figure 12F:
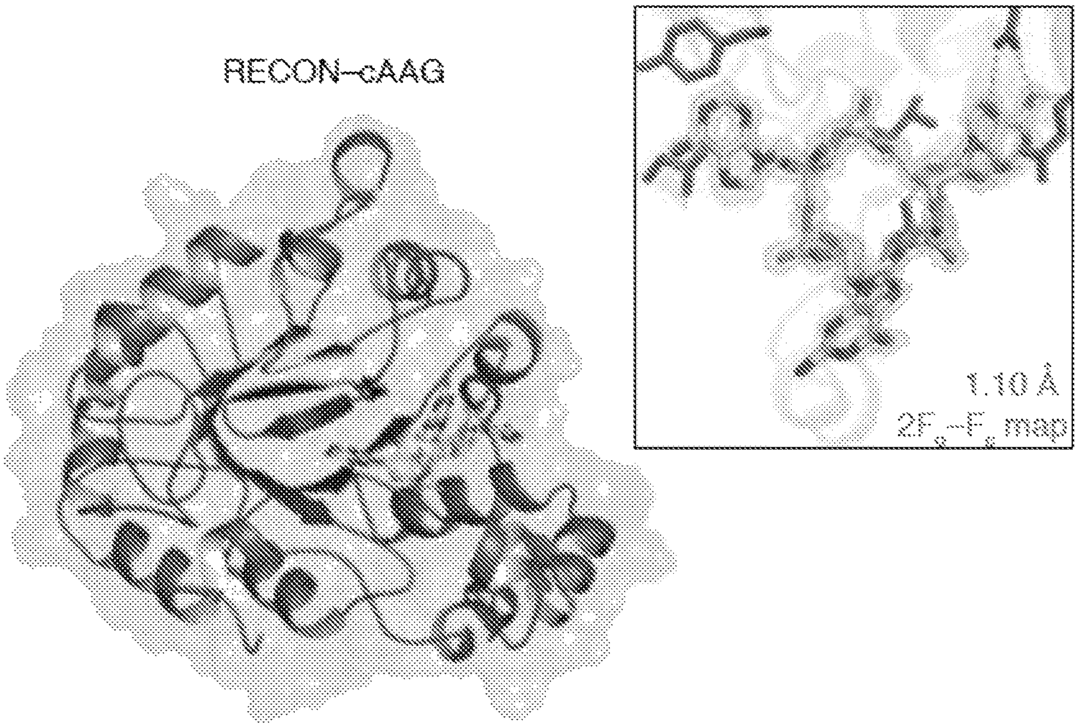

FIG. 12A-FIG. 12F show bacteria synthesis and host recognition of a cyclic trinucleotide second messengers. FIG. 12A shows silica TLC analysis of Ec-CdnD02. Control reactions produced c-di-AMP (DisA), 3'3' cGAMP (DncV), and c-di-GMP (WspR). The major product of Ec-CdnD02 is indicated with a triangle and incorporated ~70% [α-$^{32}$P] from ATP and ~30% [α-$^{32}$P] from GTP. FIG. 12B shows the major product of Ec-CdnD02, cyclic AMP-AMP-GMP (cAAG), confirmed by MS and NMR, see FIG. 13 for additional characterization. FIGS. 12C and 12D show the cAAG interactions with STING or RECON. Radiolabeled nucleotide was incubated with a concentration gradient of each protein, separated in a native PAGE gel shift (0, 4, 20, 100 μM protein). FIG. 12E shows the cAAG inhibition of RECON enzymatic activity, as measured by oxidation of NADPH cosubstrate. FIG. 12F shows the co-crystal structure of the host receptor RECON in complex with cAAG, and inset highlighting the cAAG 2Fo-Fc electron density contoured at 1.3 σ. Greed dotted lines indicate hydrogen bonding. Some RECON-cAAG contacts are omitted for clarity (also see FIG. 17).

Figure 13A:
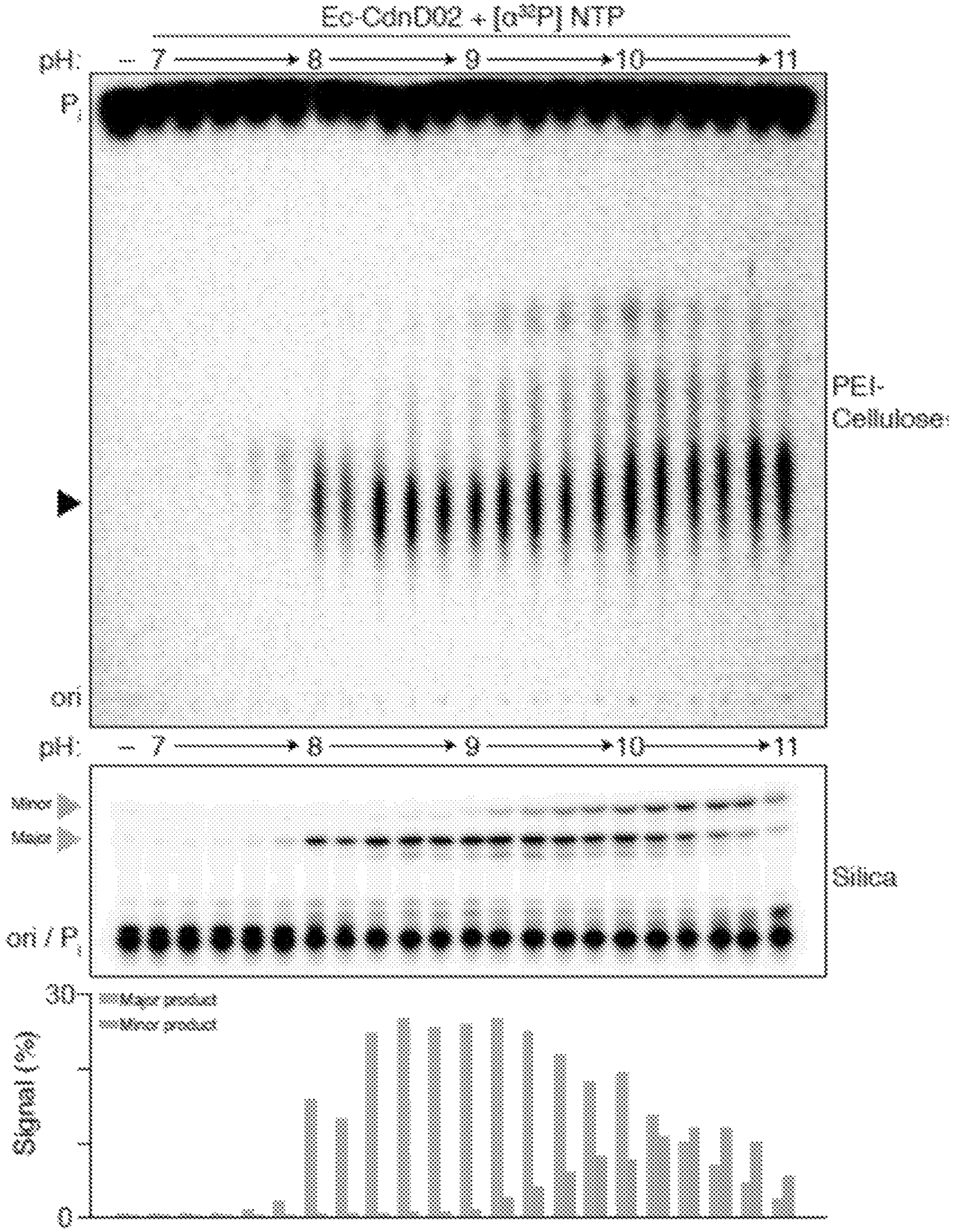

FIG. 13A-FIG. 13J show the detailed biochemical analysis of Ec-CdnD02. FIG. 13A shows the titration of reaction buffer pH in steps of 0.2 pH units. Recombinant Ec-CdnD02 was incubated with [α-$^{32}$P] radiolabeled NTPs at varying pH and the reactions were visualized by PEI-cellulose or silica TLC. Silica TLC identified two products, denoted the major (blue triangle) and minor (red triangle) product. Quantification of TLC spots is shown below.

Figure 13B:
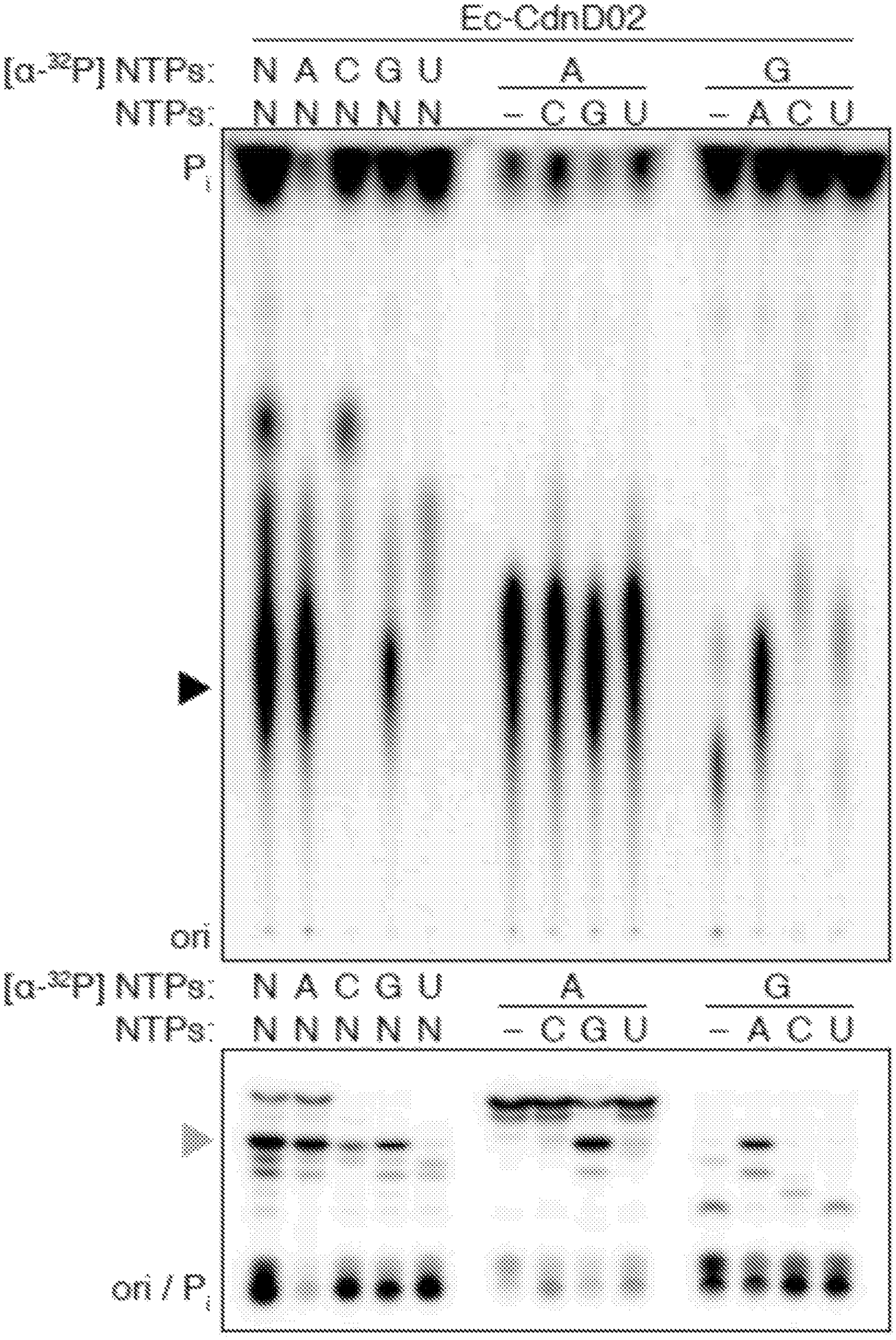
Figure 13C:
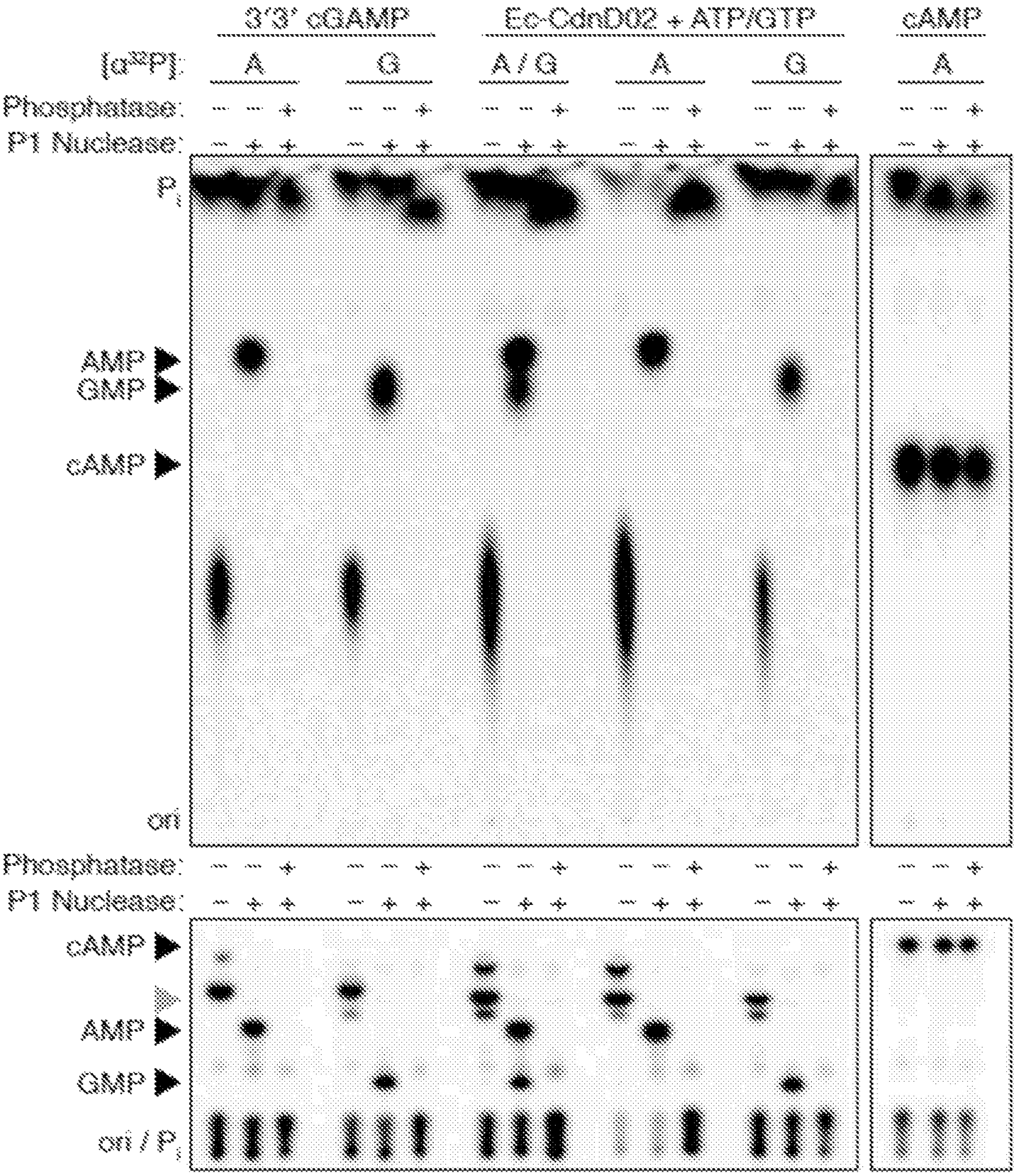
Figure 13D:
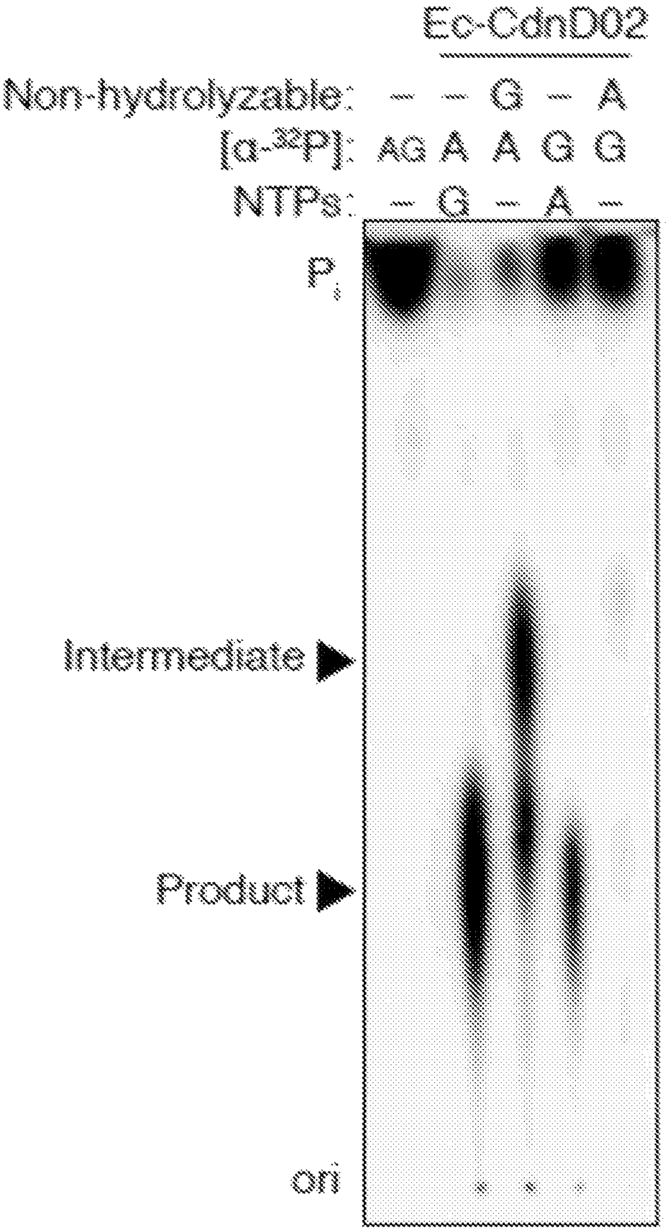
Figure 13E:
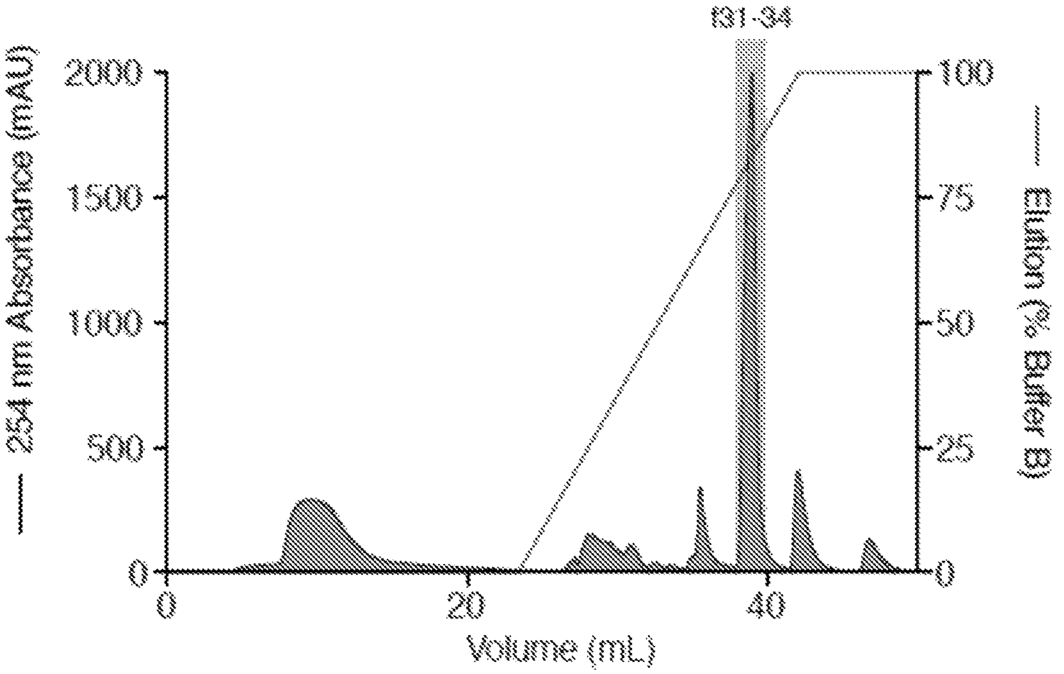
Figure 13F:
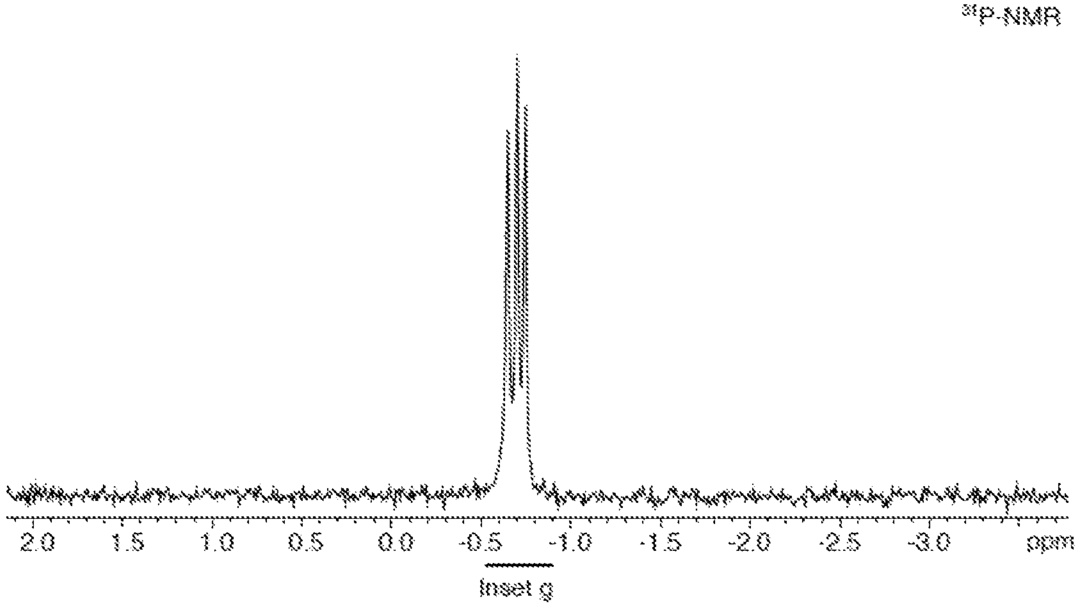
Figure 13G:
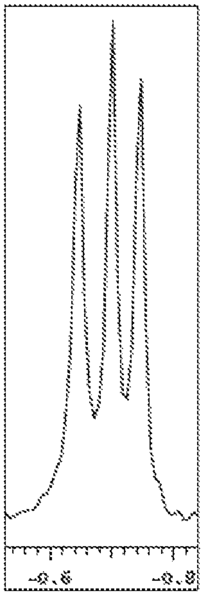

FIG. 13B shows biochemical deconvolution of Ec-CdnD02. Recombinant protein was incubated with NTPs as indicated and analyzed by TLC. FIG. 13C shows the nuclease digestion of the Ec-CdnD02 product. Conventional nuclease digestion includes addition of a phosphatase. In this experiment, reactions were first treated with Antarctic phosphatase to remove unused NTPs then heat inactivated. Next, reactions were either untreated, treated with P1 endonuclease (specific for 3'-5' phosphodiester bonds) only, or treated with P1 and phosphatase to remove exposed phosphate groups. 3'3' cGAMP (DncV) and Ec-CdnD02 product were digested into AMP and GMP constituents, which are phosphatase sensitive. CAMP (CyaA) was insensitive to P1 digestion and cyclic monophophates were phosphatase resistant. These data ruled out a cyclic monophosphate in the Ec-CdnD02 product. FIG. 13C shows the incubation of Ec-CdnD02 with nonhydrolyzable nucleotides, as described in FIGS. 2G-2I. Nonhydrolyzable ATP completely blocked the reaction, indicating the first step requires attack of the a-P from ATP. FIG. 13E shows anion exchange chromatography of an Ec-CdnD02 reaction with ATP and GTP, eluted with a gradient of Buffer B (2 M ammonium acetate) by FPLC. Individual fractions were concentrated prior to pooling for further analysis. FIG. 13F and FIG. 13G show 3'3'3' tricyclic adenosine monophosphate-adenosine monophosphate-guanosine monophosphate (cAAG) NMR spectra and associated zoomed-in dataset. $^{31}$P {$^{1}$H} NMR (162 MHZ): $\delta_P$-0.65 (s, 1P),-0.70 (s, 1P),-0.75 (s, 1P).

Figure 13H:
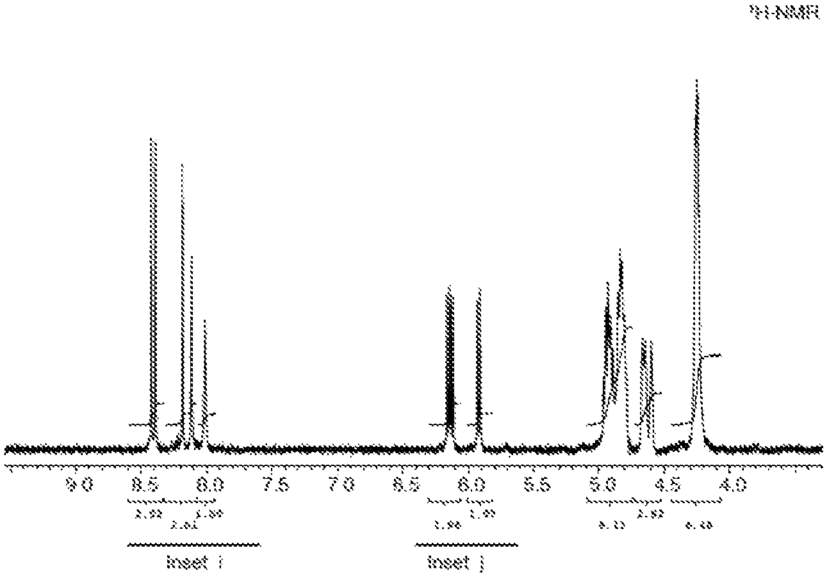
Figure 13I:
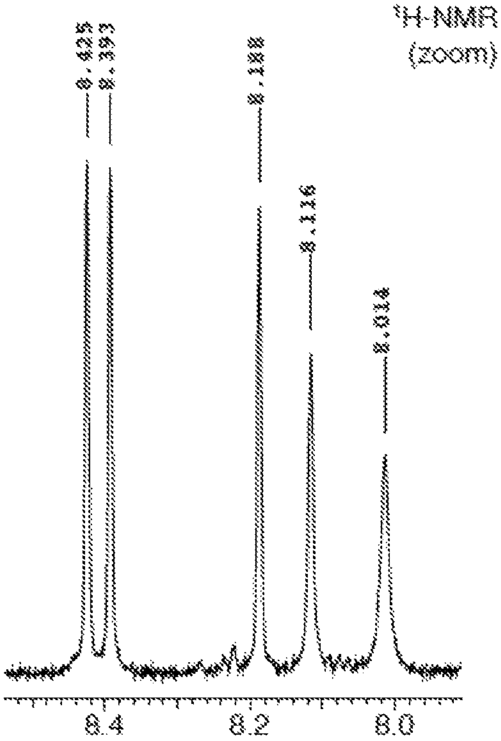
Figure 13J:
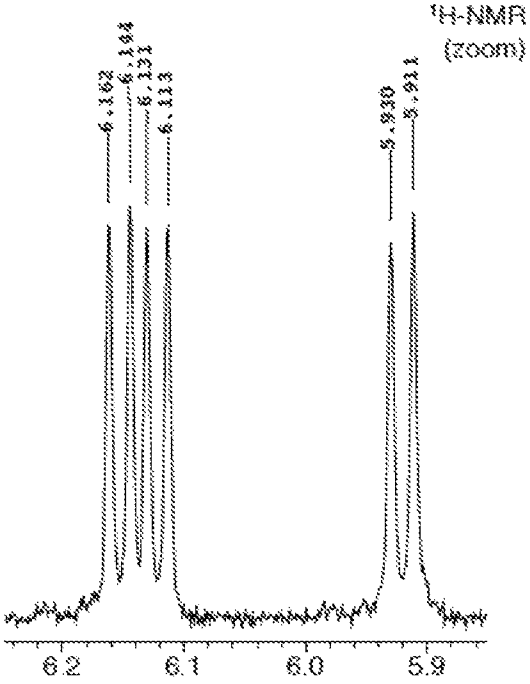

FIGS. 13H-13J show that 3'3'3' tricyclic adenosine monophosphate-adenosine monophosphate-guanosine monophosphate (cAAG) proton NMR spectra and associated zoomed-in datasets. $^{1}$H NMR (400 MHZ): $\delta_H$ 8.43 (s, 1H), 8.39 (s, 1H), 8.19 (s, 1H), 8.12 (s, 1H), 8.01 (s, 1H), 6.15 (d, J=7.0 Hz, 1H), 6.12 (d, J=7.0 Hz, 1H), 5.92 (d, J=7.5 Hz, 1H), 5.00-4.78 (m, 6H), 4.69-4.58 (m, 3H), 4.3-4.2 (m, 6H).

Figure 14:
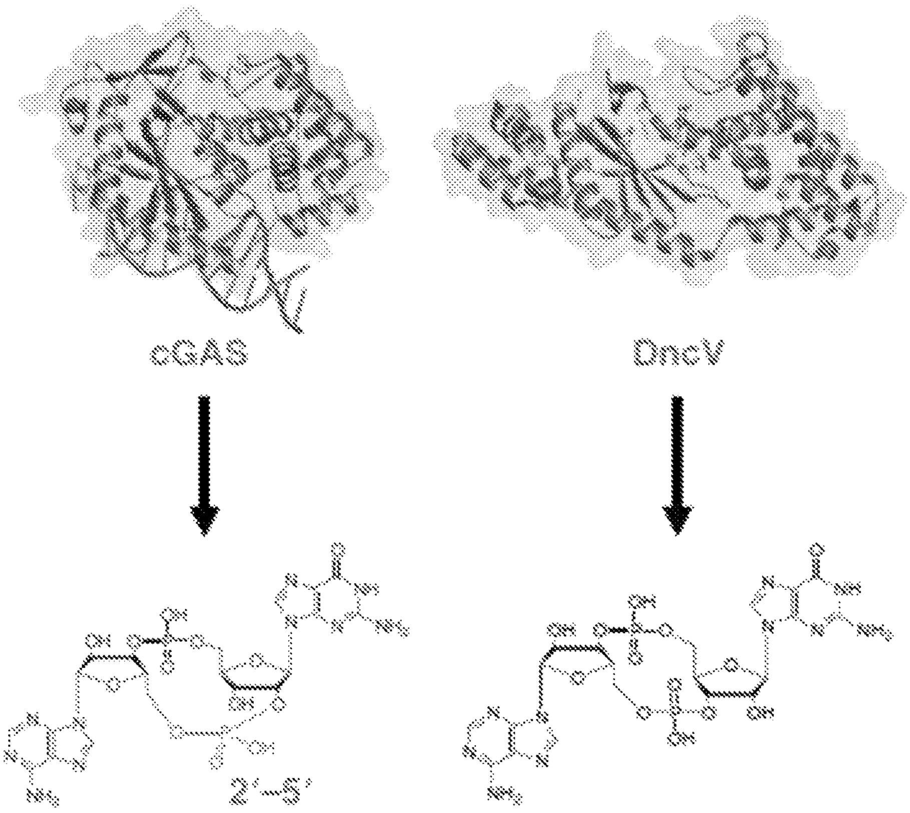

FIG. 14 shows the structure of cGAS and DncV, and their nucleotide products.

Figure 15A:
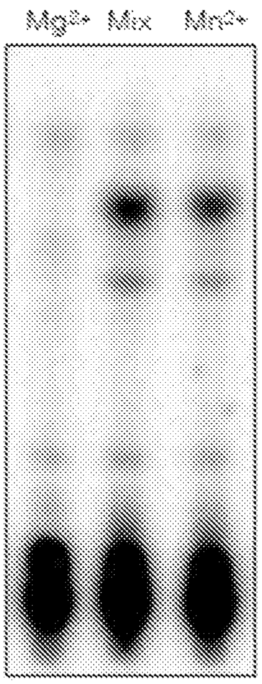

FIG. 15A-FIG. 15 C show the structure of a CD-NTase from clade D and the detection of the nucleotide products.

Figure 16:
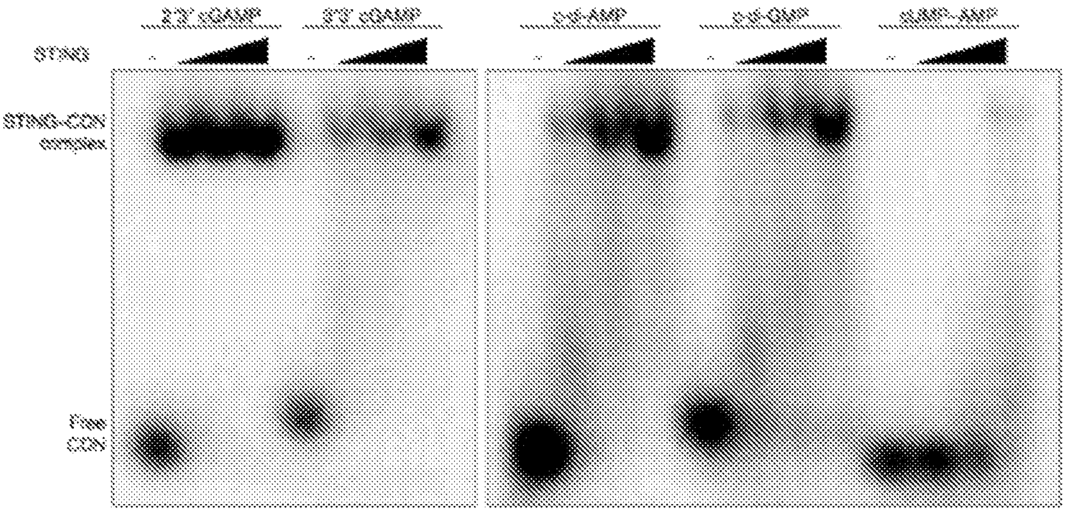

FIG. 16 shows the regulation of STNG or RECON activity by different cyclic dinucleotides.

Figure 17A:
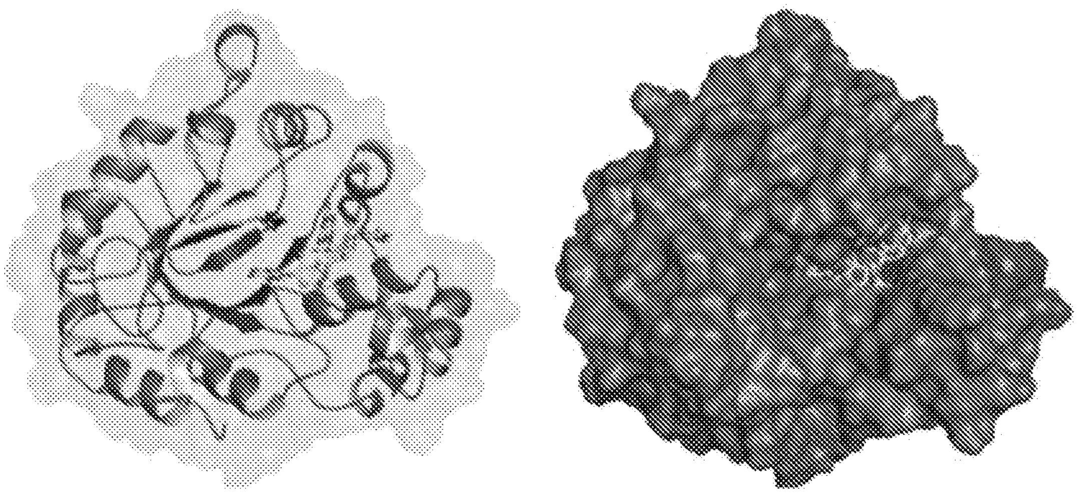
Figure 17B:
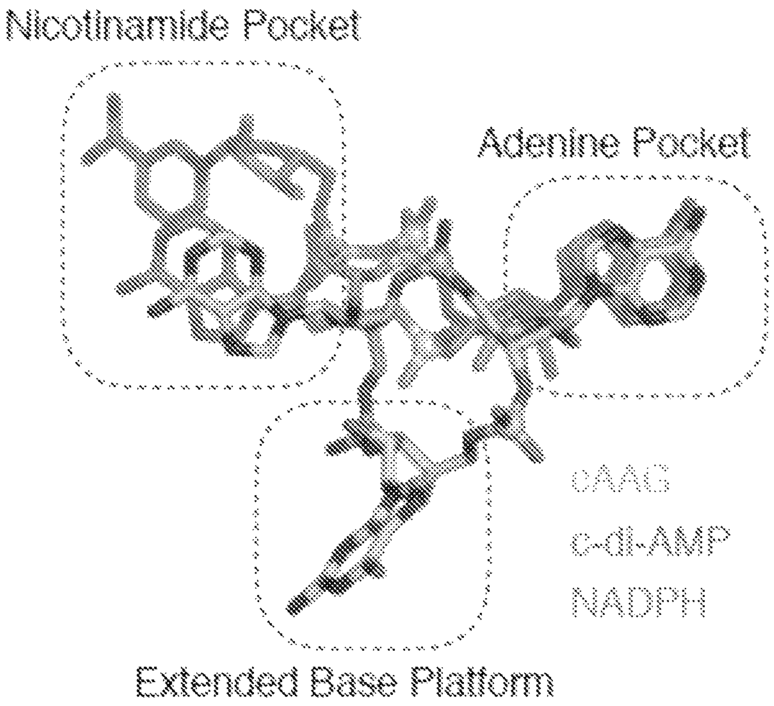
Figure 17C:
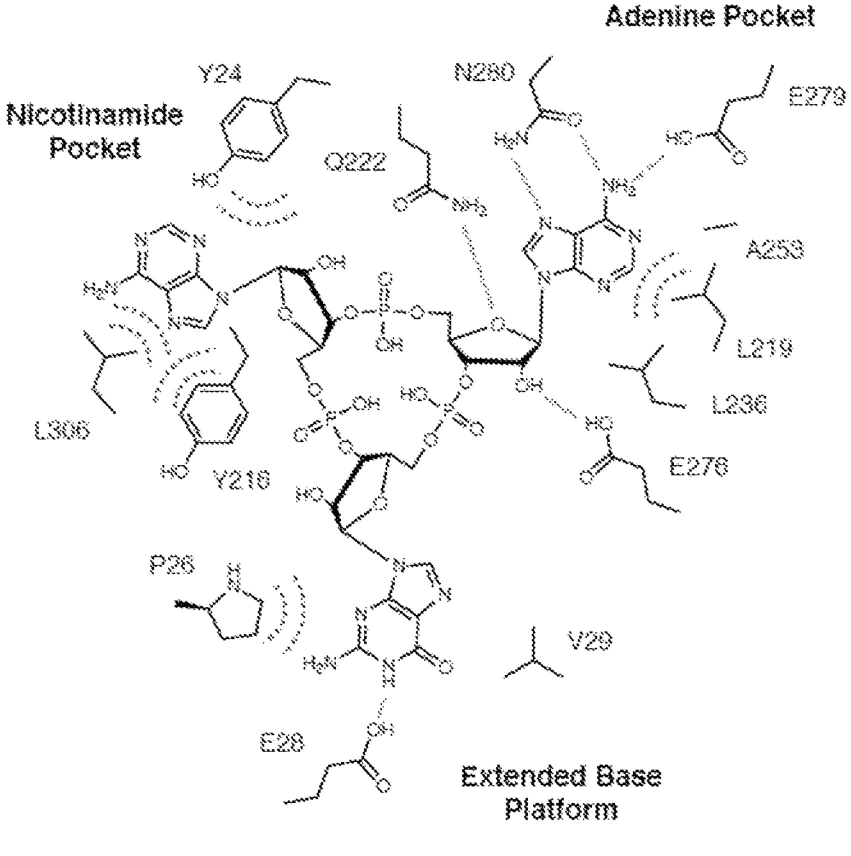
Figure 17D:
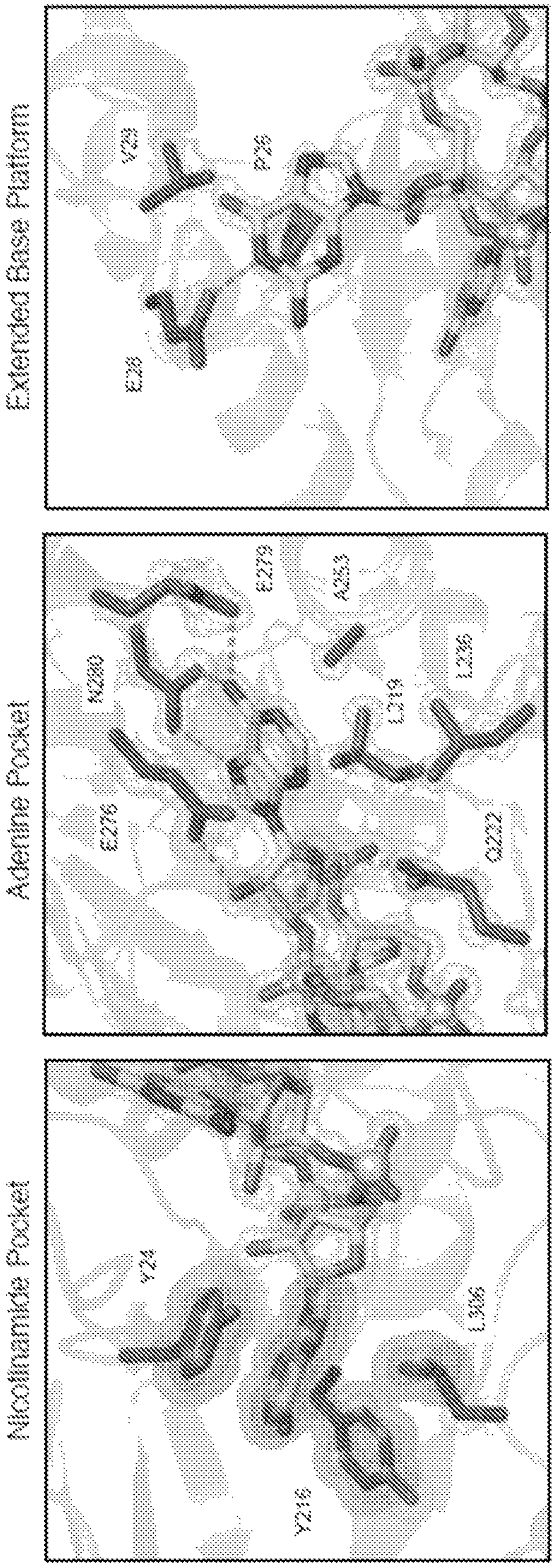
Figure 17E:
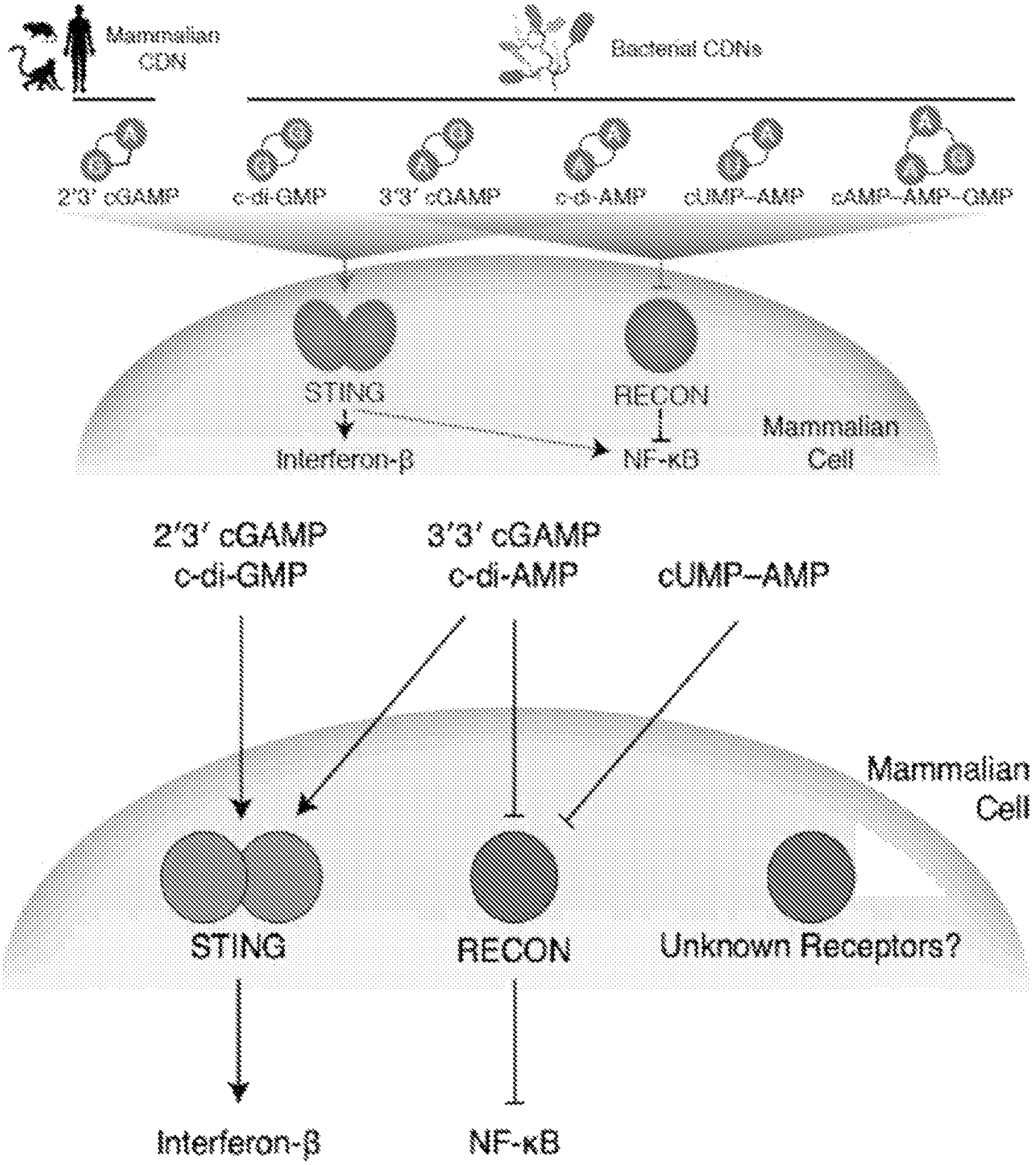

FIG. 17A-17E show structural analysis of cAAG inhibition of RECON. FIG. 17A shows the co-crystal structure of the RECON-cAAG complex as cartoon 1064 (left) and surface (right). FIG. 17B shows that overlay and orientation of RECON ligands cAAG, c-di-AMP (5UXF28), cosubstrate NAD (3LN3) demonstrate three individual binding pockets. FIG. 17C shows schematic representation of residues from RECON that interact with cAAG. Green dotted lines indicate hydrogen bonding, and grey dotted lines indicate hydrophobic interactions. FIG. 17D shows zoom-in cutaways of individual RECON binding pockets as in FIG. 17C. FIG. 17E shows that 2'3' cGAMP and c-di-GMP were detected by STING; 3'3' cGAMP and c-di-AMP were detected by both STING and RECON; and cUMP-AMP and cAAG were detected by RECON.

For any figure showing a bar histogram, curve, or other data associated with a legend, the bars, curve, or other data presented from left to right for each indication correspond directly and in order to the boxes from top to bottom of the legend.

DETAILED DESCRIPTION OF THE INVENTION

The present invention is based, at least in part, on the elucidation of the diversity of products synthesized by a family of microbial synthases related to the *Vibrio cholerae* enzyme dinucleotide cyclase in *Vibrio* (DncV) (Davies et al. (2012) *Cell* 149, 358-370) and its metazoan ortholog cGAS (Sun et al. (2013) Science 339:786-791). Using a systematic biochemical screen for bacterial nucleotide second messengers, a broad family of cGAS/DncV-like nucleotidyltransferases (CD-NTases) that use both purine and pyrimidine nucleotides to synthesize an exceptionally diverse range of CDNs was discovered. A series of crystal structures establish CD-NTases as a structurally conserved family and reveal key contacts in the active-site lid that direct purine or pyrimidine selection. CD-NTase products are not restricted to CDNs and also include an unexpected class of cyclic trinucleotide compounds. Biochemical and cellular analysis of these novel nucleotide second messengers demonstrated that these signals active distinct host receptors and modulate the interaction of both pathogenic and commensal microbiota with their animal and plant hosts. Accordingly, compositions based on the CD-NTase polypeptides, and methods of use thereof, such as methods of producing nucleotide-based second messengers and methods of screening for modulators of CD-NTase, are provided.

I. Definitions

The articles "a" and "an" are used herein to refer to one or to more than one (i.e. to at least one) of the grammatical object of the article. By way of example, "an element" means one element or more than one element.

The term "administering" is intended to include routes of administration which allow an agent to perform its intended function. Examples of routes of administration for treatment of a body which can be used include injection (subcutaneous, intravenous, parenterally, intraperitoneally, intrathecal, etc.), oral, inhalation, and transdermal routes. The injection can be bolus injections or can be continuous infusion. Depending on the route of administration, the agent can be coated with or disposed in a selected material to protect it from natural conditions which may detrimentally affect its ability to perform its intended function. The agent may be administered alone, or in conjunction with a pharmaceutically acceptable carrier. The agent also may be administered as a prodrug, which is converted to its active form in vivo.

Unless otherwise specified here within, the terms "antibody" and "antibodies" broadly encompass naturally-occurring forms of antibodies (e.g. IgG, IgA, IgM, IgE) and recombinant antibodies, such as single-chain antibodies, chimeric and humanized antibodies and multi-specific antibodies, as well as fragments and derivatives of all of the foregoing, which fragments and derivatives have at least an antigenic binding site. Antibody derivatives may comprise a protein or chemical moiety conjugated to an antibody.

In addition, intrabodies are well-known antigen-binding molecules having the characteristic of antibodies, but that are capable of being expressed within cells in order to bind and/or inhibit intracellular targets of interest (Chen et al. (1994) *Human Gene Ther.* 5:595-601). Methods are well-known in the art for adapting antibodies to target (e.g., inhibit) intracellular moieties, such as the use of single-chain antibodies (scFvs), modification of immunoglobulin VL domains for hyperstability, modification of antibodies to resist the reducing intracellular environment, generating fusion proteins that increase intracellular stability and/or modulate intracellular localization, and the like. Intracellular antibodies can also be introduced and expressed in one or more cells, tissues or organs of a multicellular organism, for example for prophylactic and/or therapeutic purposes (e.g., as a gene therapy) (see, at least PCT Publs. WO 08/020079, WO 94/02610, WO 95/22618, and WO 03/014960; U.S. Pat. No. 7,004,940; Cattaneo and Biocca (1997) *Intracellular Antibodies: Development and Applications* (Landes and Springer-Verlag publs.); Kontermann (2004) *Methods* 34:163-170; Cohen et al. (1998) *Oncogene* 17:2445-2456; Auf der Maur et al. (2001) FEBS Lett. 508:407-412; Shaki-Loewenstein et al. (2005) *J. Immunol. Meth.* 303:19-39).

The term "antibody" as used herein also includes an "antigen-binding portion" of an antibody (or simply "antibody portion"). The term "antigen-binding portion", as used herein, refers to one or more fragments of an antibody that retain the ability to specifically bind to an antigen (e.g., a CD-NTase polypeptide encompassed by the present invention, or a complex thereof). It has been shown that the antigen-binding function of an antibody can be performed by fragments of a full-length antibody. Examples of binding fragments encompassed within the term "antigen-binding portion" of an antibody include (i) a Fab fragment, a monovalent fragment consisting of the VL, VH, CL and CH1 domains; (ii) a $F(ab')_2$ fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) *Nature* 341:544-546), which consists of a VH domain; and (vi) an isolated complementarity determining region (CDR). Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent polypeptides (known as single chain Fv (scFv); see e.g., Bird et al. (1988) *Science* 242: 423-426; and Huston et al. (1988) *Proc. Natl. Acad. Sci. USA* 85:5879-5883; and Osbourn et al. 1998, Nature Biotechnology 16:778). Such single chain antibodies are also intended to be encompassed within the term "antigen-binding portion" of an antibody. Any VH and VL sequences of specific scFv can be linked to human immunoglobulin constant region cDNA or genomic sequences, in order to generate expression vectors encoding complete IgG polypeptides or other isotypes. VH and VL can also be used in the generation of Fab, Fv or other fragments of immunoglobulins using either protein chemistry or recombinant DNA technology. Other forms of single chain antibodies, such as diabodies are also encompassed. Diabodies are bivalent, bispecific antibodies in which VH and VL domains are expressed on a single polypeptide chain, but using a linker that is too short to allow for pairing between the two domains on the same chain, thereby forcing the domains to pair with complementary domains of another chain and creating two antigen binding sites (see e.g., Holliger et al. (1993) *Proc. Natl. Acad. Sci. U.S.A.* 90:6444-6448; Poljak et al. (1994) *Structure* 2:1121-1123).

Still further, an antibody or antigen-binding portion thereof may be part of larger immunoadhesion polypeptides, formed by covalent or noncovalent association of the antibody or antibody portion with one or more other proteins or peptides. Examples of such immunoadhesion polypeptides include use of the streptavidin core region to make a tetrameric scFv polypeptide (Kipriyanov et al. (1995) *Human Antibodies and Hybridomas* 6:93-101) and use of a cysteine residue, protein subunit peptide and a C-terminal polyhistidine tag to make bivalent and biotinylated scFv polypeptides (Kipriyanov et al. (1994) *Mol. Immunol.* 31:1047-1058). Antibody portions, such as Fab and F(ab'), fragments, can be prepared from whole antibodies using conventional techniques, such as papain or pepsin digestion, respectively, of whole antibodies. Moreover, antibodies, antibody portions and immunoadhesion polypeptides can be obtained using standard recombinant DNA techniques, as described herein.

Antibodies may be polyclonal or monoclonal; xenogeneic, allogeneic, or syngeneic; or modified forms thereof (e.g. humanized, chimeric, etc.). Antibodies may also be fully human. Preferably, antibodies of the invention bind specifically or substantially specifically to a modified CD-NTase polypeptide. The terms "monoclonal antibodies" and "monoclonal antibody composition", as used herein, refer to a population of antibody polypeptides that contain only one species of an antigen binding site capable of immunoreacting with a particular epitope of an antigen, whereas the term "polyclonal antibodies" and "polyclonal antibody composition" refer to a population of antibody polypeptides that contain multiple species of antigen binding sites capable of interacting with a particular antigen. A monoclonal antibody composition typically displays a single binding affinity for a particular antigen with which it immunoreacts.

Antibodies may also be "humanized," which is intended to include antibodies made by a non-human cell having variable and constant regions which have been altered to more closely resemble antibodies that would be made by a human cell. For example, by altering the non-human antibody amino acid sequence to incorporate amino acids found in human germline immunoglobulin sequences. The humanized antibodies of the invention may include amino acid residues not encoded by human germline immunoglobulin sequences (e.g., mutations introduced by random or site-specific mutagenesis in vitro or by somatic mutation in vivo), for example in the CDRs. The term "humanized antibody", as used herein, also includes antibodies in which CDR sequences derived from the germline of another mammalian species, have been grafted onto human framework sequences.

A "blocking" antibody or an antibody "antagonist" is one which inhibits or reduces at least one biological activity of the antigen(s) it binds. In certain embodiments, the blocking antibodies or antagonist antibodies or fragments thereof described herein substantially or completely inhibit a given biological activity of the antigen(s).

As used herein, the term "isotype" refers to the antibody class (e.g., IgM, IgG1, IgG2C, and the like) that is encoded by heavy chain constant region genes.

The terms "cancer" or "tumor" or "hyperproliferative" refer to the presence of cells possessing characteristics typical of cancer-causing cells, such as uncontrolled proliferation, immortality, metastatic potential, rapid growth and proliferation rate, and certain characteristic morphological features.

Cancer cells are often in the form of a tumor, but such cells may exist alone within an animal, or may be a non-tumorigenic cancer cell, such as a leukemia cell. As used herein, the term "cancer" includes premalignant as well as malignant cancers. Cancers include, but are not limited to, B cell cancer, e.g., multiple myeloma, Waldenström's macroglobulinemia, the heavy chain diseases, such as, for example, alpha chain disease, gamma chain disease, and mu chain disease, benign monoclonal gammopathy, and immunocytic amyloidosis, melanomas, breast cancer, lung cancer, bronchus cancer, colorectal cancer, prostate cancer, pancreatic cancer, stomach cancer, ovarian cancer, urinary bladder cancer, brain or central nervous system cancer, peripheral nervous system cancer, esophageal cancer, cervical cancer, uterine or endometrial cancer, cancer of the oral cavity or pharynx, liver cancer, kidney cancer, testicular cancer, biliary tract cancer, small bowel or appendix cancer, salivary gland cancer, thyroid gland cancer, adrenal gland cancer, osteosarcoma, chondrosarcoma, cancer of hematologic tissues, and the like. Other non-limiting examples of types of cancers applicable to the methods encompassed by the present invention include human sarcomas and carcinomas, e.g., fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, colon carcinoma, colorectal cancer, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, liver cancer, choriocarcinoma, seminoma, embryonal carcinoma, Wilms' tumor, cervical cancer, bone cancer, brain tumor, testicular cancer, lung carcinoma, small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, retinoblastoma; leukemias, e.g., acute lymphocytic leukemia and acute myelocytic leukemia (myeloblastic, promyelocytic, myelomonocytic, monocytic and erythroleukemia); chronic leukemia (chronic myelocytic (granulocytic) leukemia and chronic lymphocytic leukemia); and polycythemia vera, lymphoma (Hodgkin's disease and non-Hodgkin's disease), multiple myeloma, Waldenstrom's macroglobulinemia, and heavy chain disease. In some embodiments, cancers are epithelial in nature and include but are not limited to, bladder cancer, breast cancer, cervical cancer, colon cancer, gynecologic cancers, renal cancer, laryngeal cancer, lung cancer, oral cancer, head and neck cancer, ovarian cancer, pancreatic cancer, prostate cancer, or skin cancer. In other embodiments, the cancer is breast cancer, prostate cancer, lung cancer, or colon cancer. In still other embodiments, the epithelial cancer is non-small-cell lung cancer, nonpapillary renal cell carcinoma, cervical carcinoma, ovarian carcinoma (e.g., serous ovarian carcinoma), or breast carcinoma. The epithelial cancers may be characterized in various other ways including, but not limited to, serous, endometrioid, mucinous, clear cell, Brenner, or undifferentiated.

The terms "prevent," "preventing," "prevention," "prophylactic treatment," and the like refer to reducing the probability of developing a disease, disorder, or condition in a subject, who does not have, but is at risk of or susceptible to developing a disease, disorder, or condition.

The term "coding region" refers to regions of a nucleotide sequence comprising codons which are translated into amino acid residues, whereas the term "noncoding region" refers to regions of a nucleotide sequence that are not translated into amino acids (e.g., 5' and 3' untranslated regions).

The term "complementary" refers to the broad concept of sequence complementarity between regions of two nucleic acid strands or between two regions of the same nucleic acid strand. It is known that an adenine residue of a first nucleic acid region is capable of forming specific hydrogen bonds ("base pairing") with a residue of a second nucleic acid region which is antiparallel to the first region if the residue is thymine or uracil. Similarly, it is known that a cytosine residue of a first nucleic acid strand is capable of base pairing with a residue of a second nucleic acid strand which is antiparallel to the first strand if the residue is guanine. A first region of a nucleic acid is complementary to a second region of the same or a different nucleic acid if, when the two regions are arranged in an antiparallel fashion, at least one nucleotide residue of the first region is capable of base pairing with a residue of the second region. Preferably, the first region comprises a first portion and the second region comprises a second portion, whereby, when the first and second portions are arranged in an antiparallel fashion, at least about 50%, and preferably at least about 75%, at least about 90%, or at least about 95% of the nucleotide residues of the first portion are capable of base pairing with nucleotide residues in the second portion. More preferably, all nucleotide residues of the first portion are capable of base pairing with nucleotide residues in the second portion.

As used herein, the term "inhibiting" and grammatical equivalents thereof refer decrease, limiting, and/or blocking a particular action, function, or interaction. A reduced level of a given output or parameter need not, although it may, mean an absolute absence of the output or parameter. The invention does not require, and is not limited to, methods that wholly eliminate the output or parameter. The given output or parameter can be determined using methods well-known in the art, including, without limitation, immunohistochemical, molecular biological, cell biological, clinical, and biochemical assays, as discussed herein and in the examples. The opposite terms "promoting," "increasing," and grammatical equivalents thereof refer to the increase in the level of a given output or parameter that is the reverse of that described for inhibition or decrease.

As used herein, the term "interacting" or "interaction" means that two molecules (e.g., protein, nucleic acid), or fragments thereof, exhibit sufficient physical affinity to each other so as to bring the two interacting molecules, or fragments thereof, physically close to each other. An extreme case of interaction is the formation of a chemical bond that results in continual and stable proximity of the two entities. Interactions that are based solely on physical affinities, although usually more dynamic than chemically bonded interactions, can be equally effective in co-localizing two molecules. Examples of physical affinities and chemical bonds include but are not limited to, forces caused by electrical charge differences, hydrophobicity, hydrogen bonds, Van der Waals force, ionic force, covalent linkages, and combinations thereof. The state of proximity between the interaction domains, fragments, proteins or entities may be transient or permanent, reversible or irreversible. In any event, it is in contrast to and distinguishable from contact caused by natural random movement of two entities. Typically, although not necessarily, an "interaction" is exhibited by the binding between the interaction domains, fragments, proteins, or entities. Examples of interactions include specific interactions between antigen and antibody, ligand and receptor, enzyme and substrate, and the like.

Generally, such an interaction results in an activity (which produces a biological effect) of one or both of said molecules. The activity may be a direct activity of one or both of the molecules, (e.g., signal transduction). Alternatively, one or both molecules in the interaction may be prevented from binding their ligand, and thus be held inactive with respect to ligand binding activity (e.g., binding its ligand and triggering or inhibiting an immune response). To inhibit such an interaction results in the disruption of the activity of one or more molecules involved in the interaction. To enhance such an interaction is to prolong or increase the likelihood of said physical contact, and prolong or increase the likelihood of said activity.

An "interaction" between two molecules, or fragments thereof, can be determined by a number of methods. For example, an interaction can be determined by functional assays. Such as the two-hybrid Systems. Protein-protein interactions can also be determined by various biophysical and biochemical approaches based on the affinity binding between the two interacting partners. Such biochemical methods generally known in the art include, but are not limited to, protein affinity chromatography, affinity blotting, immunoprecipitation, and the like. The binding constant for two interacting proteins, which reflects the strength or quality of the interaction, can also be determined using methods known in the art. See Phizicky and Fields, (1995) Microbiol. Rev., 59:94-123.

As used herein, a "kit" is any manufacture (e.g. a package or container) comprising at least one reagent, e.g. a probe, for specifically detecting or modulating the expression of a modified CD-NTase polypeptide encompassed by the present invention. The kit may be promoted, distributed, or sold as a unit for performing the methods encompassed by the present invention.

As used herein, the term "modulate" includes up-regulation and down-regulation, e.g., enhancing or inhibiting the expression and/or activity of the modified CD-NTase polypeptide encompassed by the present invention.

An "isolated protein" refers to a protein that is substantially free of other proteins, cellular material, separation medium, and culture medium when isolated from cells or produced by recombinant DNA techniques, or chemical precursors or other chemicals when chemically synthesized.

An “isolated” or “purified” protein or biologically active portion thereof is substantially free of cellular material or other contaminating proteins from the cell or tissue source from which the antibody, polypeptide, peptide or fusion protein is derived, or substantially free from chemical precursors or other chemicals when chemically synthesized. The language “substantially free of cellular material” includes preparations of a polypeptide or fragment thereof, in which the protein is separated from cellular components of the cells from which it is isolated or recombinantly produced. In one embodiment, the language “substantially free of cellular material” includes preparations of a modified CD-NTase polypeptide or fragment thereof, having less than about 30% (by dry weight) of non-CD-NTase protein (also referred to herein as a “contaminating protein”), more preferably less than about 20% of non-CD-NTase protein, still more preferably less than about 10% of non-CD-NTase protein, and most preferably less than about 5% non-CD-NTase protein. When antibody, polypeptide, peptide or fusion protein or fragment thereof, e.g., a biologically active fragment thereof, is recombinantly produced, it is also preferably substantially free of culture medium, i.e., culture medium represents less than about 20%, more preferably less than about 10%, and most preferably less than about 5% of the volume of the protein preparation.

As used herein, the term “nucleic acid molecule” is intended to include DNA molecules and RNA molecules. A nucleic acid molecule may be single-stranded or double-stranded, but preferably is double-stranded DNA. As used herein, the term “isolated nucleic acid molecule” is intended to refer to a nucleic acid molecule in which the nucleotide sequences are free of other nucleotide sequences, which other sequences may naturally flank the nucleic acid in human genomic DNA.

A nucleic acid is “operably linked” when it is placed into a functional relationship with another nucleic acid sequence. For instance, a promoter or enhancer is operably linked to a coding sequence if it affects the transcription of the sequence. With respect to transcription regulatory sequences, operably linked means that the DNA sequences being linked are contiguous and, where necessary to join two protein coding regions, contiguous and in reading frame. For switch sequences, operably linked indicates that the sequences are capable of effecting switch recombination.

For nucleic acids, the term “substantial homology” indicates that two nucleic acids, or designated sequences thereof, when optimally aligned and compared, are identical, with appropriate nucleotide insertions or deletions, in at least about 80% of the nucleotides, usually at least about 81%, 82%, 83%, 84%, 85%, 86%, 87%, 88%, 89%, 90%, 91%, 92%, 93%, 94%, 95%, 96%, or more of the nucleotides, and more preferably at least about 97%, 98%, 99% or more of the nucleotides. Alternatively, substantial homology exists when the segments will hybridize under selective hybridization conditions, to the complement of the strand.

The percent identity between two sequences is a function of the number of identical positions shared by the sequences (i.e., % identity= # of identical positions/total # of positions×100), taking into account the number of gaps, and the length of each gap, which need to be introduced for optimal alignment of the two sequences. The comparison of sequences and determination of percent identity between two sequences can be accomplished using a mathematical algorithm, as described in the non-limiting examples below.

The percent identity between two nucleotide sequences can be determined using the GAP program in the GCG software package (available on the world wide web at the GCG company website), using a NWSgapdna. CMP matrix and a gap weight of 40, 50, 60, 70, or 80 and a length weight of 1, 2, 3, 4, 5, or 6. The percent identity between two nucleotide or amino acid sequences can also be determined using the algorithm of E. Meyers and W. Miller (CABIOS, 4:11 17 (1989)) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (J. Mol. Biol. (48): 444 453 (1970)) algorithm which has been incorporated into the GAP program in the GCG software package (available on the world wide web at the GCG company website), using either a Blosum 62 matrix or a PAM250 matrix, and a gap weight of 16, 14, 12, 10, 8, 6, or 4 and a length weight of 1, 2, 3, 4, 5, or 6.

The nucleic acid and protein sequences encompassed by the present invention can further be used as a “query sequence” to perform a search against public databases to, for example, identify related sequences. Such searches can be performed using the NBLAST and XBLAST programs (version 2.0) of Altschul, et al. (1990) J. Mol. Biol. 215:403 10. BLAST nucleotide searches can be performed with the NBLAST program, score=100, wordlength=12 to obtain nucleotide sequences homologous to the nucleic acid molecules encompassed by the present invention. BLAST protein searches can be performed with the XBLAST program, score=50, wordlength=3 to obtain amino acid sequences homologous to the protein molecules encompassed by the present invention. To obtain gapped alignments for comparison purposes, Gapped BLAST can be utilized as described in Altschul et al., (1997) *Nucleic Acids Res.* 25 (17): 3389 3402. When utilizing BLAST and Gapped BLAST programs, the default parameters of the respective programs (e.g., XBLAST and NBLAST) can be used (available on the world wide web at the NCBI website).

The nucleic acids may be present in whole cells, in a cell lysate, or in a partially purified or substantially pure form. A nucleic acid is “isolated” or “rendered substantially pure” when purified away from other cellular components or other contaminants, e.g., other cellular nucleic acids or proteins, by standard techniques, including alkaline/SDS treatment, CsCl banding, column chromatography, agarose gel electrophoresis and others well-known in the art (see, F. Ausubel, et al., ed. Current Protocols in Molecular Biology, Greene Publishing and Wiley Interscience, New York (1987)).

A “transcribed polynucleotide” or “nucleotide transcript” is a polynucleotide (e.g. an mRNA, hnRNA, a cDNA, or an analog of such RNA or cDNA) which is complementary to or homologous with all or a portion of a mature mRNA made by transcription of a modified CD-NTase nucleic acid and normal post-transcriptional processing (e.g. splicing), if any, of the RNA transcript, and reverse transcription of the RNA transcript.

An “RNA interfering agent” as used herein, is defined as any agent which interferes with or inhibits expression of a target gene by RNA interference (RNAi). Such RNA interfering agents include, but are not limited to, nucleic acid molecules including RNA molecules which are homologous to a modified CD-NTase nucleic acid encompassed by the present invention, or a fragment thereof, short interfering RNA (siRNA), and small molecules which interfere with or inhibit expression of a target modified CD-NTase nucleic acid by RNA interference (RNAi).

“RNA interference (RNAi)” is an evolutionally conserved process whereby the expression or introduction of RNA of a sequence that is identical or highly similar to a target modified CD-NTase nucleic acid results in the sequence specific degradation or specific post-transcriptional gene silencing (PTGS) of messenger RNA (mRNA) transcribed from that targeted gene (see Coburn, G. and Cullen, B. (2002) *J. of Virology* 76 (18): 9225), thereby inhibiting expression of the target modified CD-NTase nucleic acid. In one embodiment, the RNA is double stranded RNA (dsRNA). This process has been described in plants, invertebrates, and mammalian cells. In nature, RNAi is initiated by the dsRNA-specific endonuclease Dicer, which promotes processive cleavage of long dsRNA into double-stranded fragments termed siRNAs. siRNAs are incorporated into a protein complex that recognizes and cleaves target mRNAs. RNAi can also be initiated by introducing nucleic acid molecules, e.g., synthetic siRNAs, shRNAs, or other RNA interfering agents, to inhibit or silence the expression of target modified CD-NTase nucleic acids. As used herein, "inhibition of a modified CD-NTase nucleic acid expression" or "inhibition of modified CD-NTase gene expression" includes any decrease in expression or protein activity or level of the modified CD-NTase nucleic acid or protein encoded by the modified CD-NTase nucleic acid. The decrease may be of at least 30%, 40%, 50%, 60%, 70%, 80%, 90%, 95% or 99% or more as compared to the expression of a modified CD-NTase nucleic acid or the activity or level of the protein encoded by a modified CD-NTase nucleic acid which has not been targeted by an RNA interfering agent.

In addition to RNAi, genome editing can be used to modulate the copy number or genetic sequence of a protein of interest, such as constitutive or induced knockout or mutation of a protein of interest, such as a modified CD-NTase polypeptide encompassed by the present invention. For example, the CRISPR-Cas system can be used for precise editing of genomic nucleic acids (e.g., for creating non-functional or null mutations). In such embodiments, the CRISPR guide RNA and/or the Cas enzyme may be expressed. For example, a vector containing only the guide RNA can be administered to an animal or cells transgenic for the Cas9 enzyme. Similar strategies may be used (e.g., designer zinc finger, transcription activator-like effectors (TALEs) or homing meganucleases). Such systems are well-known in the art (see, for example, U.S. Pat. No. 8,697,359; Sander and Joung (2014) *Nat. Biotech.* 32:347-355; Hale et al. (2009) *Cell* 139:945-956; Karginov and Hannon (2010) *Mol. Cell* 37:7; U.S. Pat. Publ. 2014/0087426 and 2012/0178169; Boch et al. (2011) *Nat. Biotech.* 29:135-136; Boch et al. (2009) *Science* 326:1509-1512; Moscou and Bogdanove (2009) *Science* 326:1501; Weber et al. (2011) *PLoS One* 6: e19722; Li et al. (2011) *Nucl. Acids Res.* 39:6315-6325; Zhang et al. (2011) *Nat. Biotech.* 29:149-153; Miller et al. (2011) *Nat. Biotech.* 29:143-148; Lin et al. (2014) *Nucl. Acids Res.* 42: e47). Such genetic strategies can use constitutive expression systems or inducible expression systems according to well-known methods in the art.

"Piwi-interacting RNA (piRNA)" is the largest class of small non-coding RNA molecules. piRNAs form RNA-protein complexes through interactions with piwi proteins. These piRNA complexes have been linked to both epigenetic and post-transcriptional gene silencing of retrotransposons and other genetic elements in germ line cells, particularly those in spermatogenesis. They are distinct from microRNA (miRNA) in size (26-31 nt rather than 21-24 nt), lack of sequence conservation, and increased complexity. However, like other small RNAs, piRNAs are thought to be involved in gene silencing, specifically the silencing of transposons. The majority of piRNAs are antisense to transposon sequences, indicating that transposons are the piRNA target. In mammals it appears that the activity of piRNAs in transposon silencing is most important during the development of the embryo, and in both *C. elegans* and humans, piRNAs are necessary for spermatogenesis. piRNA has a role in RNA silencing via the formation of an RNA-induced silencing complex (RISC).

"Aptamers" are oligonucleotide or peptide molecules that bind to a specific target molecule. "Nucleic acid aptamers" are nucleic acid species that have been engineered through repeated rounds of in vitro selection or equivalently, SELEX (systematic evolution of ligands by exponential enrichment) to bind to various molecular targets such as small molecules, proteins, nucleic acids, and even cells, tissues and organisms. "Peptide aptamers" are artificial proteins selected or engineered to bind specific target molecules. These proteins consist of one or more peptide loops of variable sequence displayed by a protein scaffold. They are typically isolated from combinatorial libraries and often subsequently improved by directed mutation or rounds of variable region mutagenesis and selection. The "Affimer protein", an evolution of peptide aptamers, is a small, highly stable protein engineered to display peptide loops which provides a high affinity binding surface for a specific target protein. It is a protein of low molecular weight, 12-14 kDa, derived from the cysteine protease inhibitor family of cystatins. Aptamers are useful in biotechnological and therapeutic applications as they offer molecular recognition properties that rival that of the commonly used biomolecule, antibodies. In addition to their discriminate recognition, aptamers offer advantages over antibodies as they can be engineered completely in a test tube, are readily produced by chemical synthesis, possess desirable storage properties, and elicit little or no immunogenicity in therapeutic applications.

"Short interfering RNA" (siRNA), also referred to herein as "small interfering RNA" is defined as an agent which functions to inhibit expression of a modified CD-NTase nucleic acid, e.g., by RNAi. A siRNA may be chemically synthesized, may be produced by in vitro transcription, or may be produced within a host cell. In one embodiment, siRNA is a double stranded RNA (dsRNA) molecule of about 15 to about 40 nucleotides in length, preferably about 15 to about 28 nucleotides, more preferably about 19 to about 25 nucleotides in length, and more preferably about 19, 20, 21, or 22 nucleotides in length, and may contain a 3' and/or 5' overhang on each strand having a length of about 0, 1, 2, 3, 4, or 5 nucleotides. The length of the overhang is independent between the two strands, i.e., the length of the overhang on one strand is not dependent on the length of the overhang on the second strand. Preferably the siRNA is capable of promoting RNA interference through degradation or specific post-transcriptional gene silencing (PTGS) of the target messenger RNA (mRNA).

In another embodiment, a siRNA is a small hairpin (also called stem loop) RNA (shRNA). In one embodiment, these shRNAs are composed of a short (e.g., 19-25 nucleotide) antisense strand, followed by a 5-9 nucleotide loop, and the analogous sense strand. Alternatively, the sense strand may precede the nucleotide loosoop structure and the antisense strand may follow. These shRNAs may be contained in plasmids, retroviruses, and lentiviruses and expressed from, for example, the pol III U6 promoter, or another promoter (see, e.g., Stewart, et al. (2003) *RNA* Apr;9 (4): 493-501 incorporated by reference herein).

RNA interfering agents, e.g., siRNA molecules, may be administered to a host cell or organism, to inhibit expression of a modified hsGAS polypeptide encompassed by the present invention and thereby inhibit the expression and/or acitivty of hsGAS.

The term "small molecule" is a term of the art and includes molecules that are less than about 1000 molecular weight or less than about 500 molecular weight. In one embodiment, small molecules do not exclusively comprise peptide bonds. In another embodiment, small molecules are not oligomeric. Exemplary small molecule compounds which can be screened for activity include, but are not limited to, peptides, peptidomimetics, nucleic acids, carbohydrates, small organic molecules (e.g., polyketides) (Cane et al. (1998) *Science* 282:63), and natural product extract libraries. In another embodiment, the compounds are small, organic non-peptidic compounds. In a further embodiment, a small molecule is not biosynthetic.

The term "specific binding" refers to antibody binding to a predetermined antigen. Typically, the antibody binds with an affinity ($K_D$) of approximately less than $10^{-7}$ M, such as approximately less than $10^{-8}$ M, $10^{-9}$ M or $10^{-10}$ M or even lower when determined by surface plasmon resonance (SPR) technology in a BIACORE® assay instrument using an antigen of interest as the analyte and the antibody as the ligand, and binds to the predetermined antigen with an affinity that is at least 1.1-, 1.2-, 1.3-, 1.4-, 1.5-, 1.6-, 1.7-, 1.8-, 1.9-, 2.0-, 2.5-, 3.0-, 3.5-, 4.0-, 4.5-, 5.0-, 6.0-, 7.0-, 8.0-, 9.0-, or 10.0-fold or greater than its affinity for binding to a non-specific antigen (e.g., BSA, casein) other than the predetermined antigen or a closely-related antigen. The phrases "an antibody recognizing an antigen" and "an antibody specific for an antigen" are used interchangeably herein with the term "an antibody which binds specifically to an antigen." Selective binding is a relative term referring to the ability of an antibody to discriminate the binding of one antigen over another.

As used herein, the term "molecular complex" means a composite unit that is a combination of two or more molecular components (e.g., protein, nucleic acid, nucleotide, compound) formed by interaction between the molecular components. Typically, but not necessarily, a "molecular complex" is formed by the binding of two or more molecular components together through specific non-covalent binding interactions. However, covalent bonds may also be present between the interacting partners. For instance, the two interacting partners can be covalently crosslinked so that the molecular complex becomes more stable. The molecular complex may or may not include and/or be associated with other molecules such as nucleic acid, such as RNA or DNA, or lipids or further cofactors or moieties selected from a metal ions, hormones, second messengers, phosphate, sugars. A "molecular complex" of the invention may also be part of or a unit of a larger physiological molecular complex assembly.

The term "isolated molecular complex" means a molecular complex present in a composition or environment that is different from that found in nature, in its native or original cellular or body environment. Preferably, an "isolated molecular complex" is separated from at least 50%, more preferably at least 75%, most preferably at least 90% of other naturally co-existing cellular or tissue components. Thus, an "isolated molecular complex" may also be a naturally existing molecular complex in an artificial preparation or a non-native host cell. An "isolated molecular complex" may also be a "purified molecular complex", that is, a substantially purified form in a substantially homogenous preparation substantially free of other cellular components, other polypeptides, viral materials, or culture medium, or, when the components in the molecular complex are chemically synthesized, free of chemical precursors or by-products associated with the chemical synthesis. A "purified molecular complex" typically means a preparation containing preferably at least 75%, more preferably at least 85%, and most preferably at least 95% of a particular molecular complex. A "purified molecular complex" may be obtained from natural or recombinant host cells or other body samples by standard purification techniques, or by chemical synthesis.

The term "CD-NTase" refers to cGAS/DncV-like nucleotidyltransferase family of proteins. CD-NTases are nucleotidyltranferases identified from bacteria which typically function as monomers and capable of nucleotide second messenger synthesis. It is a highly diverse family of proteins that share a common nucleotidyltransferase protein fold and an active site with a consensus seqeunce of $GSX_1X_2$ [ . . . ] $X_n$ $A_1Y_1B_1$, optionally wherein the active site comprises the amino acid sequence $GSX_1X_2$ [ . . . ] $X_n$ $A_1Y_1B_1$ $Z_1Z_2$ [ . . . ] $Z_mC_1$, wherein $A_1$, $B_1$, and $C_1$ independently represent amino acid residue D or E; $X_1$, $X_2$, . . . , $X_n$, $Y_1$, $Z_1$, $Z_2$, . . . , and Zn independently represent any amino acid residue; and n or m is any integer. In some embodiments, n is 5-40 residues and m is $10^{-200}$ residues, or any range in between, inclusive, such as n is 6-15 residues and m is 50-100 residues.

In some embodiments, the nucleotidyltransferase protein fold is a protein structure having a core of an alpha-beta-trun-beta-X-beta-(alpha); mixed beta-sheet, order of core strands: 123, as defined according to d.218: nucleotidyltransferase (1 superfamily) of the SCOPe database, release 2.07 (updated 2018 Aug. 3, stable release March 2018). The active site may have two or more magnesium ions, which are typically coordinated by a triad of acidic amino acid resiudes. The "GS" motif in the active site interacts with the terminal phosphates of a nucleotide and particicates in magenesium ion coordination. In one embodiment, CD-NTase contains conserved domains which include Mab-21 protein domain (PFAM database PF03281 and/or Eukaryotic Orthologous Groups (KOG) database KOG3963, PAP_central domain (PFAM database PF04928, Clusters of Orthologous Groups (COG) database COG5186, NCBI conserved domain database CD05402, and/or KOG database KOG2245), CCA domain (COG database COG1746), and transcription factor NFAT domain (KOG database KOG3792/37933). In another embodiment, CD-NTase is a bipartite protein having a N-terminal Pol-β-like nucleotidyltransferase core domain (such as defined according to PFAM database PF14792/PF01909, COG database COG1665/1669, and/or NCBI conserved domain database CD05400/CD5397) contiguous with either a C-terminal OAS1_C domain (PFAM database PF10421) or a C-terminal tRNA-NucTransf2 domain (PFAM database PF9249). The following database references apply for the referenced databases herein: Pfam database v31.0, updated March 2017; KOG and COG databases v1.0, updated 2014; and NCBI conserved domain database v3.16, updated 2017. CD-NTase may further contain an alpha helix that braces the N-terminal nucleotidyltransferase core domain and C-terminal domain. Representative sequences of CD-NTase family proteins are listed in Table 1 and Table 2. The classification, crystal stuctures, and functional characterizations of the representative CD-NTase family proteins are described in the Examples below.

The term "modified CD-NTase polypeptide" refers to CD-NTase polypeptide that is different from that found in nature, in its native or original cellular or body environment.

The term "modification" as used herein refers to all modifications of a protein, DNA, or protein-DNA complex of the invention including cleavage and addition or removal of a group. The "modified CD-NTase polypeptide" of this invention may be, e.g., homolog, derivative, or fragment of native CD-NTase polypeptide having an amino acid sequence listed in Table 1. Preferably, the "modified CD-NTase polypeptide" has one or more following biologically activities: a) circular or linear nucleotide-based second messenger synthesis; b) active enzyme conformation; and c) STING or RECON pathway regulation. The term "modified CD-NTase nucleic acid" refers to nucleic acid (e.g., DNA, mRNA) that encodes the modified CD-NTase polypeptide of described herein.

As used herein, the term "nucleotide-based second messenger" refers to a second messenger having a realtively small numer (e.g., one, two, or three) of nucleotides or derivatives thereof that transduces signals originating from changes in the environment or in intracellular conditions into appropriate cellular responses. It can be circular or linear. In one embodiment, the nucleotide-based second messenger is a cyclic dinucleotide which includes but is not limited to a cyclic di-purine (e.g., cyclic di-AMP, cyclic di-GMP, cyclic AMP-GMP), a cyclic pyrimidine (e.g., cyclic di-UMP or cyclic UMP-CMP), or a cyclic pruine-pyrimidine hybrid (e.g., cyclic UMP-AMP or cyclic UMP-GMP). In another embodiment, the nucleotide-based second messenger is a cyclic trinucleotide (e.g., cyclic AMP-AMP-GMP). Several bona fide nucleotide signaling pathways, (p) ppGpp, cAMP, cGMP, c-di-AMP, c-di-GMP and cGAMP, have been characterized with respect to basic pathway modules and phenotypic and physiological output (Martin-Rodriguez et al. (2017) *Curr Top Med Chem* 17:1928-1944). In prokaryotes cyclic di-GMP has emerged as an important and ubiquitous second messenger regulating bacterial lifestyle transitions relevant for biofilm formation, virulence, and many other bacterial functions (Pesavento et al. (2009) *Curr Opin Microbiol* 12:170-176).

The nucleotide-based second messenger may contain modified or unnatural nucleotides. The modified nucleotides can be naturally occurring modified RNA base analogs (Limbach et al. (1994) *Nucleic Acids Res* 22:2183-2196; Cantara et al. (2011) *Nucleic Acids Res* 39: D195-D201; Czerwoniec et al. (2009) *Nucleic Acids Res* 37: D118-D121; Grosjean et al. (1998) Modification and Editing of RNA. ASM Press, Washington DC.), including but not limited to N°-Methyladenosine-5'-Triphosphate, 5-Methylcytidine-5'-Triphosphate, 2'-O-Methyladenosine-5'-Triphosphate, 2'-O-Methylcytidine-5'-Triphosphate, 2'-O-Methylguanosine-5'-Triphosphate, 2'-O-Methyluridine-5'-Triphosphate, 2'-O-Pseudouridine-5'-Triphosphate, Inosine-5'-Triphosphate, 2'-O-Methylinosine-5'-Triphosphate, 5-Methyluridine-5'-Triphosphate, 4-Thiouridine-5'-Triphosphate, 2-Thiouridine-5'-Triphosphate, 5,6-Dihydrouridine-5'-Triphosphate, 2-Thiocytidine-5'-Triphosphate, 2'-O-Methylpseudouridine-5'-Triphosphate, N1-Methyladenosine-5'-Triphosphate, 2'-O-Methyl-5-methyluridine-5'-Triphosphate, N4-Methylcytidine-5'-Triphosphate, N1-Methylpseudouridine-5'-Triphosphate, 5,6-Dihydro-5-Methyluridine-5'-Triphosphate, 5-Formylcytidine-5'-Triphosphate, 5-Hydroxymethylcytidine-5'-Triphosphate, 5-Hydroxycytidine-5'-Triphosphate, 5-Hydroxyuridine-5'-Triphosphate, 5-Methoxyuridine-5'-Triphosphate, and 5-Carboxymethylesteruridine-5'-Triphosphate.

Unnatural nucleotides include but are not limited to 2' Fluoro and 2' O-Methyl NTPs, for example, 2'-Amino-2'-deoxyadenosine-5'-Triphosphate, 2'-Amino-2'-deoxycytidine-5'-Triphosphate, 2'-Amino-2'-deoxyuridine-5'-Triphosphate, 2'-Azido-2'-deoxyadenosine-5'-Triphosphate, 2'-Azido-2'-deoxycytidine-5'-Triphosphate, 2'-Azido-2'-deoxyguanosine-5'-Triphosphate, 2'-Azido-2'-deoxyuridine-5'-Triphosphate, 2'-Fluoro-2'-deoxyadenosine-5'-Triphosphate, 2'-Fluoro-2'-deoxycytidine-5'-Triphosphate, 2'-Fluoro-2'-deoxyguanosine-5'-Triphosphate, 2'-Fluoro-2'-deoxyuridine-5'-Triphosphate, 2'-Fluorothymidine-5'-Triphosphate, 2'-Fluoro-2'-deoxyadenosine-5'-Triphosphate, 2'-Fluoro-2'-deoxycytidine-5'-Triphosphate, 2'-Fluoro-2'-deoxyguanosine-5'-Triphosphate, 2'-Fluoro-2'-deoxyuridine-5'-Triphosphate, 2'-Fluorothymidine-5'-Triphosphate, 2'-Fluoro-2'-deoxyadenosine-5'-Triphosphate, 2'-Fluoro-2'-deoxycytidine-5'-Triphosphate, 2'-Fluoro-2'-deoxyguanosine-5'-Triphosphate, 2'-Fluoro-2'-deoxyuridine-5'-Triphosphate, 2'-O-Methyladenosine-5'-Triphosphate, 2'-O-Methylcytidine-5'-Triphosphate, 2'-O-Methylguanosine-5'-Triphosphate, 2'-O-Methyluridine-5'-Triphosphate, Pseudouridine-5'-Triphosphate, 2'-O-Methylinosine-5'-Triphosphate, 2'-Amino-2'-deoxycytidine-5'-Triphosphate, 2'-Amino-2'-deoxyuridine-5'-Triphosphate, 2'-Azido-2'-deoxycytidine-5'-Triphosphate, 2'-Azido-2'-deoxyuridine-5'-Triphosphate, 2'-O-Methylpseudouridine-5'-Triphosphate, 2'-O-Methyl-5-methyluridine-5'-Triphosphate, 2'-Azido-2'-deoxyadenosine-5'-Triphosphate, 2'-Amino-2'-deoxyadenosine-5'-Triphosphate, 2'-Fluoro-thymidine-5'-Triphosphate, 2'-Azido-2'-deoxyguanosine-5'-Triphosphate, N4-Methylcytidine-5'-Triphosphate, 2'-O-Methyladenosine-5'-Triphosphate, 2'-O-Methylcytidine-5'-Triphosphate, 2'-O-Methylguanosine-5'-Triphosphate, 2'-O-Methyluridine-5'-Triphosphate, 2'-Amino-2'-deoxyadenosine-5'-Triphosphate, 2'-Amino-2'-deoxycytidine-5'-Triphosphate, 2'-Amino-2'-deoxyuridine-5'-Triphosphate,Araadenosine-5'-Triphosphate, Aracytidine-5'-Triphosphate, Araguanosine-5'-Triphosphate, Arauridine-5'-Triphosphate, 2'-Azido-2'-deoxyadenosine-5'-Triphosphate, 2'-Azido-2'-deoxycytidine-5'-Triphosphate, 2'-Azido-2'-deoxyguanosine-5'-Triphosphate,2'-Azido-2'-deoxyuridine-5'-Triphosphate,2'-Fluoro-2'-deoxyadenosine-5'-Triphosphate, 2'-Fluoro-2'-deoxycytidine-5'-Triphosphate, 2'-Fluoro-2'-deoxyguanosine-5'-Triphosphate, 2'-Fluoro-2'-deoxyuridine-5'-Triphosphate, 2'-Fluorothymidine-5'-Triphosphate,2'-O-Methyladenosine-5'-Triphosphate, 2'-O-Methylcytidine-5'-Triphosphate, 2'-O-Methylguanosine-5'-Triphosphate, 2'-O-Methyluridine-5'-Triphosphate,2'-Fluoro-2'-deoxyadenosine-5'-Triphosphate,2'-Fluoro-2'-deoxycytidine-5'-Triphosphate, 2'-Fluoro-2'-deoxyguanosine-5'-Triphosphate, 2'-Fluoro-2'-deoxyuridine-5'-Triphosphate, 2'-Fluorothymidine-5'-Triphosphate, 2'-O-Methyladenosine-5'-Triphosphate, 2'-O-Methylcytidine-5'-Triphosphate,2'-O-Methylguanosine-5'-Triphosphate, and 2'-O-Methyluridine-5'-Triphosphate.

As used herein, the term "domain" means a functional portion, segment or region of a protein, or polypeptide. "Interaction domain" refers specifically to a portion, segment or region of a protein, polypeptide or protein fragment that is responsible for the physical affinity of that protein, protein fragment or isolated domain for another protein, protein fragment or isolated domain.

If not stated otherwise, the term "compound" as used herein are include but are not limited to peptides, nucleic acids, carbohydrates, natural product extract libraries, organic molecules, preferentially small organic molecules, inorganic molecules, including but not limited to chemicals, metals and organometallic molecules.

The terms "derivatives", "analogs" or "variants" as used herein include, but are not limited, to molecules comprising regions that are substantially homologous to the modified CD-NTase polypeptide, in various embodiments, by at least 30%, 40%, 50%, 60%, 70%, 80%, 90%, 95% or 99% identity over an amino acid sequence of identical size or when compared to an aligned sequence in which the alignment is done by a computer homology program known in the art, or whose encoding nucleic acid is capable of hybridizing to a sequence encoding the component protein under stringent, moderately stringent, or nonstringent conditions. It means a protein which is the outcome of a modification of the naturally occurring protein, by amino acid substitutions, deletions and additions, respectively, which derivatives still exhibit the biological function of the naturally occurring protein although not necessarily to the same degree. The biological function of such proteins can e.g. be examined by suitable available in vitro assays as provided in the invention.

The term "functionally active" as used herein refers to a polypeptide, namely a fragment or derivative, having structural, regulatory, or biochemical functions of the protein according to the embodiment of which this polypeptide, namely fragment or derivative is related to.

"Function-conservative variants" are those in which a given amino acid residue in a protein or enzyme has been changed without altering the overall conformation and function of the polypeptide, including, but not limited to, replacement of an amino acid with one having similar properties (e.g., polarity, hydrogen bonding potential, acidic, basic, hydrophobic, aromatic, and the like). Amino acids other than those indicated as conserved may differ in a protein so that the percent protein or amino acid sequence similarity between any two proteins of similar function may vary and may be, for example, from 70% to 99% as determined according to an alignment scheme such as by the Cluster Method, wherein similarity is based on the MEGALIGN algorithm. A "function-conservative variant" also includes a polypeptide which has at least 60% amino acid identity as determined by BLAST or FASTA algorithms, preferably at least 75%, more preferably at least 85%, still preferably at least 90%, and even more preferably at least 95%, and which has the same or substantially similar properties or functions as the native or parent protein to which it is compared.

The terms "polypeptide fragment" or "fragment", when used in reference to a reference polypeptide, refers to a polypeptide in which amino acid residues are deleted as compared to the reference polypeptide itself, but where the remaining amino acid sequence is usually identical to the corresponding positions in the reference polypeptide. Such deletions may occur at the amino-terminus, internally, or at the carboxyl-terminus of the reference polypeptide, or alternatively both. Fragments typically are at least 5, 6, 8 or 10 amino acids long, at least 14 amino acids long, at least 20, 30, 40 or 50 amino acids long, at least 75 amino acids long, or at least 100, 150, 200, 300, 500 or more amino acids long. They can be, for example, at least and/or including 10, 15, 20, 25, 30, 35, 40, 45, 50, 55, 60, 65, 70, 75, 80, 85, 90, 95, 100, 120, 140, 160, 180, 200, 220, 240, 260, 280, 300, 320, 340, 360, 380, 400, 420, 440, 460, 480, 500, 520, 540, 560, 580, 600, 620, 640, 660, 680, 700, 720, 740, 760, 780, 800, 820, 840, 860, 880, 900, 920, 940, 960, 980, 1000, 1020, 1040, 1060, 1080, 1100, 1120, 1140, 1160, 1180, 1200, 1220, 1240, 1260, 1280, 1300, 1320, 1340 or more long so long as they are less than the length of the full-length polypeptide. Alternatively, they can be no longer than and/or excluding such a range so long as they are less than the length of the full-length polypeptide.

"Homologous" as used herein, refers to nucleotide sequence similarity between two regions of the same nucleic acid strand or between regions of two different nucleic acid strands. When a nucleotide residue position in both regions is occupied by the same nucleotide residue, then the regions are homologous at that position. A first region is homologous to a second region if at least one nucleotide residue position of each region is occupied by the same residue. Homology between two regions is expressed in terms of the proportion of nucleotide residue positions of the two regions that are occupied by the same nucleotide residue. By way of example, a region having the nucleotide sequence 5'-ATTGCC-3' and a region having the nucleotide sequence 5'-TATGGC-3' share 50% homology. Preferably, the first region comprises a first portion and the second region comprises a second portion, whereby, at least about 50%, and preferably at least about 75%, at least about 90%, or at least about 95% of the nucleotide residue positions of each of the portions are occupied by the same nucleotide residue. More preferably, all nucleotide residue positions of each of the portions are occupied by the same nucleotide residue.

The term "probe" refers to any molecule which is capable of selectively binding to a specifically intended target molecule, for example, a nucleotide transcript or protein encoded by or corresponding to a marker. Probes can be either synthesized by one skilled in the art, or derived from appropriate biological preparations. For purposes of detection of the target molecule, probes may be specifically designed to be labeled, as described herein. Examples of molecules that can be utilized as probes include, but are not limited to, RNA, DNA, proteins, antibodies, and organic molecules.

As used herein, the term "host cell" is intended to refer to a cell into which a nucleic acid encompassed by the present invention, such as a recombinant expression vector encompassed by the present invention, has been introduced. The terms "host cell" and "recombinant host cell" are used interchangeably herein. It should be understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

As used herein, the term "vector" refers to a nucleic acid capable of transporting another nucleic acid to which it has been linked. One type of vector is a "plasmid", which refers to a circular double stranded DNA loop into which additional DNA segments may be ligated. Another type of vector is a viral vector, wherein additional DNA segments may be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors" or simply "expression vectors". In general, expression vectors of utility in recombinant DNA techniques are often in the form of plasmids. In the present specification, "plasmid" and "vector" may be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The term "substantially free of chemical precursors or other chemicals" includes preparations of antibody, polypeptide, peptide or fusion protein in which the protein is separated from chemical precursors or other chemicals which are involved in the synthesis of the protein. In one embodiment, the language "substantially free of chemical precursors or other chemicals" includes preparations of antibody, polypeptide, peptide or fusion protein having less than about 30% (by dry weight) of chemical precursors or non-antibody, polypeptide, peptide or fusion protein chemicals, more preferably less than about 20% chemical precursors or non-antibody, polypeptide, peptide or fusion protein chemicals, still more preferably less than about 10% chemical precursors or non-antibody, polypeptide, peptide or fusion protein chemicals, and most preferably less than about 5% chemical precursors or non-antibody, polypeptide, peptide or fusion protein chemicals.

The term "activity" when used in connection with proteins or molecular complexes means any physiological or biochemical activities displayed by or associated with a particular protein or molecular complex including but not limited to activities exhibited in biological processes and cellular functions, ability to interact with or bind another molecule or a moiety thereof, binding affinity or specificity to certain molecules, in vitro or in vivo stability (e.g., protein degradation rate, or in the case of molecular complexes ability to maintain the form of molecular complex), antigenicity and immunogenecity, enzymatic activities, etc. Such activities may be detected or assayed by any of a variety of suitable methods as will be apparent to skilled artisans.

As used herein, the term "interaction antagonist" means a compound that interferes with, blocks, disrupts or destabilizes a protein-protein interaction or a protein-DNA interaction; blocks or interferes with the formation of a molecular complex, or destabilizes, disrupts or dissociates an existing molecular complex.

The term "interaction agonist" as used herein means a compound that triggers, initiates, propagates, nucleates, or otherwise enhances the formation of a protein-protein interaction or a protein-DNA interaction; triggers, initiates, propagates, nucleates, or otherwise enhances the formation of a molecular complex; or stabilizes an existing molecular complex.

The terms "polypeptides" and "proteins" are, where applicable, used interchangeably herein. They may be chemically modified, e.g. post-translationally modified. For example, they may be glycosylated or comprise modified amino acid residues. They may also be modified by the addition of a signal sequence to promote their secretion from a cell where the polypeptide does not naturally contain such a sequence. They may be tagged with a tag. They may be tagged with different labels which may assists in identification of the proteins in a molecular complex. Polypeptides/proteins for use in the invention may be in a substantially isolated form. It will be understood that the polypeptide/protein may be mixed with carriers or diluents which will not interfere with the intended purpose of the polypeptide and still be regarded as substantially isolated. A polypeptide/protein for use in the invention may also be in a substantially purified form, in which case it will generally comprise the polypeptide in a preparation in which more than 50%, e.g. more than 80%, 90%, 95% or 99%, by weight of the polypeptide in the preparation is a polypeptide of the invention.

The terms "hybrid protein", "hybrid polypeptide," "hybrid peptide", "fusion protein", "fusion polypeptide", and "fusion peptide" are used herein interchangeably to mean a non-naturally occurring protein having a specified polypeptide molecule covalently linked to one or more polypeptide molecules that do not naturally link to the specified polypeptide. Thus, a "hybrid protein" may be two naturally occurring proteins or fragments thereof linked together by a covalent linkage. A "hybrid protein" may also be a protein formed by covalently linking two artificial polypeptides together. Typically but not necessarily, the two or more polypeptide molecules are linked or fused together by a peptide bond forming a single non-branched polypeptide chain.

The term "tag" as used herein is meant to be understood in its broadest sense and to include, but is not limited to any suitable enzymatic, fluorescent, or radioactive labels and suitable epitopes, including but not limited to HA-tag, Myc-tag, T7, His-tag, FLAG-tag, Calmodulin binding proteins, glutathione-S-transferase, strep-tag, KT3-epitope, EEF-epitopes, green-fluorescent protein and variants thereof.

The term "structure coordinates" refers to mathematical detercoordinates derived from mathematical equations related to the patterns obtained on diffraction of a monochromatic beam of X-rays by the atoms (scattering centers) of a molecule or molecule complex in crystal form. The diffraction data are used to calculate an electron density map of the repeating unit of the crystal. The electron density maps are used to establish the positions of the individual atoms within the unit cell of the crystal.

The term "root mean square deviation" means the square root of the arithmetic mean of the squares of the deviations. It is a way to express the deviation or variation from a trend or object. For purposes of this invention, the "root mean square deviation" defines the variation in the backbone of a protein from the backbone of CD-NTase or a binding pocket portion thereof, as defined by the structure coordinates of CD-NTase described herein.

The term "binding pocket," as used herein, refers to a region of a molecule or molecular complex, which, as a result of its shape, favorably associates with another chemical entity. Thus, a binding pocket may include or consist of features such as cavities, surfaces, or interfaces between domains. Chemical entities that may associate with a binding pocket include, but are not limited to, cofactors, substrates, modifiers, agonists, and antagonists.

The term "unit cell" refers to a basic parallelipiped shaped block. The entire volume of a crystal may be constructed by regular assembly of such blocks. Each unit cell comprises a complete representation of the unit of pattern, the repetition of which builds up the crystal.

The term "space group" refers to the arrangement of symmetry elements of a crystal.

The term "molecular replacement" refers to a method that involves generating a preliminary model of a CD-NTase crystal whose structure coordinates are unknown, by orienting and positioning a molecule whose structure coordinates are known (e.g., CD-NTase coordinates from Table 3) within the unit cell of the unknown crystal so as best to account for the observed diffraction pattern of the unknown crystal. Phases can then be calculated from this model and combined with the observed amplitudes to give an approximate Fourier synthesis of the structure whose coordinates are unknown. This, in turn, can be subject to any of the several forms of refinement to provide a final, accurate structure of the unknown crystal (Lattman et al. (1985) *Methods in Enzymology* 115:55-77; M. G. Rossmann, ed., "The Molecular Replacement Method", Int. Sci. Rev. Ser., No. 13, Gordon &

Breach, New York, (1972)). Using the structure coordinates of CD-NTase provided herein, molecular replacement may be used to determine the structure coordinates of a crystalline mutant or homologue of CD-NTase or of a different crystal form of CD-NTase.

In the context of this invention, the term "crystal" refers to a regular assemblage of a modified CD-NTase polypeptide or a complex of a modified CD-NTase polypeptide for X-ray crystallography. That is, the assemblage produces an X-ray diffraction pattern when illuminated with a beam of X-rays. Thus, a crystal is distinguished from an agglomeration or other complex of CD-NTase that does not give a diffraction pattern.

The term "RECON" refers to CDN sensor reductase controlling NF-κB. RECON is a mammalian host receptor for bacterial cdNs. The oxidoreductase RECON is a high-affinity cytosolic sensor of bacterium-derived cyclic dinucleotides (CDNs). CDN binding inhibits RECON's enzymatic activity and subsequently promotes inflammation. High-affinity cdN binding inhibited RECON enzyme activity by simultaneously blocking the substrate and cosubstrate sites, as revealed by structural analyses. CDN inhibition of RECON promotes a proinflammatory, antibacterial state that is distinct from the antiviral state associated with STING activation. During bacterial infection of macrophages, RECON antagonized STING activation by acting as a molecular sink for cdNs. RECON also negatively regulates NF-κB activation (McFarland et al. (2017) *Immunity* 46:433-445; McFarland et al. (2018) mBio 9: e00526-18).

The term "STING" or "stimulator of interferon genes", also known as transmembrane protein 173 (TMEM173), refers to a five transmembrane protein that functions as a major regulator of the innate immune response to viral and bacterial infections. STING is a cytosolic receptor that senses both exogenous and endogenous cytosolic cyclic dinucleotides (CDNs), activating TBK1/IRF3 (interferon regulatory factor 3), NF-κB (nuclear factor KB), and STAT6 (signal transducer and activator of transcription 6) signaling pathways to induce robust type I interferon and proinflammatory cytokine responses. The term "STING" is intended to include fragments, variants (e.g., allelic variants) and derivatives thereof. Representative human STING cDNA and human STING protein sequences are well-known in the art and are publicly available from the National Center for Biotechnology Information (NCBI). Human STING isoforms include the longer isoform 1 (NM_198282.3 and NP_938023.1), and the shorter isoform 2 (NM_001301738.1 and NP_001288667.1; which has a shorter 5' UTR and lacks an exon in the 3' coding region which results in a shorter and distinct C-terminus compared to variant 1). Nucleic acid and polypeptide sequences of STING orthologs in organisms other than humans are well-known and include, for example, chimpanzee STING (XM_016953921.1 and XP_016809410.1; XM_009449784.2 and XP_009448059.1; XM_001135484.3 and XP_001135484.1), monkey STING (XM_015141010.1 and XP_014996496.1), dog STING (XM_022408269.1 and XP_022263977.1; XM_005617260.3 and XP_005617317.1; XM_022408249.1 and XP_022263957.1; XM_005617262.3 and XP_005617319.1; XM_005617258.3 and XP_005617315.1; XM_022408253.1 and XP_022263961.1; XM_005617257.3 and XP_005617314.1; XM_022408240.1 and XP_022263948.1; XM_005617259.3 and XP_005617316.1; XM_022408259.1 and XP_022263967.1; XM_022408265.1 and XP_022263973.1), cattle STING (NM_001046357.2 and NP_001039822.1), mouse STING (NM_001289591.1 and NP_001276520.1; NM_001289592.1 and NP_001276521.1; NM_028261.1 and NP_082537.1), and rat STING (NM_001109122.1 and NP_001102592.1).

STING agonists have been shown as useful therapies to treat cancer. Agonists of STING well-known in the art and include, for example, MK-1454, STING agonist-1 (MedChem Express Cat No. HY-19711), cyclic dinucleotides (CDNs) such as cyclic di-AMP (c-di-AMP), cyclic-di-GMP (c-di-GMP), cGMP-AMP (2'3'cGAMP or 3'3'cGAMP), or 10-carboxymethyl-9-acridanone (CMA) (Ohkuri et al. (2015) *Oncoimmunology* 4 (4): e999523), rationally designed synthetic CDN derivative molecules (Fu et al. (2015) *Sci Transl Med.* 7 (283): 283ra52. doi: 10.1126/scitranslmed.aaa4306), and 5,6-dimethyl-xanthenone-4-acetic acid (DMXAA) (Corrales et al. (2015) *Cell Rep.* 11 (7): 1018-1030). These agonists bind to and activate STING, leading to a potent type I IFN response. On the other hand, targeting the cGAS-STING pathway with small molecule inhibitors would benefit for the treatment of severe debilitating diseases such as inflammatory and autoimmune diseases associated with excessive type I IFNs production due to aberrant DNA sensing and signaling. STING inhibitors are also known and include, for example, CCCP (MedChem Express, Cat No. HY-100941) and 2-bromopalmitate (Tao et al. (2016) IUBMB Life. 68 (11): 858-870). It is to be noted that the term can further be used to refer to any combination of features described herein regarding STING molecules. For example, any combination of sequence composition, percentage identify, sequence length, domain structure, functional activity, etc. can be used to describe a STING molecule encompassed by the present invention.

The term "STING pathway" or "cGAS-STING pathway" refers to a STING-regulated innate immune pathway, which mediates cytosolic DNA-induced signalling events. Cytosolic DNA binds to and activates cGAS, which catalyzes the synthesis of 2'3'-cGAMP from ATP and GTP. 2'3'-cGAMP binds to the ER adaptor STING, which traffics to the ER-Golgi intermediate compartment (ERGIC) and the Golgi apparatus. STING then activates IKK and TBK1. TBK1 phosphorylates STING, which in turn recruits IRF3 for phosphorylation by TBK1. Phosphorylated IRF3 dimerizes and then enters the nucleus, where it functions with NF-κB to turn on the expression of type I interferons and other immunomodulatory molecules. The cGAS-STING pathway not only mediates protective immune defense against infection by a large variety of DNA-containing pathogens but also detects tumor-derived DNA and generates intrinsic antitumor immunity. However, aberrant activation of the cGAS-STING pathway by self DNA can also lead to autoimmune and inflammatory disease.

The term "cGAS" or "Cyclic GMP-AMP Synthase", also known as Mab-21 Domain-Containing Protein 1, refers to nucleotidyltransferase that catalyzes the formation of cyclic GMP-AMP (cGAMP) from ATP and GTP (Sun et al. (2013) *Science* 339:786-791; Krazusch et al. (2013) Cell Rep 3:1362-1368; Civril et al. (2013) *Nature* 498:332-227; Ablasser et al. (2013) Nature 503:530-534; Kranzusch et al. (2014) *Cell* 158:1011-1021). cGAS involves both the formation of a 2,5 phosphodiester linkage at the GpA step and the formation of a 3,5 phosphodiester linkage at the ApG step, producing c [G (2,5) pA (3,5) p] (Tao et al. (2017) *J Immunol* 198:3627-3636; Lee et al. (2017) *FEBS Lett.* 591:954-961). cGAS acts as a key cytosolic DNA sensor, the presence of double-stranded DNA (dsDNA) in the cytoplasm being a danger signal that triggers the immune responses (Tao et al. (2017) *J Immunol* 198:3627-3636). cGAS binds cytosolic DNA directly, leading to activation and synthesis of cGAMP, a second messenger that binds to and activates TMEM173/STING, thereby triggering type-I interferon production (Tao et al. (2017) *J Immunol* 198: 3627-3636; Wang et al. (2017) *Immunity* 46:393-404). cGAS has antiviral activity by sensing the presence of dsDNA from DNA viruses in the cytoplasm (Tao et al. (2017) J Immunol 198:3627-3636). cGAS also acts as an innate immune sensor of infection by retroviruses, such as HIV-1, by detecting the presence of reverse-transcribed DNA in the cytosol (Gao et al. (2013) *Science* 341:903-906). The detection of retroviral reverse-transcribed DNA in the cytosol may be indirect and be mediated via interaction with PQBP1, which directly binds reverse-transcribed retroviral DNA (Yoh et al. (2015) *Cell* 161:1293-1305). cGAS also detects the presence of DNA from bacteria, such as *M.tuberculosis* (Wassermann et al. (2015) *Cell Host Microbe* 17:799-810). cGAMP can be transferred from producing cells to neighboring cells through gap junctions, leading to promote TMEM173/STING activation and convey immune response to connecting cells (Ablasser et al. (2013) *Nature* 503:530-534). cGAMP can also be transferred between cells by virtue of packaging within viral particles contributing to IFN-induction in newly infected cells in a cGAS-independent but TMEM173/STING-dependent manner (Gentili et al. (2015) *Science* 349:1232-1236). In addition to antiviral activity, cGAS is also involved in the response to cellular stresses, such as senescence, DNA damage or genome instability (Mackenzie et al. (2017) Nature 548:461-465; Harding et al. (2017) *Nature* 548:466-470). cGAS acts as a regulator of cellular senescence by binding to cytosolic chromatin fragments that are present in senescent cells, leading to trigger type-I interferon production via TMEM173/STING and promote cellular senescence. cGAS is also involved in the inflammatory response to genome instability and double-stranded DNA breaks. cGAS acts by localizing to micronuclei arising from genome instability (PubMed: 28738408; Harding et al. (2017) *Nature* 548:466-470). Micronuclei, which is frequently found in cancer cells, is consist of chromatin surrounded by its own nuclear membrane. Following breakdown of the micronuclear envelope, a process associated with chromothripsis, MB21D1/cGAS binds self-DNA exposed to the cytosol, leading to cGAMP synthesis and subsequent activation of TMEM173/STING and type-I interferon production (Mackenzie et al. (2017) *Nature* 548:461-465; Harding et al. (2017) *Nature* 548:466-470). In one embodiment, human cGAS has 522 amino acids with a molecular mass of 58814 Da. cGAS is a monomer in the absence of DNA and when bound to dsDNA (Tao et al. (2017) *J Immunol* 198:3627-3636). cGAS interacts with PQBP1 (via WW domain) (Yoh et al. (2015) *Cell* 161:1293-1305). cGAS also interacts with TRIM14 and this interaction stabilizes cGAS/MB21D1 and promotes type I interferon production (Chen et al. (2016) *Mol Cell* 64:105-119). cGAS also interacts with herpes virus 8/HHV-8 protein ORF52, and this interaction inhibits cGAS enzymatic activity.

The term "cGAS" is intended to include fragments, variants (e.g., allelic variants) and derivatives thereof. Representative human cGAS cDNA and human cGAS protein sequences are well-known in the art and are publicly available from the National Center for Biotechnology Information (NCBI). Human cGAS isoforms include the protein (NP_612450.2) encoded by the transcript (NM_138441.2). Nucleic acid and polypeptide sequences of cGAS orthologs in organisms other than humans are well-known and include, for example, chimpanzee cGAS (XM_009451553.3 and XP_009449828.1; and XM_009451552.3 and XP_009449827.1), Monkey cGAS (NM_001318175.1 and NP_001305104.1), cattle cGAS (XM_024996918.1 and XP_024852686.1, XM_005210662.4 and XP_005210719.2, and XM_002690020.6 and XP_002690066.3), mouse cGAS (NM_173386.5 and NP_775562.2), rat cGAS (XM_006243439.3 and XP_006243501.2), and chicken cGAS (XM_419881.6 and XP_419881.4).

Anti-cGAS antibodies suitable for detecting cGAS protein are well-known in the art and include, for example, antibody TA340293 (Origene), antibodies NBP1-86761 and NBP1-70755 (Novus Biologicals, Littleton, CO), antibodies ab224144 and ab176177 (AbCam, Cambridge, MA), antibody 26-664 (ProSci), etc. In addition, reagents are well-known for detecting cGAS. Multiple clinical tests of cGAS are available in NIH Genetic Testing Registry (GTR®) (e.g., GTR Test ID: GTR000540854.2, offered by Fulgent Clinical Diagnostics Lab (Temple City, CA)). Moreover, mutilple siRNA, shRNA, CRISPR constructs for reducing cGAS expression can be found in the commercial product lists of the above-referenced companies, such as siRNA product #sc-95512 from Santa Cruz Biotechnology, RNAi products SR314484 and TL305813V, and CRISPR product KN212386 (Origene), and multiple CRISPR products from GenScript (Piscataway, NJ). It is to be noted that the term can further be used to refer to any combination of features described herein regarding cGAS molecules. For example, any combination of sequence composition, percentage identify, sequence length, domain structure, functional activity, etc. can be used to describe a cGAS molecule encompassed by the present invention.

There is a known and definite correspondence between the amino acid sequence of a particular protein and the nucleotide sequences that can code for the protein, as defined by the genetic code (shown below). Likewise, there is a known and definite correspondence between the nucleotide sequence of a particular nucleic acid and the amino acid sequence encoded by that nucleic acid, as defined by the genetic code.

GENETIC CODE

| | |
|---|---|
| Alanine (Ala, A) | GCA, GCC, GCG, GCT |
| Arginine (Arg, R) | AGA, ACG, CGA, CGC, CGG, CGT |
| Asparagine (Asn, N) | AAC, AAT |
| Aspartic acid (Asp, D) | GAC, GAT |
| Cysteine (Cys, C) | TGC, TGT |
| Glutamic acid (Glu, E) | GAA, GAG |
| Glutamine (Gln, Q) | CAA, CAG |
| Glycine (Gly, G) | GGA, GGC, GGG, GGT |
| Histidine (His, H) | CAC, CAT |
| Isoleucine (Ile, I) | ATA, ATC, ATT |
| Leucine (Leu, L) | CTA, CTC, CTG, CTT, TTA, TTG |
| Lysine (Lys, K) | AAA, AAG |
| Methionine (Met, M) | ATG |
| Phenylalanine (Phe, F) | TTC, TTT |
| Proline (Pro, P) | CCA, CCC, CCG, CCT |
| Serine (Ser, S) | AGC, AGT, TCA, TCC, TCG, TCT |
| Threonine (Thr, T) | ACA, ACC, ACG, ACT |
| Tryptophan (Trp, W) | TGG |
| Tyrosine (Tyr, Y) | TAC, TAT |
| Valine (Val, V) | GTA, GTC, GTG, GTT |
| Termination signal (end) | TAA, TAG, TGA |

An important and well-known feature of the genetic code is its redundancy, whereby, for most of the amino acids used to make proteins, more than one coding nucleotide triplet may be employed (illustrated above). Therefore, a number of different nucleotide sequences may code for a given amino acid sequence. Such nucleotide sequences are considered functionally equivalent since they result in the production of the same amino acid sequence in all organisms (although certain organisms may translate some sequences more efficiently than they do others). Moreover, occasionally, a methylated variant of a purine or pyrimidine may be found in a given nucleotide sequence. Such methylations do not affect the coding relationship between the trinucleotide codon and the corresponding amino acid.

In view of the foregoing, the nucleotide sequence of a DNA or RNA encoding a modified CD-NTase polypeptide nucleic acid (or any portion thereof) can be used to derive the modified CD-NTase polypeptide amino acid sequence, using the genetic code to translate the DNA or RNA into an amino acid sequence. Likewise, for polypeptide amino acid sequence, corresponding nucleotide sequences that can encode the polypeptide can be deduced from the genetic code (which, because of its redundancy, will produce multiple nucleic acid sequences for any given amino acid sequence). Thus, description and/or disclosure herein of a nucleotide sequence which encodes a polypeptide should be considered to also include description and/or disclosure of the amino acid sequence encoded by the nucleotide sequence. Similarly, description and/or disclosure of a polypeptide amino acid sequence herein should be considered to also include description and/or disclosure of all possible nucleotide sequences that can encode the amino acid sequence.

Finally, nucleic acid and amino acid sequence information for the CD-NTase polypeptide encompassed by the present invention are well-known in the art and readily available on publicly available databases, such as the National Center for Biotechnology Information (NCBI). For example, exemplary nucleic acid and amino acid sequences derived from publicly available sequence databases are provided in Table 1 below.

TABLE 1

Representative CD-NTase amino acid sequences

| CD-NTase Name | SEQ ID NO: | Amino Acid Sequence |
|---|---|---|
| DncV | 4 | MRMTWNFHQYYTNRNDGLMGKLVLTDEEKNNLKALRKIIRLRTRDVFEEAKGIAKAVKKS<br>ALTFEIIQEKVSTTQIKHLSDSEQREVAKLIYEMDDDARDEFLGLTPRFWTQGSFQYDTL<br>NRPFQPGQEMDIDDGTYMPMPIFESEPKIGHSLLILLVDASLKSLVAENHGWKFEAKQTC<br>GRIKIEAEKTHIDVPMYAIPKDEFQKKQIALEANRSFVKGAIFESYVADSITDDSETYEL<br>DSENVNLALREGDRKWINSDPKIVEDWFNDSCIRIGKHLRKVCRFMKAWRDAQWDVGGPS<br>SISLMAATVNILDSVAHDASDLGETMKIIAKHLPSEFARGVESPDSTDEKPLFPPSYKHG<br>PREMDIMSKLERLPEILSSAESADSKSEALKKINMAFGNRVTNSELIVLAKALPAFAQEP<br>SSASKPEKISSTMVSG |
| NTase001 aka Ec-DncV | 6 | MPWDFNNYYSHNMDGLISKLKLSKTESDKLKALRQIVRERTRDVFQEARQVAIDVRRQAL<br>TLESVRLKLEKTNVRYLSPEERADLARLIFEMEDEARDDFIKFQPRFWTQGSFQYDTLNR<br>PFHPGQEMDIDDGTYMPMTVFESEPSIGHTLLLLLVDTSLKSLEAENDGWVFEEKNTCGR<br>IKIYREKTHIDVPMYAIPKEQFQKKQTAADSAHLIKSDSVFESFALNRGGREAYAVESDK<br>VNLALREGVRRWSVSDPKIVEDWFNESCKRIGGHLRSVCRFMKAWRDAQWEVGGPSSISL<br>MTAVVNILDRESHNGSDLTGTMKLIARLLPEEFNRGVESPDDTDEKPLFPAESNHNVHHR<br>AIVETMEGLYGILLAAEQSESREEALRKINEAFGKRVTNALLITSSAAAPAFLNAPSKEP<br>SSKPINKTMVSG |
| NTase002 | 8 | MLNLSPLFFTTLDDESCMHDELDLTPGQRAWIASARTDVRDCLRTGIPRVLRANGYTEDV<br>PQPRFFTQGSWYKTLNAPAQHPQQADVDDGCYLPMSFVSQTKRPSTAATVFFAAAAEEAL<br>KPLVEERRWKLVTDKPTCIRIVIAAYAHIDIPLYAIPDEEFVTLAKASMERYGYDSLTEA<br>VNMAERDAWTALPADKVLLAHRECNWMSSDPRPVKEWFLGEVEAKGEQFRRVVRYLKAFR<br>DWKWSSGGPASILLMAAAAPLFEKRDRRDDLALLDVVAALPARLRGGVNNPVEESESLTE<br>PLGQAGVEDAAKAFEEFEKVLRGATGAGSPSQACIWMRGEFGPRFPNEPDRVKVVSVAAT<br>IAAAPATAGPSELVGRTKAG |
| NTace003 | 11 | MLNLSPLFFTTVDNRTCLHGALDLEDAQRTYIAQARLDVRNCLRAGIPAILKAHGYPGQV<br>PTPRFFTQGSWAYKTLNAPAKPPQQADVDDGCYLPMGFVSQSNRPSVAAGVFFQAAEAAL<br>QPLVDQNKWQLVTDKDTCIRIVIAKDAHIDIPLYAIPDEEFVTLAKAFESPGIAMDSITF<br>AEEEDVWTKLPRYKVLLAHRQENWKVSDPRPVKEWFLSEVEAKGEQFRRTVRYLKAYRDW<br>HWESGGPSSILLMAAAAPLFEKHDSRDDLALLAVVEKLSDALREGVSNPADTSESLTERL<br>GAVGVEDAAKAYESFAIMLRGAIHASKASQACAWMRHEFGSRFTDDPERVKVVSVASSIA<br>SSSAIAGPSELIGRSKAG |
| NTase004 | 14 | MYDCSKEFSTFYRKKVVLSAKEQDELRKRRKQNIRRIKDGLNEYNEEKKTSYKISEDRIQ<br>GSMAMHTITQNDEKDYDIDVGIVFEADCLNSLGAQATPNMVANALERKTRQFAQPPEVKT<br>SCVRLKYSSLGYHMDFAVFQRSKEYEWDDNYIYEHAGTEWTERHIKALEEWFINRVKYSG<br>DDLRKIVRLSKMFCKSRDSWKNMPSGLVQTILCDSKLKNYYSRLDEKFYYTMQAIVQRLD<br>IHLDVNAPVDNGRELIIRDVDYKRMENWKNRLRASLNKLDILFDKECSREDALQAWALFF<br>NHSYWEELAEQNQRSNISESRFLSFNDTEQFIEELYPIYENYNVSIDCDVSGNGFSVMPI<br>EKFFDKLSPQLKRFIPYNFSIRCRLGDTDCPTYDKILWKVRNIGIEAEKRNCIRGQIVDN<br>RGTEIIENSNFAGLHYIECYLIKNDICVGIGHVDIPIGGI |
| NTase005 | 17 | MFDLETEFNIFYRDYVVLSKDEKQNLYNKKDLNLDRLKDGLQEYNEEKKTEYKIKDNVVQ<br>GSYAMSTVTQNDKHDYDIDVAVIFDKDNIPSGTTAVKNIVVNSLKKKCKQFKTEPEAKTN<br>CVRVAYEEGYHIDFAVYRRFKNDSDEFEYEHCGSEWSKRDPRTITNWFIENNKAQDYKLR<br>KIVRLLKMFCKSREHWVMPGGLIHTVLVVECFEPNDRIDKSFYNTIKATRDRLKNDKEYK<br>NPVDDSLSLIIKESDKTKVENLYNRLSTYIDKLDILFTDGCTKEQAIEAWNDFFNHSYWS<br>DLLTEDTQKANESAYCATETFPECDETEEFIEHIYPIDIKYDLNINCRVTQDGWRTKLLR<br>SMLRLKEPLRLNKNLEFFIEGTNVPPPYKVFWKVRNIGDVAEQKNCIRGQIVEDKGKNTK<br>KEETSFPGPHFVECYIVRYGVCVARSRIDVPINIL |

TABLE 1-continued

Representative CD-NTase amino acid sequences

| CD-NTase Name | SEQ ID NO: | Amino Acid Sequence |
|---|---|---|
| NTase006 | 20 | MADIDCHSEMTNFHRDKVTLSNKQQGEMRTRRDAGRTRLENGLNEAKKPQPNEVRSQGSYQMRTMVQDDANDYDIDDGAYFASDDLKDNAGVALTPKAARERVCNALVWDGRLKQEATVKRNCVRQVYAAGYHIDIPVYRIIITTNDENNDPVEHYELASGDEWTRSDARAVTRWFNGLVGELNSGESDGSQMRRVTKLTKKFARRSSWKDETTSGICITKLVVDHFQYSADRDDKALRETWKAIDKKLQKSTEIDHPVLATKLAQAGDAAVTFFHTCLSDALKTLEVLDTSDCTRKKAREAWDDVFDIDFFSMQPDNKDDGGGGKGSAMSVTSVETARRNDGGGRFG |
| NTase007 | 23 | MANLDTQFQEFYGELQITVTKKQALITSHNNLRTKIQKYFAKNHPEYVPSFYIQGSYKMGTTIRTRDDECDLDDGCYFIPKPEVKGITLQNWVMDAVNGTVGATPVHKNKCIRVNYAAGYHIDLPVYRKERCNDNTEHPELAVRDGEYELSDPREIVQWFNSKKKDMPVLIRLVSYLKSWCDTVPGFMPPGLAMTILASKYQKKHEGRDDIALRDTLKSIRTALQANFSCVVPGTPYDDLFESYDSNRQEKFMSELNGFIEDADRAVNEKNKLKASKLWKKHLGNRFHLAPDENDAEMSKLDKLRDIGNKVLTGIATTAHNGYIHAAEGVKNVSHRNYGNE |
| NTase008 | 26 | MANNHEQFIAFNKTINSNKRATLKKNRDALRERIKNYFSREYPDEIQPKFHWQGSYAMHTILNPLKDENNLGVYDLDDGVYFIGKSEDERHSVQWYHDRIYEAVDGHTSIKPDDNKPCITVNYGDGHHIDLPIYFMVEGDKHPLLAHKTKSWLDTDPRELLNWFMGRDEHPQLRRIVRYLKAWCEYIRFKKEIKMPTGCSLTMLAVKNFKSNERDDIAMKNILVAIHNSLSSKFECLRPTFPKNEDLFEEYSETRKNNFMQELKSFREDAERAIESKNPHEACMKWQKHLGDRFSCSTAKDEDEDAQTKSFSGTINTNSRFA |
| NTase009 | 29 | MANVQKYFEEFHEAIRLSDTDENEELREKRDIILNRLNEKKADNVPKYTPFNQGSYAMGTGVKPIDGEYDIDVGIRFDISKDDYPDPVEVKKWVYDALQDHTSEVKMRRSCVTVTYFKDGEPEFHVDLAIYAANNDDGKLYLAKGKLYSDDENKYWEVSNPLELITKIRNKYEDADDRNQFRRVIRYLKRWKDVNFTTDGSAAPTGIGLTVAAYNFLTISKQYDFATGKYKYNDLSALKNLVQSILSSFRLEYNQEEGKGVERLRISLPTEPYNDLFEKMSDSQMADFKVKLEELKTTLNNAEVEPDPHEACKILKKVFGKPFPVPPKEETGQRKNLAFFGTSASA |
| NTase010 | 32 | MSLQNKFKNFHDAIKLGRKDLEYTTARLKDDSITADIVERFKEDGYPVVEDFIQGSLATFTGIREKGQDFDIDRAIVIEAEIAPENPITPKLAVLEVLEGRGFKNAKIKKPCVTADYKADDLHIDIPIYRKYNNGEYELAVGKRHSTEDNREWARAAPRELIDWVNNYDADETYGSNKHDQFRRIVRYLKRWRNFTFGDDVRRKVYSIGIAVMVKESFDSSINDEGFPDDLTALRKTINHMLNYRSYFTQVGVDKYSVNVTLPVSPYRDIFHSSSIVTGTQFRNKLSALLKTLNKVADEEQESKQCELLRSVFGEDFPECAETSSASSTAVKTVFASAGVVGTSQGA |
| NTase011 | 35 | MSLQNKFNTENQRIYLTRHDSEYSNAREKDDSITAAIKAKFKEKGYPVIDNFVQGSLATYTTIKEPGKDFDIDRAIVIDYEESPSDPLVPKKVILEILEDRGFQNAKIKKPCVTADYKFKNLHIDIPVYRKNSWGGYELAVGKKDSADEHKIWSESSPKELIDWVNDSSQYGVYATEKLHQFRRLVRYLKRWRNLKFSPDVCRKIYSIGLTVMIKQNFKPSIDEDGFPNDLLALKATVDSILQWSCYFQLHSDDQWKVKVELPVYPSRDIFHGSSLNTGTRFRNQFTNLRSTLQDVIDTSDEAEQCSLLVKVFGDDFPNNVNTNSASNAQKVQFATSGAVGTSQGA |
| NTase012 | 38 | MANLQSYFNSFHDAIKLDYDDNKELRDKRDELLEILKANMPSDAGSFEIFHQGSYAMYTGVKPLDDGDYDIDVGLLFNISKDDYPNPVTVKKWVYDALTKNYEDVEMKKPCVTVKFKAEGEDERNYHVDFAVYADYESDEKTYLAKGKLNSNAENRYWEESDPKTLVNDIKNHFTDSEDRKQFRRVIRYLKRWKDIKFKGQVNRPSGIGLTVAGLTHFQPKYTYDGFTNTKNYKDLDAIESFVQSMLNAFAWVFNEENELEERLQVYLPTFPYNDIYEKMTGKQMTDFKEKLQCLLDKLQQAKNEADPVVACKLLQEEFGDDFPVPEESTTAQKRGPAIIVDHSSA |
| NTase013 | 41 | MANIQTSFIDFKNSIRLDVEDNTLLKDYKDQVIDGLKDYLPDDVKFETFLQGSYSVYTGIKSCDEKIDFDIDIAVAFEIDHTVYEDPREPKLWVKEALVEIFPNAQVNLKVPCVTATFTGKKTKKNVHVDVAVYAKEDKNYFLAKAKEFSAPENRCWEEADPKVLKEKINSHVADDDRPKQFRRCIRYLKRWKDNNFNQEYKPTGIGLTINVMDTFLVNKSTDFLTRKVQYNDMECMKQIVSSLKDSFVYEYSETDGWHYRLHAYLPVKPNSDTYSKMTVNQMSDFKNKLSKLYDDLIFAIDTEDEYEATKRLNNQFGEDFLIISEEEVTEKNLRNAFVTDYPSA |
| NTase014 | 44 | MPTLQSQFIKFHDTIKLDADDKKVLIDKRKELEEVINNGVSEFEKSFFNQGSYSTYTGILPIDEGDYDLDRGLKIDVDRHSNSPKEVKKFIFDALVSEFGENRVKVKNPCVTVSFPEDNVHIDIAVYCTENDNYFLARGKLNSIYENIKWEEADPVELTKKINNAMENSEDRNQFRRVIRYLKRWKDLKFKNQDNRPTGIGISVFAVSNFSVSKKVDYLSGNTTYDDISALRNLVNTMINSFSDTYDVDRNLFYPRLEVYLPVKPYTDVYERVSNIQMEAFKNKLEKLRDSLDEAINSTDLSESTKVLSKQFGDDFPIIEQKETAENFGTRAIISDYPSA |
| NTase015 | 47 | MNCSDLFYADTNTENTLHQRTQLSEVILSKGIAKKNELIEFLRQELKEAFDCDVRFWLQGSYKSHTLIKPVDKFSSYDIDIGVYLFFDAENEGVDSKDVKETLRDALLSYCSINNEAKLQESKNACEGLKFSTFLTVDTPIYYKTDTKIKLATDKGWSDSDPKAIQDWITNYYKDKSDRALMKRLVRYFKAWVNVKWQNTGFKKIPSLAINVLVAQHMKQHVREDDCFIYTALSICEELESTLIVRNPLNNSNLISMPQDAECFAHQKLDELKQVCLSCIKSDDIKRGAHFSNLFQHYFPQISLDSATGSTGLPTVVNVPEISVCRYDKNGNHVETIITDRLTVNKGDSLTFTIRNHYDFNIYSSAQWTVRNIGSQANDANDIGHSVTGKPSESHKRGTSYTGSHTMECMILHNGAIIGFKTIHVIVKPARTVRRKTLKFWRA |
| NTase016 | 50 | MSFDKNKHLREVLDTHKMCHVQDFVNKVKKRREEIKAKMHDHYGCDKYSSFGSGSFAKHTATNVKFDLDLVEPFKRNSFGTLQEMFDSVHDFLAEEYKNTGVTIRRQKVSIGVSFPIEEG |

TABLE 1-continued

Representative CD-NTase amino acid sequences

| CD-NTase Name | SEQ ID NO: | Amino Acid Sequence |
|---|---|---|
| | | DEKPVELDVVPGRELSDDNYLDSHDLNLCFNEDHWGFQKGSSQKTNIQKQISHIEGKSSE<br>RQIIRLLKIWKKQKDKKYKSFVIELAVIRALDGYNGDMGLWPRLKYTMEYLRDHIAESSF<br>HLFDPGNTNNDVVGTMQDYDRQSFKSDMESMLNNIDSNPDLYLPYYFKVNEKYCGYKEKD<br>TGAAYPTSTKRFG |
| NTase017 | 53 | MSSAYLNAIIAREAVDTSAFSPVRQVQTIIAPVLQQWANRFLLSISPSGSFAKGTANRSG<br>TDIDLFISLHEDTPETLKDIYGSLFNAIAGAGYVPKRQNASINATIGGFDVDLVPGKRQS<br>AWTTDHSLYRRTADTWTKTNVTTHINTVVMAGHQRESRLLKLWRNQKRLEFPSFYLELTV<br>IAALSGRTSPDLAENVVTVLEYLRDKFTAARVIDPANGNNVISDDLTGTEKQAVRRLAEA<br>ALGGMWSGFVQ |
| NTase018 | 56 | MSSGLDRVKTSSEDEMSTEHVDHKTIARFAEDKVNLPKVKADDFREQAKRLQNKLEGYLS<br>DHPDFSLKRMIPSGSLAKGTALRSLNDIDVAVYISGSDAPQDLRGLLDYLADRLRKAFPN<br>FSPDQVKPQTYSVTVSFRGSGLDVDIVPVLYSGLPDWRGHLISQEDGSFLETSIPLHLDF<br>IKARKRAAPKHFAQVVRLAKYWARLMKQERPNFRFKSFMIELILAKLLDNGVDFSNYPEA<br>LQAFFSYLVSTELRERIVFEDNYPASKIGTLSDLVQIIDPVNPVNNVARLYTQSNVDAII<br>DAAMDAGDAIDAAFYATKQLTVTYWQKVFGSSFQG |
| NTase019 | 59 | MPLTNTQIRYYDSNVLRLPKDKRETYNAQVDRLITALRKKLKDQDKITIKRVVKAGSFAK<br>HTILRKTSDSQVDVDVVFYVSGEKVAEETFASLSEKIYEALLKMYPNKAVEDFEIQRKAA<br>TVSFVGTGLDVDIVPVIENPDKEGYGWQFDRIDGSKTETCAPCQIKFVKERKDQDPDFRT<br>LVRLAKRWRTNMECPLKSFHIELIMAHVLEVNGKDGSLEKRFRDFLLYIAESGLKEVITF<br>PENSTIPAFSHPVVILDPVCDTNNVTSRITEDERKEIVRIAEKSWATANFASVEGDYDIW<br>KELFGRSFKVEDAA |
| NTase020 | 62 | MSLSNTALEYFDHNVLRLPGEKRKEYHAQVDNLVSELKKRITDKSKLKVKKVVKAGSFAK<br>YTILRKIDDYPTDVDVVFYITGVEENSKSYEVLCNRIYDLLIEIYPTKKVEDFEIQRRAA<br>KVTFVKSGLEVDVVPVLQHSTLADHGWQYDIQSGARNLTCAPCHIQFIRTRKDKDKHFRT<br>LVRLAKRWKHFHDIPGLKSFHIELILAHLVDTDGAAENIEKRFREFLVYIARTKLGERID<br>FPENEGKTSVSFSDPVVIIDPASPENNVASRITKDEQEQIAKAAEAAWEAATYASTKNDD<br>DLWKEIFGGRFKTKD |
| NTase021 | 65 | MQLADHFNVLLKDTVNLSQFKLDLLNQRVEAIYKALKADVEIGALITGKTPQGSWAHRTI<br>INPVGDNEFDADFMLDMSQNPDWADNPKTYIDEVYAALHRHSTYGTMPHSRKCRCARLVY<br>ANSMHVDIVPHLNLADGREVIVNRDDNEWELTNPQGFTDWMKKQDSIASGNLRKVIRLMK<br>YLRDHKNSFTGTRSVLLTTMLGEQVTDLRKLLDPSYYSNVPTTLLHVVQDLDTWLQANPI<br>KPSIADPSGSGVTFDHRWGPDPESAQATYSYFRDRIHVHAADIEAAYEEKDKDRSVQLWQ<br>NIFGDGFKAPATTTASAKFPAATSAADSTVGRSGRAG |
| NTase022 | 68 | MPMLTVAQAFETFMNSLRLHDGEARDATRQEQYVFNAMRRQLRPTESFISGSYGRNTAIR<br>PLHDIDLFLVLADDGRNPPEPEDALARVQWALRAEFHDKETRLQNRSVNINFTGTEIGFD<br>VVPALYDPWEQGGYLIPDRRAGQWIRSNPRKHQEACDDANDVAKKKLKPWIKAIKRWNFR<br>HDKPVPSFLLEVLACRGVTHSLGDKSYAEGLAQLFDYMCANILNQCPVPGSSGFTITSWI<br>PQGRLVQAHQRLTQAVRVSKRALELEYSGYTVEALDLWRELLGTDFPVR |
| NTase023 | 71 | MLSIDEAFRKFKSRLELNEREQKNASQRQNEVRDYLQTKFGIARSFLTGSYARYTKTKPL<br>KDIDIFFVLKDSEKHYHGKAASVVLDDFHSALVEKYGSAAVRKQARSINVDFGVHIDAED<br>NTDYRVVSVDAVPAFDTGDQYEIPDTASGKWIKTDPEIHKDKATAAHQAYANEWKGLVRM<br>VKYWNNNPKHGDLKPVKPSFLIEVMALECLYGGWGGSFDREIQSFFATLADRVHDEWPDP<br>AGLGPAISNDMDAARKQRAQQLLFQASQDASIAIDHARRGRNIEALRAWRALFGPKFPLS |
| NTase024 | 74 | MSDFRINKAINAFVAEHIDLHKDTVQKGRNSRNWLLDQLESMAQKAEHFPPRYTDRHKGF<br>GSFHRSTKKQELDDIDQLFCFSARGDMYYSEVGSTVYINIAGDNEIYGHLTSTNDNTKLS<br>SIKMVNLMVSSLDSIGQYKNTPHRNGEAATLQAAAYDWNFDIVPCFFTAADANGKDYYLI<br>PDGSGNWKKTDPREDKNRSARINQSHRGQILQLIRIIKYWNKRQTMATMGSYLLENMVLD<br>YFENNKPSEEYIEFSIRAIFDYIANAVYCPVNDPKGIQGNLNNLDFDKMKSISERAKLDS<br>LRLHNADQYEFSNPDKAINELKAIFGSDFVG |
| NTase025 | 76 | MATTVISAFNEFLKESVNLDSNKTITARSSRDWLISKINNFDNNQSFPYIYQDIHINFGS<br>FARRTKIRPLDDIDIMIGIKSDYCTYYENNEDIKILIDSNTARLNNYTHDNTTYVNSRKI<br>INLFVSELSKIEQYSSSEINRRQEAATLKLKSYDWNFDIVPCFITVPDIYDRTFYLIPDG<br>NGHWKKTDPRIDKNRTTDINVKHDGNMLNVIRIVKYWQKRKTMPTMSSYLLETILLNYYD<br>NKSYCSPYVDIELEGVFRHISDVIYNTVNDHKNIQGDINNLPWDDRVKISNKALSDAEKV<br>NLARDLEEKYDYQKSINVWREIFGDAFPQYG |
| NTase026 | 78 | MATTVNNAFKEFMRDKVNLDPDKTKTARKSRDNLIDNIHSLGSNEDFFNLYHDIDIAFGS<br>FARKTKIRPLDDIDIMIGINGDGSTYYDSGYEVKIYVNDDNSPQKSCCNDNTNILNSTKV<br>INKFIKELKNLNDYKKAETHKNGAAATLQLKSYEWNFDIVPCFRTTKESDGRDYYLIPDG<br>KGNWQKTDPRKDRDKVTTLNQKHNGLMLETIRLVKYWNRRPTMPLMPSYALECLLLQYFD<br>SVDSVSDYIDLRFRDVLYYIKDNIWYSINDPKEIQGDLNTLTYDEKLKISNKAESDYEKA<br>KEAISAEIDDKDHEKAIKKWAEIFGSEFPEYSED |
| NTase027 | 81 | MATTVIAAFNEFMKDTVNLKKADTDDARASRDWLIGKMNDFEKDDKFPVSFPAIHIAFGS<br>FARRTKIRPLDDIDLMFGLTGQGATYTILSDRITVTSSGEGSRLHSYRHSGADTVCSVRI<br>LNAFKNRLQDIAQYAQADIRRNQEAVTLKLVSKDWNFDIVPCFITSEDAFGRTYYLIPDG |

TABLE 1-continued

Representative CD-NTase amino acid sequences

| CD-NTase Name | SEQ ID NO: | Amino Acid Sequence |
|---|---|---|
| | | NGHWKFTDPRKDRDRVTTINVQNNGNVLNVIRAVKYWQRRPTMPSMSSYLLETLILDYYA<br>GRTSCSSFVDMELEALFRHLGQSVRYSVNDPKGIQGDINSLSAEARKAISDRCYLDAQKV<br>SEARWFENNKEYEKSINKWRDVFGPFFPVYG |
| NTase028 | 84 | MTMTVNAAFNEFMRDTVNLLKADTDDARASRDWLIGKVNDFEKDGTFPVNHPGIHIAFGS<br>FARRTKIRPLDDIDLMFGLSAESATHTIYSGHITLNSSGENSRLHQYRHPGENTICSVRI<br>LNAFKNRLQGISQYAQAEIRRNQEAVTLNLSSKDWNFDIVPCFISTADAFGKNYYLIPDG<br>KGHWKKTDPRIDRNRVTDINVKNDGNVLNVIRAVKYWQRRPTMPAMSSYLLETMILDYYA<br>NKTDCSEFIDIELRALFNHLGLFVRYSVNDPKGIQGDTNTLSMEDRQKISDRCYLDAQRA<br>AEARQFERDNDHEKSINRWRDVFGPQFPAYG |
| NTase029 | 87 | MNVSNTFQEFLQNLAIDNKEEISNRYKEITKVLNIKYRNTESKISNSLQVGSYGRFTAIK<br>GISDLDMIYILPRTEYKRFKDHGQSALLQEVKKTIQSRYPKTDMRRDGQVVVISFTNYQI<br>EVLPAFECKNGSFLYPDTNDGGSWKNTNPRLEIKAISDLHEKNKNLRNLCKMIRSWKNYH<br>SVAMGGLLIDSLAYNFLNSTTYYNDKSFAHYDQLIKDFFKYLSDLQNTNYVFAPGSYQKV<br>YIKSKFQTKAKKAHKLVLEAIEAQKNKNANQKWKKIFGRGFPSAVQLATEAMNESISAWT<br>NTEEFIEDKYNVDIRYDLSIDCEVTQIGFRTDKLSNILAKNIRLLPNKELKFQIIHNDTK<br>GDFEIYWKVLNRGDEAQKRNMIRGQIVKGTKIKKETTNFRGDHIVECYIVQNNTVVAKDR<br>IHVPISEGIYS |
| NTase030 | 90 | MSISDKFSTLIDNLKITNGDTISSRYKAITKRLNTDFWNSSSEISHSRYVGSVGRGTAIR<br>GVSDVDMVMELPSDVYWQHDAYKSNGQSALLQAVKESIKKTYPNTHNVGDGQVVVVSFTD<br>GIKFEVIPVFLNREGTYTYPDANNGGGWKVTDPVAEINAINDANNTYNQKVKHLAKMARA<br>WKEKCNVPVPGILIDTLVFNFMKKWEYNDKSFLYYDFMTRDFLKYLSEQNPSQGYWLAPG<br>SNRRVYGKGKFESKAKSSYNDALRAIEYENAKKEYSANQEWRKIFGNYFPS |
| NTase031 | 93 | MSTSDLFSSFIENLAISNMESISSRYGEITAALNKEFRNTDSKIANTLQVGSFGRKTGIN<br>GISDLDILYFMPKGKWDTYKDSKQLSLLQDVKSAILKRYPKTEVRVDRLVVTITYTDFHI<br>EVQPVFEQDDGSFKYPDTKDGGNWKITKPREEMEAVSKLDADKNSNLKRLCKMARAWKNK<br>HGVEMGGLLIDTFAYNFLSSTDNYDTKSFNSYGELNRDFFQFLSEQPEQDYYRAPGSNQN<br>VRVKKQFQKKAKKAYDLCVKAIEAKDESGVNDKWKKVFGRPFPSNIESTSDSVQKTASTL<br>WTNTEQFIEDQYPIDIRYDMSIDCNVNQDGFRESTLRQMIEKKYPLQPKKTLEFRITSIN<br>VPGSYEIYWKVLNRGEEARKRNQIRGQIIKDSGNYEKVEQTLFKGDHVVECYAIKNGILV<br>AKDRTHYPISLNG |
| NTase032 | 96 | MSHRELFSEFLENLNLDLKQAKKISYHYRKITKSLNLAFRGTSSRVANRLKVGSVGRHTA<br>IKGISDLDMLYIMPPNQYEYYNRKDNGQSALLTDVRNILAEEYPDQTVKKDRLVVQIIFK<br>NFYVSVQPVFRQDDDSFKFPESYNGGAWRITKPLHEKAAMTAFSRDKSNNLRKLCKMTRA<br>WKNLHGVNMGGLLIDTLAYRFLSSTSDYDNTGNGSLGALARDFFEYLSNEERKERYLALG<br>SNQHVRVKSPWFGRAAKHAYELCCDALDAEGAASENDRWRKVFGRAFPRRKVGIMEARLG<br>LESHAADAVPWTDTEEFIEDKYPVDIRYSLHLDCTVTQDGFPPRSLREMLTRRFRLSARK<br>SLLFRADLTEMEAEEPYTVMWKVLNVGDEARRRNMIRGQIVSDGGYCTKKETTDFRGDKM<br>VECYVIKNEVVVARAQTEVPIS |
| NTase033 | 99 | MADITKSINQFITEEIKLVQDDISSAVSSRKWFLNKIETAIQNRENEPVLYTPKIFNFGS<br>YFKGTKVTNVDEFDVLVVIDSSPGIFKEGETVIGTGVGSANPNPIYNEKYKKSDGSGVSP<br>SKLLNWLKGITEEVVKGFNGQAPERDGQAITATIKSKNLKIDLVPALKFEKDDGTGFYAI<br>PKGDKGNGWIKTQPKDDMDALEDAAKEKDGFRNVIRLLKFIRGEYNFKVSSFAIESAVVN<br>YSETGLWENDLYIDLKGCLGYLAQNFRDGEIKSTVDKSANLISGVESLASYATKIDKIIT<br>ALGNLSSEQDQKVANEEVSKIFKNE |
| NTase034 | 101 | MLRFGEGELGLADITKSINQFITDEIKLFQKDITSAVKSREWFLSRIESAVQKRTNELTL<br>YKTPFVYFGSYFKKTKVTNVDEFDVLVVIDSNDGQFSQGGEVIGKGLGSASPNHKYDKKY<br>KKSDDEGVSPSKLLNWLKGIAEEVVEGFHGQAPERDGQAITATIKSKDLKIDLVPAGIFE<br>EDDGTVFYIIPKGDKENGWIRTQPKDDMKELEDAANEKTQFRNIIRLVKFIRGKYKFKVS<br>SFAIESAVVNYSKTTTWRNDLYTDLKGFLSYLAQNFRTGEIKSTIDENANLISEVESLVY<br>YASRIDKIITTLGDLEGELDQKVVNEAVSKLFKNE |
| NTase035 | 103 | MSVNSYLENLSHELIIRDNEKENIKKSIEVIKSRLKSYFGNNIVETFCFGSYTRGTMLPR<br>KVNENSDVDYMVVFSNSFLYAPQTLLNKLRDFVRTYYSKSEIYQSNPTIVLELNHIKFEL<br>VPAYSNNMYLWQENHYRIPAKASNYNDWIDTCPDDINSRLTRLNVESNNKLKPAIRIIKY<br>WNSLNNNVYSSYELESAILENMHCYWRTSIQDYFTAITESLIYNFGTPSWKVDKISSLKK<br>WYNHALKEEYIWRNYIQSNLYMENILPSIK |
| NTase036 | 106 | MSVQSHIDNLASKLNLKQDEKDKIEKSIATLSDRLNRYFDGELTDHFKFGSYTRGTILPR<br>KADEYSDVDYMVIFKNPNNYKPQTLLNYLKSFVNYYYHSSEIYQSHPTIVLELNHIKFEL<br>VPAKKDIWGNIYIPSPSSSFEEWMKTDPNAFNKKLTDANVKYFYKIKPLVRLMKYWNRLN<br>GSYLSSYELENWIVENYYWNCNNLKDFVYSTFEKLSYNYSDPQGYKDKVDRAKKIIAQTK<br>EYERNNMPYSAEAEIKKLFPDF |

TABLE 1-continued

Representative CD-NTase amino acid sequences

| CD-NTase Name | SEQ ID NO: | Amino Acid Sequence |
|---|---|---|
| NTase037 | 109 | MGSERIMTTQQQFLDLLSDIEPSTTTVNDCSSAHNTLRDALKVHNEFSKVHVHTFLSGSY<br>KRNTAVRPTTIGGITQRPDVDIIALTNHTINDDPQIVLDAVHTALKDIGYTDLTVNRRSV<br>NVKLKKVDMDVVPIISDGYGGYLIPDIHLEEWLVTNPPAHTEWTVEVNKNANGRFKPLVK<br>LFKWWRRENLSDLKRPKGFILECLVAKHMNYYESNYEKLFVYLLETIRDSYGIYASLGII<br>PHLEDPGVAGNNVFSAVTADEFKTFFEKVEEQAAIARNALNETDDDKALALWRQVLGNRF<br>PRSASHKSANSADMASSLIRSALGAGLTFPSTPVYPNKPGGFA |
| NTase038 aka Ec-CdnD02 | 112 | MELQPQFNEFLANIRPTDTQKEDWKSGARTLRERLKNFEPLKEIVVSTFLQGSIRRSTAI<br>RPLGDKRPDVDIVVVTNLDHTRMSPTDAMDLFIPFLEKYYPGKWETQGRSFGITLSYVEL<br>DLVITAIPESGAEKSHLEQLYKSESVLTVNSLEEQTDWRLNKSWTPNTGWLSESNSAQVE<br>DAPASEWKAHPLVLPDREKNEWGRTHPLAQIRWTAEKNRLCNGHYINLVRAVKWWRQQNS<br>EDLPKYPKGYPLEHLIGNALDNGTTSMAQGLVQLMDTFLSRWAAIYNQKSKPWLSDHGVA<br>EHDVMARLTAEDFCSFYEGIASAAEIARNALASEEPQESAQLWRQLFGSKFPLPGPQGGD<br>RNGGFTTPSKPAEPQKTGRFA |
| NTase039 | 115 | MSNFPSLRRDDRPDDPFADPLDAVLAELAINIQLPPGLHAKAVERYEAVRRYIERPGSPL<br>EGRVACFYPQGSMAIDATTSTRGTDDEYDLDIVAEIEGPDLGPEALLDDLEAALESYPVS<br>KVVRQTRCITLYYADGMHLDITPSRRRAPKEKEGEIPHAKKGTRSDPARYVPMNSYAFGK<br>WYCARTPTEERFALALNRQLYEQAGIAFAAADVEDVPPQTPLIIKSVTTVALQLIKRHRN<br>IAYATETGRIPPSVMLSCHAGHAARPGMRLAEMLIRQARWTARAIDDAAKRGQLLVVPNP<br>EFPVERFTDRWPESQLQQTTYSRHLHTLANGLEAARTGDVQLEDLQEWLRGQFGDRVVTR<br>SVKAFNQRLGRQVQSRQHGYTRSGGLFVPAAPAIIGAATSLAPVAARAHTNMGERR |
| NTase040 | 118 | MTTFAYQGKNPFEDPLDRILAEIAFSVQLPPFLHGKACQRYKAVREYLEGTTSFHDQIEH<br>FYVQGSMAIDATISTRGTDDEYDIDIVAQLGSQYRHMTPLGILKALAAALKDYPVQKIVQ<br>QTRCITLFYADNMHLDVTPALRDYGTTDRQSAITHAKGPLPSNDDCMVPMNAYGHAEWYM<br>ASTPNEERVIEAFKDRWSGDDRMRIRADADVDEVPDQTQFVVKNMATVALQLLKRYRNVR<br>YANYSGRIPPSVMLSYFAGAAALPDMNLSDILIRICRWIIGEIERATINRQKLHVVNPTY<br>SADVFTDRWPENLDQQNQFARYLHDLVAGIERAKRGELDPVKLRNWLREMFGDRVVTRAA<br>DRMADATGAGIVAGSQVYSKKGSILLPAAATIVTSVAPVVAKPHTFFGDPVDE |
| NTase041 | 121 | MNSKRTLAKAFMEKVAADQEARQWEELMVQLLSKLELSEEERGRASGHYDTLAKQVARKL<br>GVGETDVHIVVQGSMRTQTTVAPRGREKFDLDIVVKMDGDRFIGIDPDEFFKEFGDSLRG<br>LNNAAGDPKPKPRCWRLQYPNEPFYFDVTPALPGSFDITGTDLRVRDPDTGWSPSNPEDF<br>ADWFCEAAEQKFQFQMLLKVAMDARHQIEDVPSDPVAIDDILRRTVQLIKLHRDLMYHGA<br>SDGVKEGKPISVILVTLATWAYNDVYQDRHLYSNAIEVLLDVVERMPEYIEFDDGVYTVR<br>NPKHPDENFAERWNGDDGVRASAFYRWHEKLQSDLTALFSDSYSRSTEERIRKIFGQHGV<br>DAWKASIAPATSGLLNSLMKSVPGGERRDPVTPVPPGSRKDTLA |
| NTase042 | 124 | MSNEQTKHRSWEYFLLRAARKISLSAAQYSVIDARYSQLEKILSAADDPLLADAHIFPQG<br>SMRLQTTINPVPGAPADLGTIDADAIVWLPHARGIDARTVLEVIERRFQEGSRVQEDIQQ<br>LRRGVRIVYADENPGFHIDVTPARPCHHNEQSDGLGMLEVPDREHGWKASSPIPYADWLH<br>DASKQDIMLEHVVEFNKSRAAMDSATQAPLPEYKEYQKDDPLRASIKLMKRHRDEWAIRT<br>KNEGYRPISAVITTLATHAYLDVVAQSEYTAFTPLQAILAIVNRMPDHIHRYSNEYYVCN<br>PEDNGENFAEKWNRPDEGYKYVDAFNKWHASARSALTLGLDSHASTETFAKAVQEQFGIG<br>PTFVREVNESIPANWTMPGRQDGVTRNSVSMGSLFGSSVSSNQSQANVAPVGRLG |
| NTase043 | 127 | MNMLNIPSKVDSWEYLLLRAAQNISLSESKYTQIMERYNQLEKILTASNNPLLAEAHIFP<br>QGSMRLRTTIKPVLGAPADLGTVDADAIIWLPNAQGVEASVILEAIEERFKEGARVQKDI<br>QPLRRGIRIVYADVDPGFHIDVTPARAIDGNDEEKGEGKLEVPDRVTGWKASSPIPYANW<br>LKYVSYQKIELAMESYDLVRKHQTFDAATQEELPAYSDYSDMNPLIATIKLLKRHRDEWA<br>IRTGCKDWRPISAVITTLATHAYSDVVKMSASNPLRPLDAILAIVRKMPDYIQYLGGQFF<br>VCNPEDAAENFAEKWNRVGEGYKYKEAFFQWHTNAMASVSIGLEDFSSYESFEAVIKEKF<br>GLSGSFISQVNREIPPDWTQPGRVEGTTRNAAAIGILFGGESNSENIQNTVKPVGRLG |
| NTase044 | 130 | MSMSNEQTKRGSWEHFLLPAAREISLSEAQYEKINDRYSQLEQILNASDNPLLAEAHIFV<br>QGSMRLKTTIKPVSGAPEDLDTIDADAIIWLPHAQGAGAQEVLDAIEERFKAGSRVQEEI<br>KQLRRGIRIIYADENPGFHIDVTPARAINGNSQGNGEGKLEVPDRVTGWKASSPIPYSNW<br>LQVASKQTISLEHLAVAKSQRAFDAATQDPLPQYEDYLDQDPLRATIKLLKRHRDEWAIR<br>TKNADHRPISAVITTLATHAYLEVAKESQTAPLKPLDAILEIVRRMPDHVKRQGNECLVC<br>NPADNGENFAEKWNRPLDGHRYRRAFEEWHENASASVSLGLESFESAEAFAKAVKENFGM<br>GPTFISTVNSEIPSNWTMPGRPDGTTRNSTSMGALFGGFSGTASSQEDVKPVGRLG |
| NTase045 | 133 | MQTPQRRSTFSHRAATQFFHLADTIARSHEPTSTQLLALESSYISTAEYLAESDEFAGLT<br>TNIHGHGSRALGTLLRPSDESREGFDIDLVARLDQRAMLRYGGDGGPGLLLNHLHAVLSR<br>YASAHGLKIKRWERCVTLEYASGMFADITPVVDDPLSWAPYGDTHGRVPDRQLRTYEPTN<br>PRGLTRSFARAASIVPVFTAVEHLTFAADSVRKSISPLPKADEVFERLLSRLVQLLKLHR<br>NVAFGKATGHEDFAPSSVFITTLAAAAYVDLAPKPHSTPLDLLLDIVEAMPRYFTRERDF<br>GGREVWYLQNPSSPYDNLASSMNMRERQGAFDEWHARICRDLRRLVDMIEANAGLDAVVR<br>IVLAVFGERARAEILKDDRARREAGRKAGRYAIMGGSAAPSSVIAKSKPHTFYGD |
| NTase046 | 136 | MQNLFSKNNLLDDLLQRIGTKLQIGKTQRKLAEDRYNAVGIWLSKDDDFFNNAKIEIYPQ<br>GSLSIGTTVKPLSKQEYDLDLVCQINENWQGKDPLQLLNSIEKRLRENEIYDKMIERKNR<br>CIRLNYANEFHMDILPAHPLDHSTSTNVKVPDRKAKNWKDSNPKGFSQWFNEQALQYNTK<br>LFEIRAGIEPLPSEDNVERKPPLKRAVQLIKRYRDIYFEKDPDSAPISIVLTTLACNFYS |

TABLE 1-continued

Representative CD-NTase amino acid sequences

| CD-NTase Name | SEQ ID NO: | Amino Acid Sequence |
|---|---|---|
| | | EQISVNESISHILNSILLNLPKNGKRLKVTNPTNQNEDLSERWIGHPELYQKFVEFIRVF<br>NKKWQGLQKKTGISEINEELKFMFGEKVATESLKDQTKLISDMRENEKLAVTHTGSFVAA<br>ASNKKPTTIKRNTFYGI |
| NTase047 | 139 | MYGSATARSLPAGKKQRIADLLSQIIETLDLTKTQYANIKSAYNGVGTFLSEGDDPLLQD<br>AVIYPQGSVRLNTTVKPKNEEQYDIDLICYLPHATQADYTGVISAIRRRLESHNTYKDLL<br>SDLPRGFRINYAGDYHLDITPGREHTGAQHPGQPLWVVDAHTAWKESNPSGYAEWFDSSA<br>SVQPLRTILVMDSASRVGTEALLPLPDSTDKKLLNRIVQILKRHRDEWAAEQDDVRQRCR<br>PISVIITTLACHAYNHIIADRRSYDNDLDILLDVLELMPDFIVSIQGEIQVSNPHMPEEN<br>FAEKWNRSEQDEGPQRSETFYQWHAAAQATFNTIAASVGEDNLFLSLEDGFGKKPVDVVR<br>QRLMEHMQSAREQGSLQLDKKTGGLIATGLASTAAQAGVPKNTFYGE |
| NTase048 | 142 | MRQSQLVDLIEEACQHLEPSAHQRDLAKQRYEGVGEWLAAADDWLLTSIAIRLQGSVAIG<br>TTVKPIGKNEHDVDLVAHVADLDLTVSPALLKQRIGDRLRSNGHYAPLLVEMPRCWRLDY<br>ANEFHLDITPSIPNPECRFCGELVPDKTLKTWKASNPQGYRAKFERRAALLPRIRSVFGK<br>AFDSAHANAQVEPYPEEKRLKGILRRIVQIAKRHRDIHFIDDDQGLAPLSIIITTLASRA<br>YETCVSNFEYDHELDLIVDVLRRMPQMLQTSMTEGRVMWCLWNQTTAGENFCEKWNRKPE<br>RATAFFEWHSKVVADVEHLAAARGLDQVRRGLGDIFGTAPANKVMDTLTERVDIARRTNR<br>LLATRSAGLIMSTAASATPVRANTFFGDGP |
| NTase049 | 145 | MNQMFTAPPQTHLLLRKAEVYSLLDQICQALELTAAQLEAARTSYEAVAEWLSGSDNPLL<br>KWIDIYAHGSTGLGTTVKPIGREDFDVDLICKVLRFTADRPPAELKRIVGDRLKENARYA<br>AMLEEKKRCWRLNYAREYHLDISPTINNAKCANGGELVPDKKLREFKPTNPKGYKALFER<br>RAALIPTLRMQKALAAEDRAAVEPFPVHGTAKGILRRTVQILKRHRDVHFLEVVEEIAPI<br>SIIITTLAAQSYEYCVKSFVFDSELDVLIATIRLMPHFIDKPVVNGRRIYVVANETTVGE<br>NFAEPWNTEPARAAAFYEWHAKALADFEALPDLQGIDVIGKSLEGSLGSSVVRKVIDART<br>DSISQARTAKKLYVAPTVGLTLSSAANATPVRSNTFFGD |
| NTase050 | 148 | MDTMEQMLSMLLSGAVETLDIPPHLQALAIASYEEVGNWLAEHGEHRCRVYPQGSFRLGT<br>VVRPHSLTGDFDIDLVFLMLLAKEATTQARLKQDVGDLLHSYLDWKERNGHPGGLKTCES<br>RRRCWTLDDPVNGFHLDVLPAIPDLEYLPTGILLTDKELFHWQHSDPIGYANWFRRRSQE<br>LQNKVITAAAQRGVDVEDVPIWEFRTTLQRVVQVLKWHCMLYFADDPDNRPPSILITTLA<br>AKAYRGETDLFTATRNALAGMNRYIEDRNGVNWVANPAHEEENFVDKWKEYPERRKAYYA<br>WQRDLADTLDDALSLRGKGLQTVASQLAQSFGAEPIRQSTLKYGQRMRGHTTNRSLRLGT<br>TGLLAPSATGIAVPPHNFYGQHPDPSH |
| NTase051 | 151 | MENIIIGKEIKELIEELDVSDSEYEEATKRYNSIAEYIKNSELDSEKPDIYLQGSFKLGT<br>AIRPLTEDGAYDIDIVCNFTKLKKEDQSQSSLKYELGKVVKQYAKSKSMSNDPKESKRCW<br>TLKYVDDNNFHIDILPSVPLHNKDDEYIAITDKAKDNYFEISSNWETSNPKGYADWFREV<br>SKYTVYQEKIAKRFYASIEKVPEYKVRTPLQRIVQILKRHAETGFEDDIEFKPGSVIITT<br>LAAKQYRLASSIHNDFWDVISYIINHLKDGIELRNGKPCVYNPVNYSEVLSGKWDKDKRY<br>VEAFNNWLKQLESDFNIGNDEITYPNRIQYLKRSLFKNARSQFPIINVTSLRHHQKSKWT<br>ECLVKDVFVKAMYSQNGFRWKTIRSGTALNKHGDLKFEVKANDLKQYEIWWQITNTGKEA<br>ENANSLRGDFYSSELIEGKKIKKESTLYTGRHFVEAYLVKDGICFGKSQPFEVNIVDNFT<br>LDFAR |
| NTase052 | 154 | MPTKNAEDFLTALAEELAISDSRYEQACRSYTSLGEWLHRPESAVAKYDPQVYVQGSFRL<br>GTAIRPLNDAEEYDVDSVCLLQSLGTKDLTQYNLKTLVGDEIKAYRKAQNMVKPVREGRR<br>CWVLDYADGAQFHMDVVPSLPNATQQRILLETYGYDLKWSETAMVITDIESPVYQVLSDN<br>WQRSNPKGYAEWFKMRMRDVFEQRRKMLAESIKASVEEIPDYKVRTPLQSAIMILKRHRD<br>GMFEKRYDERPISIIITTLAAHAYNGEVKIADALYSILSRMDSFIERDGGRYIIRNPSDP<br>LENFADKWPNKPERKDAFYEWLDQARQDFGNLAHQIEKRRLVESVRPHMGAVADRAATRL<br>SPTPGSMLQPATGVAALGVVAASTPAFPNTRREPTSPKGFA |
| NTase053 | 157 | MSNTKSNDVLNTILEKIELPDSAYEKAEKRYKDLGDWLHRPESTCVNFDPHVFSQGSFRL<br>GTAIRPDSEEQYDLDMGCNLRRGLDKTSITQKQLKHLVGHELELYRNARGIKEELAEKKR<br>CWRLEYADGLSFHMDIVPCVPESDTGRGLLKKLMVENSKFDENLAQNVSQLAVSITDNTD<br>FTYAVVNENWRISNPEGYARWFETRMKTARLVINEREMRFKASIDSLPYYQWKTPLQQVI<br>QLLKRHRDTMFKNNEDSKPISVIITTLAAKSYKGESDLASALNTVLSEMDDHISAQAPMI<br>PNPVNPAEDFADKWYDEKSAQYRLQENFYKWLYQARADFSALCSSDDTQRIVNAAQNGLD<br>LKLDSSSVARLLGIPAVTAKPTFAIQSSDPKPWFKQ |
| NTase054 | 160 | MQDQGFKSLRQLSASDKEFCFEMISHITSNLDLTETQLSQLKTAYRAIGSYLANQGGELA<br>ECHIYAQGSVGIGTSVKPIDEDSDMDIDLVLHLPSQHYPTTTDEANELLFNLIRVLKDSQ<br>RYGDKIENMPKRRCVTLQYGGIEGQGFHMDITPSMPEDMDSPNHKSKVRVADIKDANSPS<br>HPYGYRKWFRSACSKEIRWNRKSNYRSNNDIYAGTVEPLPGQGRKTVLQIVVQLLKRHRD<br>MWKQNKQNVYGDCAPISIIITTLAGLAYEKCSNSNKEYYNPFDLMLDVLEEMPNFISHQY<br>QSNGTVKYTIRNPALPTENFADKWHEKPMLPQAFKAWYTQVTEDLAKLLELDQGLDKTIE<br>RSREMFGSAARGIQAKLADTLTERRAKNRAVVSSIGLGVSNAATATPVPKHNFYGDV |
| NTase055 | 163 | MSISEAQLETWSHQGAIRGSSLTYQAIKSTLENADSPYAGKNIEVFLQGSYGNATNIYAE<br>SDVDVVILLKDCFQQDLKALSEEQKTAWRAAYHDAVYAHRDFKKDVVSVLRDAYGGDVTV<br>GDKAIAIAARGVRRKADVIAAIGYRRYYRFNGLRDQSYDEGICFYDAAGTRIANYPKQHA<br>ENLTAQHQATQQRLKPMVRIWKNLRSALVEAAAIEAGAAPSYYLEGLLYNVPVDKFVGSY<br>GDTFVNVYNWLVTEADKTQLVCANRQYYLLRDNAPTCWAPAQCEAFLAATLAYWDDWGA |

TABLE 1-continued

Representative CD-NTase amino acid sequences

| CD-NTase Name | SEQ ID NO: | Amino Acid Sequence |
|---|---|---|
| NTase056 aka CdnE | 166 | MGIPESQLDTWSHQGSIAQSASTYSIIKNALESANTKYHGKNFKVFLQGSYGNDTNIYAE<br>SDVDVVICLDDVYYSDLTQLSPEDKDAYDRAFVPATYSYTQFKQDVLEALTERFGSDVKV<br>GDKAIVVAANGSRRKADVIASMQFRRYWKFKGHYDSQYDEGICFFNGAGERIANYPKQHS<br>ENLTLKHQASNKWLKPMVRVLKNLRSKLIADGKLKSGLAPSYYLEGLLYNVPNEKFGTSY<br>ADCFVNAMNWIQTEADKDKLVCANEQYYLLWEGTHTSWEKADAEAFIDAAIKMWNEW |
| NTase057 aka Lp-CdnE02 | 168 | MSIDWEQTFRKWSKPSSETESTKAENAERMIKAAINSSQILSTKDISVFPQGSYRNNTNV<br>REDSDVDICVCLNTLVLSDYSLVPGMNDKLAELRTASYTYKQFKSDLETALKNKFGTLGV<br>SRGDKAFDVHANSYRVDADVVPAIQGRLYYDKNHNAFIRGTCIKPDSGGTIYNWPEQNYS<br>NGVNKNKSTGNRFKLIVRAIKRLRNHLAEKGYNTAKPIPSYLMECLVYIVPDQYFTGDSY<br>KTNVENCINYLYNQIDSSDWTEINEIKYLFGSHQMWNKTQVKEFLLTAWSYIQKN |
| NTase058 | 171 | MKFSEEKLRLFAAPLSETEDQKCKNAIGMVRDALKDIGFTDDGKTIEKLYADTYSYSLEM<br>RNATKNRKVKLFVKGSYANNTNVRTESDVDTAVVLESTFKVKYRPNINDAKYGFSNSTDN<br>VMTFKDDVEDALRKKFGSDVERKNKSIKIHGNTYRVDADAVPCMRHRDYSNDYNSDPNNF<br>IGGIFIRSDDGQTIINYPEQHIRNGREKNNQTNTYYKKMVRIIKKMRYIMQDENYESANN<br>VSSFGLESLLWNLPNGVFTKYTIYRYAFGEITEYLWNNSHMLPFYKEANGIKPLCESAID<br>VEKYTRFIKDLYNFYEYDI |
| NTase059 | 174 | MLFTEEQLKLYSKPLSESEKEKCENAIRIIQESLESLGYEIKKGIHRNNEDTLSYQIKMT<br>NSSKDYELSIFVKGSYATNTNVRQNSDVDIAVVKESEFFDKYREGKTRENYKFISSNKPP<br>YYFKDEVEEALIEKFGRSEVRRGNKAIRINGNTYRKETDCVPCFRYRDYSNDYMDDPNNF<br>IGGITIYSDKGERIINYPEQHINNSVIKNNNTNYKYKKMVRIIKEIRYQLIDSKNRNAEQ<br>TSSFGVEGLFWNIPDYKYSNDEMLGDTFNALIAFLIDNIDKLSEFKEPNDR |
| NTase060 | 177 | MYETKTTASDWDKTLITLSKGPSESESQKCENTENAIRKAITSNAKLSQMDISIFAQGSY<br>KARTNVRAESDVDIAVLLNTVAYNDYPVGLTAENFGFTPAKIEFIDFKNLVKQAMEEYFG<br>YFNIDRSGKKSIKVHSNTYRVDADVVPMFCHNHFLSANPDDCLRGVAFSTNEGMIIKNWP<br>QQNYENGIQKNTATKRKYKRLIRILKRLKAYMIQEGIQEANIPSYLIECLVWNVPNVEFF<br>HDSLYQNLRQILFYLWDKTRTNETCSNWGEVNELKYLFSTSQPWTFQQAHNFILATWKYI<br>GYK |
| NTase061 | 180 | MSRDWESVFATWSQGPSATEQERAQNAERQIRQAIQASDKLKNRNIKVFTQGSYRNRVNV<br>RRDSDVDIGVLCFDTYFPEYPDDNVKMELAKNSVPATYEYATFKSELEEALVARFGRDAV<br>TRGSKAFDIKANTYRVESDVAAFFEHRRYVTATYYHSGVEMIPDDYDPPRVKNWPEQHYE<br>NGVSKNTYSLRRYKRVVRVLKTLSNEMASKGIQSAKDAPSFLIESLVFNASNSCFEYQSF<br>KPMVRHILAELFNNTMSHEKCSEWGEVNELKYLFRSSQPWTRESAHQFLSDAWDYIGYE |
| NTase062 | 183 | MSNSFSARIERMKSRRKGTFDQLNVARESISNQRIDGLENYALLEGFLDLNESWETRGKQ<br>DSATRYVIGAMQPVDNRYTEISFETAKRIENQLVKKLDLNLEFRVQGSVPLDIHIKSFSD<br>VDLLIIDTQMLIYDSDGIGRYTPTNKNDGDVILELRDAARDALKATFPAADVDDNNAKSL<br>RITGGSLQREVDVVPSIWWDTKEYQHTKDVDQRGVTIIDKNTRQRIYNLPFLHIKRIKDK<br>CDQCNGGLRKSIRFLKTLKADSEAEGTKIELSSYDIASLMYHADGNNLRHSQYYELAVLV<br>ETHRWLNYLAQNPNAAMLLYVPNGTRKIIDKNETFAELLKLTGMVNSIVTEVLREITGQP<br>TEYYTPAKGILLIKQAVY |
| NTase063 | 186 | MNTPINERINRLRSRRSGLDRSSVIAMDAKDFIVNRSLTKEAWEHRVKDKPNTTFALGAM<br>QEVDPTYTRISIETAERVSNQLSKRTSGNLEFELQGSVPLNVHIRGVSDVDLLAIEADFH<br>TYDARGYMSTSGQYRSPTSRTSVGVLTARRGEIGRALRDAFPAATIDTSGSKAIKLQGGS<br>LARPVDVVPSHWHDTITYQASGQKHDRAVTILDSHKSTTIENWPFLHIKKYRERCETTGG<br>GLRKSIRLCKNIKAELEAEGKPVTISSFDIASIMYHANMHSLSAGAYYELAILAETQRYL<br>DYLWNNKEEARRLVVPDGSRFIFNTEDKFNGLLHLSVAMDSLLREAAKEQNYLLSLSDKP<br>LLDASRIAVTNAIIF |
| NTase064 | 189 | MSILVTNSYVTPLEARQTIARRYRIVTKAINVEFWNSISETAHSFYVGSYGRGTAISTSD<br>IDILVEIPNSEYDKFNSSTGNGQSRLLQSIRKSLQVAYPQSDIRADGQVVKINFHDGIKF<br>EILPAFQNIDYWGKNQGYIYPDSNMGGNWKATNPKNEQEAMKIKNGPTYSNGLLYATCRH<br>FRYVRDTYFSSYHLSGIVIDSFVYNAMGNWRYTESGSSSNASMGAYENILLEYFNNNTIW<br>GLSLNSPGSNQTVSTTNSITCLEKVIKKIAT |
| NTase065 | 192 | MSTATDFKTLLDNIKIDNAGQISKRYGRITKALNQYFYNLDSKTANSLQVGSYGRFTGIR<br>GISDLDMLYFLPATAWPRFRDPQSYLLQVVKTEIKKTFKNTDIRGDGQVVVVKFKNQEVE<br>VVPVFSNEDGTFTYPDTHDGGSWKVCNPRAEMSSFRALNDDRKGHLRRLSKMIRAWKARH<br>EVEISGFLIDTLCYNFFSNLTEYDDKSFKSYDQLSLDFFTFLENEGDRVFYYAPGSRSKV<br>SVKKSFNKVAKLTKEYCEEALSATSENSRNLAWKKVFGRPFPNYTTKALSNVNVSEQFIE<br>DQYEMNLYGHVSIECEIRKNNLLEALLSNLLGEGHDISTNRKLRFYVDEINNISHPYKIK<br>WKIKNVGDEAERRGNVRGEILDDEGGSERFETADFSGPHFVECYVIYGNQVVARDRIDVP<br>IHN |
| NTase066 | 195 | MGLLVPRANTYTIPLTKRQLIAKRYQRITRAINREFWNSESDTAHSLYVGSYGRGTAIST<br>SDIDIIVELPMAEFDRFKNYLSNGPSKLLQVIKNAFQEILPNSDIRADGQVVKINFHDGI<br>KFEIVPAFNEKDYWGESKGFIYPDSNMGGNWKATNPKKEQEAMKLKNTKSNNLLYATCKH<br>FRHVRDTEFTSYHLSGIVIDSFVYEAMGNWKFVENNSGGQNISSVSYETALLEYYNSHKV<br>MGGLNLYSPGSNQFVNSDSSIICLEKVLKKIAL |

TABLE 1-continued

| Representative CD-NTase amino acid sequences | | |
|---|---|---|
| CD-NTase Name | SEQ ID NO: | Amino Acid Sequence |
| Rm-CdnE | 198 | MPVPESQLERWSHQGATTTAKKTHESIRAALDRYKWPKGKPEVYLQGSYKNSTNIRGDSD<br>VDVVVQLNSVFMNNLTAEQKRRFGFVKSDYTWNDFYSDVERALTDYYGASKVRRGRKTLK<br>VETTYLPADVVVCIQYRKYPPNRKSEDDYIEGMTFYVPSEDRWVVNYPKLHYENGAAKNQ<br>QTNEWYKPTIRMFKNARTYLIEQGAPQDLAPSYFLECLLYNVPDSKFGGTFKDTFCSVIN<br>WLKRADLSKFRCQNGQDDLFGEFPEQWSEEKARRFLRYMDDLWTGWGQ |
| Em-CdnE | 201 | MNFSEQQLINWSRPVSTTEDLKCQNAITQITAALRAKFGNRVTIFLQGSYRNNTNVRQNS<br>DVDIVMRYDDAFYPDLQRLSESDKAIYNAQRTYSGYNFDELKADTEEALRNVFTTSVERK<br>NKCIQVNGNSNRITADVIPCFVLKRFSTLQSVEAEGIKFYSDDNKEIISFPEQHYSNGTE<br>KTNQTYRLYKRMVRILKVVNYRLIDDGEIADNLVSSFFIECLVYNVPNNQFISGNYTQTL<br>RNVIVKIYEDMKNNADYTEVNRLFWLFSNRSPRTRQDALGFMQKCWNYLGYQ |

TABLE 2

| Representative CD-NTase nucleic acid sequences | | |
|---|---|---|
| a. Wild-type sequences | | |
| CD-NTase Name | SEQ ID NO: | Nucleotide Sequence |
| DncV | 5 | GTGAGAATGACTTGGAACTTTCACCAGTACTACACAAACCGAAATGATGGCTTGATGGGC<br>AAGCTAGTTCTTACAGACGAGGAGAAGAACAATCTAAAGGCATTGCGTAAGATCATCCGC<br>TTAAGAACACGAGATGTATTTGAAGAAGCTAAGGGTATTGCCAAGGCTGTGAAAAAAAGT<br>GCTCTTACGTTTGAAATTATTCAGGAAAAGGTGTCAACGACCCAAATTAAGCACCTTTCT<br>GACAGCGAACAACGAGAAGTGGCTAAGCTTATTTACGAGATGGATGATGATGCTCGTGAT<br>GAGTTTTTGGGATTGACACCTCGCTTTTGGACTCAGGGAAGCTTTCAGTATGACACGCTG<br>AATCGCCCGTTTCAGCCTGGTCAAGAAATGGATATTGATGATGGAACCTATATGCCAATG<br>CCTATTTTTGAGTCAGAGCCTAAGATTGGTCATTCTTTACTAATTCTTCTTGTTGACGCG<br>TCACTTAAGTCACTTGTAGCTGAAAATCATGGCTGGAAATTTGAAGCTAAGCAGACTTGT<br>GGGAGGATTAAGATTGAGGCAGAGAAAACACATATTGATGTACCAATGTATGCAATCCCT<br>AAAGATGAGTTCCAGAAAAAGCAAATAGCTTTAGAAGCAAATAGATCATTTGTTAAAGGT<br>GCCATTTTTGAATCATATGTTGCAGATTCAATTACTGACGATAGTGAAACTTATGAATTA<br>GATTCAGAAAACGTAAACCTTGCTCTTCGTGAAGGTGATCGGAAGTGGATCAATAGCGAC<br>CCCAAAATAGTTGAAGATTGGTTCAACGATAGTTGTATACGTATTGGTAAACATCTTCGT<br>AAGGTTTGTCGCTTTATGAAAGCGTGGAGAGATGCGCAGTGGGATGTTGGAGGTCCGTCA<br>TCGATTAGTCTTATGGCTGCAACGGTAAATATTCTTGATAGCGTTGCTCATGATGCTAGT<br>GATCTCGGAGAAACAATGAAGATAATTGCTAAGCATTTACCTAGTGAGTTTGCTAGGGGA<br>GTAGAGAGCCCTGACAGTACCGATGAAAAGCCACTCTTCCCACCCTCTTATAAGCATGGC<br>CCTCGGGAGATGGACATTATGAGCAAACTAGAGCGTTTGCCAGAGATTCTGTCATCTGCT<br>GAGTCAGCTQACTCTAAGTCAGAGGCCTTGAAAAAGATTAATATGGCGTTTGGGAATCGT<br>GTTACTAATAGCGAGCTTATTGTTTTGGCAAAGGCTTTACCGGCTTTCGCTGAAGAACCT<br>AGTTCAGCCTCGAAACCTGAAAAAATCAGCAGCACAAGGTAAGTGGCTGA |
| NTase001 aka Ec-DncV | 7 | ATGCCTTGGGATTTTAACAATTACTATAGTCacaatatggatggcttaatcagtaagctc<br>aaattgagcaagactgaatccgataaactcaaagcacttcgtcagatcgtacgtgaaagg<br>acgagagatgtatttcaggaagctcgccaagtcgcaattgacgtgagaaggcaagcgctg<br>acacttgaaagtgtcagattaaaacttgagaaaacaaacgttcgctacctctcccccgaa<br>gaacgtgctgatctagcgcgacttatttttgaaatggaagatgaagcacgcgatgacttc<br>atcaaattccagcctcgtttctggactcaaggaagttttcagtacgatacgttaaacagg<br>ccttttcatccggggcaggaaatggatattgatgatggcacctacatgcccatgacggtg<br>tttgaatccgaaccgagcattggacacactctgcttctccttctcgtggatacatcactg<br>aaatcactagaagctgaaaacgatggctgggtatttgaagaaaagaatacctgcggacgc<br>atcaaaatctatcgggagaaaacacacattgatgtaccgatgtatgcgatccctaaagaa<br>caattccagaaaaaacaaacagcagcagattcagcacacctcataaagtcagattcggtg<br>tttgaatcttttgcattgaaccgggggggacgcgaggcttatgccgttgagtccgacaaa<br>gtgaacctggcacttcgcgaaggggtcagaagatggtcagtcagcgaccccaaaattgtt<br>gaagactggttcaacgaaagctgtaaacgtatcggcgggcatctgcgttcagtttgccgg<br>tttatgaaggcttggcgggatgcacaatgggaagttgggggcccttcatcaatcagtctg<br>atgactgcagtcgtcaacatcctcgatagagaatctcataatggctccgacctcaccggg<br>acgatgaaacttattgccaggttgctgcctgaggaattcaatcgcggtgtggaaagtccc<br>gacgatactgacgaaaaaccattgttccctgcggaaagtaaccataacgtgcaccataga<br>gctatcgttgaaactatggaaggtctgtacggtattttacttgccgctgagcaatcagaa<br>agtcgggaagaagcgttacgtaaaatcaacgaagcatttggtaaacgtgtgactaatgcc<br>ctattaatcacgtcaagtgctgcagctccggcatttctcaatgcaccatccaaagagcca<br>tcatCTAAACCAATCAACAAAACGATGGTAAGTGGC |
| NTase002 | 9 | ATGCTGAACTTGAGCCCACTCTTCTTCACCACCCTTGATGACGAATCCTGCATGCACGAC<br>GAGCTGGATCTGACGCCTGGGCAGCGCGCCTGGATCGCCAGCGCACGCACTGACGTCAGG<br>GACTGCCTGCGCACAGGCATCCCCCGCGTGCTTAGGGCAAACGGATACACGGAAGACGTG<br>CCGCAGCCGCGCTTCTTCACGCAAGGGTCGTGGGCATACAAGACGCTGAACGCCCCGGCA |

TABLE 2-continued

Representative CD-NTase nucleic acid sequences

| | | |
|---|---|---|
| | | CAACACCCTCAGCAGGCGGATGTCGATGATGGCTGCTATCTGCCAATGAGTTTCGTCTCG<br>CAGACGAAGCGTCCCAGCACTGCGGCGACGGTGTTCTTTGCCGCTGCGGAAGAAGCATTG<br>AAGCCGCTGGTCGAGGAAAGGCGGTGGAAGCTTGTCACCGACAAGCCGACCTGCATCCGC<br>ATCGTCATTGCTGCGTATGCTCACATTGATATTCCTCTGTACGCCATTCCCGACGAGGAA<br>TTTGTCACGCTCGCAAAGGCTTCGATGGAGCGATATGGCTACGACTCGCTGACGGAAGCG<br>GTGAACATGGCAGAGCGCGATGCCTGGACCGCGCTGCCGGCTGACAAGGTTCTCCTGGCC<br>CATCGTGAATGCAATTGGATGTCCTCTGACCCGAGGCCCGTGAAGGAATGGTTCCTGGGC<br>GAAGTGGAAGCCAAGGGGGAGCAATTCCGCCGCGTGGTTCGCTACTTGAAGGCGTTCCGC<br>GATTGGAAGTGGTCCAGCGGAGGACCTGCCTCGATCCTGTTGATGGCCGCCGCGGCCCCG<br>CTCTTTGAGAAACGCGATAGGCGCGACGACCTCGCTCTGCTGGATGTCGTCGCGGCACTG<br>CCAGCCCGGTTGCGTGGGGGAGTGAACAACCCCGTGGAAGAGTCCGAATCGCTCACGGAG<br>CGACTTGGCCAAGCGGGTGTCGAAGATGCGGCCAAAGCATTCGAAGAGTTTGAGAAGGTG<br>CTTCGCGGAGCAACCGGCGCCGGCAGTCCTTCACAGGCCTGCATCTGGATGCGAGGCGAA<br>TTCGGCCCGCGTTTTCCGAACGAGCCGGATCGGGTCAAGGTGGTATCCGTTGCCGCCACC<br>ATTGCCGCAGCTCCCGCCACCGCCGGCCCGAGCGAACTTGTCGGGCGAACAAAGGCTGGA<br>TGA |
| NTase003 | 12 | ATGCTGAACTTGAGCCCGCTGTTCTTCACTACCGTTGACAATCGGACCTGTCTGCATGGT<br>GCGCTGGACTTGGAGGATGCGCAACGCACCTACATCGCCCAAGCACGCCTAGATCTCCGC<br>AACTGTCTGCGCGCAGGCATCCCGGCGATTCTGAAAGCACATGGCTATCCAGGCCAAGTG<br>CCAACGCCCCGCTTTTTCACCCAAGGGTCCTGGGCCTACAAGACCCTCAACGCGCCCGCC<br>AAACCGCCGCAGCAAGCAGATGTCGATGACGGCTGCTATCTGCCGATGGGCTTTGTCTCG<br>CAGAGCAACCGGCCAAGCGTTGCGGCCGGAGTCTTCTTCCAAGCTGCAGAAGCGGCGCTC<br>CAACCCTTGGTCGACCAGAACAAGTGGCAGTTGGTCACTGATAAGGACACCTGCATCCGG<br>ATCGTGATCGCCAAGGATGCCCATATCGACATCCCCCTTTACGCCATTCCTGACGAGGAG<br>TTCGTCACTCTGGCTAAGGCGTTTGAGAGCCGTGGAATAGCCATGGACTCGATCACCTTT<br>GCTGAGGAGGAGGATGTCTGGACGAAGCTACCTCGTTACAAAGTGCTCCTGGCTCATCGC<br>CAAGAGAACTGGAAGGTCTCTGATCCTCGCCCGGTCAAGGAATGGTTCTTGAGTGAAGTC<br>GAGGCGAAGGGAGAGCAGTTCCGCCGGACAGTTCGCTATCTCAAGGCTTACCGGGATTGG<br>CACTGGGAAAGCGGTGGCCCGTCTTCGATCCTTTTGATGGCAGCGGCAGCCCCGTTGTTT<br>GAAAAGCACGATAGCCGTGATGATTTGGCCTTGCTCGCTGTGGTGGAGAAGCTTTCAGAC<br>GCCTTGCGAGAGGGGGTTAGCAATCCTGCAGATACCAGTGAATCTTTGACCGAGCGTCTT<br>GGTGCCGTAGGTGTTGAGGATGCTGCGAAGGCTTATGAGAGTTTCGCGATCATGCTGCGT<br>GGCGCGATTCATGCATCCAAGGCCTCGCAGGCATGCGCTTGGATGCGTCATGAATTTGGA<br>TCCCGCTTTCCAGACGATCCGGAGAGGGTCAAGGTTGTCTCCGTCGCGAGCAGCATCGCA<br>TCGTCCTCCGCTATCGCTGGCCCAAGCGAACTCATCGGACGCTCCAAGGCCGGATGA |
| NTase004 | 15 | ATGTATGATTGCTCAAAGGAATTCAGTACTTTTTATCGTAAAAAAGTCGTACTTTCTGCT<br>AAAGAACAGGACGAACTAAGAAAAAGAAGAAAACAGAATATTAGAAGGATTAAAGATGGG<br>TTAAATGAATATAATGAAGAGAAAAAAACAAGTTATAAAATTTCAGAGGACCGTATTCAA<br>GGTAGCATGGCTATGCATACCATTACGCAGAATGACGAGAAGGACTATGATATTGATGTA<br>GGTATAGTATTTGAAGCAGATTGTCTAAATAGTTTGGGTGCACAAGCTACTCGTAATATG<br>GTAGCAAACGCTCTTGAAAGAAAAACTAGGCAATTTGCACAACCACCTGAAGTAAAGACT<br>AGTTGTGTACGTTTAAAGTATAGTTCTCTTGGTTATCATATGGACTTTGCTGTATTCCAA<br>CGTAGTAAAGAATATGAGTGGGACGATAATTATATATATGAGCATGCAGGGACAGAATGG<br>ACAGAAAGACACATTAAGGCATTAGAAGAGTGGTTCATTAATCGAGTAAAGTATTCTGGT<br>GATGATTTACGTAAAATAGTGAGATTGTCCAAGATGTTCTGTAAATCAAGGGATAGTTGG<br>AAAAATATGCCGAGTGGACTTGTTCAAACGATATTATGTGACTCAAAGCTAAAAAACTAT<br>TATTCACGCTTAGATGAGAAATTTTATTACACTATGCAAGCTATTGTGCAGCGTCTGGAT<br>ATTCACCTCGATGTTAACGCTCCTGTCGATAATGGGAGAGAGCTAATAATTAGAGATGTT<br>GATTATAAGCGAATGGAGAATTGGAAAAATCGATTGAGAGCGAGTCTAAATAAGTTGGAC<br>ATACTTTTTGATAAGGAATGCTCGCGAGAAGATGCTCTGCAAGCTTGGGCATTGTTTTTC<br>AATCATTCTTATTGGGAGGAATTAGCCAGAACAAATCAAAGAAGCAATATTAGTGAGAGT<br>CGTTTCCTAAGTTTCAATGATACTGAGCAATTTATAGAAGAACTATATCCGATTTATGAA<br>AACTATAATGTTTCCATAGACTGTGATGTTTCAGGTAATGGTTTTTCTGTTATGCCGATT<br>GAGAAGTTTTTTGATAAACTCTCTCCACAACTTAAAAGGTTTATTCCATATAATTTTTCT<br>ATTAGGTGTAGGCTCGGGGATACTGATTGTCCGACCTATGATAAAATTCTTTGGAAGGTT<br>AGGAATATCGGTATTGAAGCTGAAAAGCGAAATTGTATAAGAGGACAGATAGTAGACAAT<br>AGGGGTACTGAAATTATAGAGAATTCAAATTTTGCAGGATTACATTATATCGAATGTTAT<br>TTAATTAAAAATGACATATGCGTAGGTATAGGTCATGTAGATATACCAATAGGAGGTATT<br>TAA |
| NTase005 | 18 | TTGTTTGATTTAGAGACAGAGTTTAACATATTTTATAGAGATTATGTTGTGCTTTCGAAA<br>GATGAGAAACAAAATCTATATAATAAAAAGGATCTAAATTTAGATAGACTTAAAGATGGT<br>CTACAGGAGTACAATGAGGAAAAAAAGACAGAATATAAAATAAAGGACAATGTAGTTCAG<br>GGTAGCGTGGCAATGTCTACGGTAACACAGAATGATAAACATGATTATGATATTGATGTA<br>GCAGTAATTTTTGATAAAGATAATATTCCCTCAGGAACTACAGCTGTTAAAAACATAGTT<br>GTAAACTCATTAAAGAAAAAATGTAAACAATTTAAAACTGAACCTGAGGCAAAAACTAAT<br>TGTGTAAGGGTGGCATATGAAGAGGGATACCATATAGATTTTGCTGTGTATAGACGGTTT<br>AAAAATGATTCTGATGAATTTGAATATGAACACTGTGGAAGCGAGTGGAGTAAAAGGGAC<br>CCAAGAACAATTACTAACTGGTTTATTGAAAACAATAAGGCTCAGGACTATAAACTAAGA<br>AAAATTGTGAGACTGTTAAAGATGTTTTGCAAATCAAGGGAACATTGGGTTATGCCAGGT<br>GGCTTGATTCATACAGTATTAGTTGTAGAATGTTTTGAACCTAATGATAGAATAGATAAA<br>TCTTTTTATAATACAATAAAAGCAACAAGAGATAGATTAAAAAATGATAAAGAAGTCAAA<br>AATCCTGTTGATGATAGCTTGAGTCTCATTATAAAAGAAAGTGATAAAACTAAAGTTGAA<br>AACCTTTATAACAGATTATCGACATATATAGATAAATTAGATATTTTATTTACTGATGGT<br>TGTACAAAGGAGCAAGCTATTGAGGCGTGGAATGATTTTTTTAACCACTCTTATTGGAGT<br>GATTTATTAACCGAAGATACTCAAAAAGCAAATGAGTCTGCATATTGCGCTACTGAAACT |

TABLE 2-continued

| Representative CD-NTase nucleic acid sequences | | |
|---|---|---|
| | | TTTCCTGAATGTGATGAAACAGAAGAGTTTATTGAACATATTTACCCCATCGATATTAAA<br>TATGACTTAAATATTAATTGTCGTGTCACGCAGGATGGTTGGAGAACAAAATTACTAAGA<br>AGTATGCTGAGATTAAAAGAACCACTGAGGCTAAATAAGAATCTTGAATTCTTCATTGAA<br>GGAACTAATGTGCCTCCCCCATATAAAGTTTTTTGGAAGGTGAGGAATATAGGGGATGTT<br>GCAGAGCAGAAAAACTGTATTAGGGGACAAATTGTAGAGGATAAGGGTAAGAACACTAAA<br>AAGGAGGAAACCTCTTTTAGGGGGCCTCACTTTGTAGAATGCTATATAGTTAGATATGGG<br>GTATGCGTGGCAAGGAGCAGAATAGATGTACCAATAAACATATTATAA |
| ATase006 | 21 | ATGGCTGACATCGACTGCCACAGCGAGATGACGAACTTCCATCGGGACAAAGTCACACTC<br>TCGAACAAGCAACAAGGTGAGATGCGCACGCGCCGAGACGCGGGGCGCACACGCCTGGAG<br>AACGGCCTCAACGAGGCCAAGAAGCCTCAACCCAATGAGGTCCGGTCGCAGGGGTCGTAC<br>CAGATGCGCACGATGGTACAGGACGATGCCAACGACTACGACATCGACGACGGGGCCTAC<br>TTCGCGTCTGACGATCTTAAGGATAACGCGGGCGTTGCGTTGACGCCGAAGGCTGCGCGC<br>GAGCGGGTGTGTAATGCGCTTGTGTGGGATGGCCGCCTTAAGCAGGAGGCCACCGTCAAG<br>CGCAACTGCGTCCGCCAAGTCTACGCTGCGGGCTATCATATCGACATCCCGGTGTACCGC<br>ATCATCACCACCAACGACGAGAACAACGATCCGGTGGAACACTACGAACTGGCAAGCGGT<br>GATGAGTGGACACGCTCAGACGCACGGGCGGTGACCCGTTGGTTCAACGGCCTGGTGGGC<br>GAATTGAACTCCGGCGAGTCGGACGGCAGCCAAATGCGGCGCGTCACCAAATTGACTAAG<br>AAGTTCGCGCGCCGTTCGAGCTGGAAGGACGAAACGACCAGTGGAATCTGTATCACCAAA<br>CTCGTCGTTGACCATTTTCAGTACAGCGCCGATCGCGATGACAAGGCGCTGCGCGAAACG<br>TGGAAGGCCATCGACAAGAAGCTTCAGAAATCGACCGAGATCGATCACCCCGTACTCGCC<br>ACCAAACTGGCGCAAGCGGGTGACGCGGCCGTTACCTTTTTCCATACCTGCTTGAGCGAT<br>GCGCTCAAGACGCTGGAGGTGCTGGACACGTCCGATTGCACCCGCAAAAAGGCACGGGAA<br>GCGTGGGACGACGTGTTCGACATCGACTTCTTCAGCATGCAGCCAGACAACAAAGACGAC<br>GGCGGGGGCGGCAAAGGCTCAGCCATGTCAGTCACGTCGGTCGAGACCGCCCGGCGCAAC<br>GATGGTGGCGGGAGGTTCGGCTGA |
| NTase007 | 24 | ATGGCAAATTTAGATACACAATTCCAAGAGTTTTATGGTGAACTCCAAATCACCGTTACT<br>AAGAAGCAGGCTTTGATTACTTCTCACAATAATCTTCGTACGAAGATACAAAAGTATTTC<br>GCCAAAAATCATCCTGAGTACGTGCCTTCGTTTTACATACAGGGCTCTTATAAGATGGGA<br>ACTACTATCCGTACACGTGATGATGAATGTGACCTTGATGACGGATGCTATTTCATTCCC<br>AAACCTGAAGTGAAAGGTATCACATTACAAAATTGGGTAATGGACGCTGTCAATGGTACA<br>GTCGGTGCAACTCCGGTGCATAAGAACAAGTGTATCCGTGTCAATTATGCTGCCGGTTAT<br>CATATTGATTTGCCTGTATATCGTAAGGAAAGATGCAATGATAACACTGAACATCCGGAA<br>TTGGCAGTTCGTGATGGCGAGTATGAATTAAGCGACCCTCGAGAAATTGTCCAATGGTTC<br>AATAGCAAAAAGAAAGACAATCCTGTTCTAATTCGGTTGGTATCCTATCTGAAATCGTGG<br>TGCGATACAGTGAGGGGCTTTATGCCTCCTGGACTGGCTATGACAATTCTGGCAAGTAAA<br>TATCAGAAGAAACATGAAGGACGCGACGATATAGCTTTGCGTGATACTCTAAAATCTATC<br>CGTACTGCGCTTCAAGCAAACTTTAGTTGCGTAGTACCTGGAACTCCTTATGATGACTTG<br>TTTGAGAGTTATGACAGCAATCGACAAGAAAAATTTATGAGTGAATTAAACGGATTCATT<br>GAAGATGCCGACAGAGCCGTCAATGAGAAAAATAAGCTGAAAGCAAGTAAATTATGGAAA<br>AAGCATCTTGGTAACCGCTTTCATTTAGCTCCAGATGAAAATGACGCAGAAATGAGTAAA<br>CTCGATAAGTTGCGCGATATAGGGAACAAAGTACTTACTGGCATAGCGACAACAGCCCAT<br>AACGGTTATATCCATGCTGCGGAAGGCGTAAAGAATGTTTCACATCGTAATTATGGTAAT<br>GAATAG |
| NTase008 | 27 | ATGGCAAATAATCATGAACAATTTATTGCATTCAACAAAACGATCAATTCAAACAAAAGA<br>GCTACGTTGAAAAAGAACCGTGACGCATTACGCGAGAGAATAAAAAATTATTTTAGTAGA<br>GAATATCCAGATGAAATTCAACCAAAATTTCATTGGCAAGGGTCTTATGCTATGCATACT<br>ATTCTTAATCCTCTAAAAGATGAAAACAATTTGGGGGTTTATGACCTTGATGATGGTGTT<br>TATTTTATTGGAAAATCAGAAGATGAACGTCATAGTGTACAATGGTATCATGATCGTATA<br>TATGAAGCGGTAGATGGCCATACATCTATTAAACCAGATGATAATAAACCATGTATTACA<br>GTAAATTACGGAGACGGGCATCACATTGACCTTCCTATCTATTTTATGGTGGAAGGTGAT<br>AAGCATCCACTATTAGCACATAAGACGAAGTCATGGTTGGATACTGACCCCCGTGAATTA<br>CTTAATTGGTTTAATGGTCGGGATGAACATCCACAATTACGTCGTATTGTACGCTATTTG<br>AAAGCTTGGTGCGAGTATATTAGATTTAAAAAAGAGATAAAGATGCCTACAGGATGTAGT<br>CTAACAATGCTCGCTGTTAAAAATTTCAAGAGTAATGAACGCGATGATATTGCCATGAAG<br>AATATTCTTGTAGCCATACATAATAGTCTTTCTTCTAAATTTGAGTGTCTTCGTCCTACA<br>TTTCCCAAAAATGAAGATTTATTTGAAGAATATTCAGAAACACGTAAGAATAACTTTATG<br>CAAGAACTTAAATCATTTCGTGAAGATGCTGAACGTGCTATTGAAAGCAAAAATCCACAT<br>GAAGCTTGCATGAAGTGGCAGAAGCATTTGGGTGATAGATTTTCTTGTAGCACGGCAAAA<br>GATGAGGATGAAGACGCACAGACAAAGTCATTTTCAGGAACAATAAACACTAATAGTCGC<br>TTTGCATAA |
| NTase009 | 30 | ATGGCCAATGTCCAAAAATATTTTGAAGAGTTTCATGAAGCCATTAGACTTTCAGATACT<br>GATGAAAATGAAGAACTACGTGAAAAAAGAGATATTATACTTAATAGATTAAATGAGAAA<br>AAAGCTGATAATGTACCAAAGTATACCCCCTTTAATCAAGGAAGTTATGCGATGGGGACA<br>GGAGTTAAACCTATCGATGGAGAATATGATATCGATGTAGGAATTCGTTTTGATATATCT<br>AAAGACGATTATCCTGATCCAGTTGAAGTTAAAAAGTGGGTGTACGATGCTTTGCAAGAT<br>CATACAAGCGAAGTTAAAATGAGGAGATCATGTGTAACTGTAACATATTTTAAAGACGGA<br>GAACCAGAATTTCATGTAGATTTAGCAATATATGCTGCAAATAACGACGATGGGAAACTG<br>TATTTAGCGAAAGGGAAGCTATATTCTGATGATGAGAATAAATATTGGGAAGTGTCAAAC<br>CCTTTAGAACTGATTACGAAAATTCGAAACAAATACGAAGATGCGGATGATAGAAATCAA<br>TTTAGACGTGTAATTAGATATCTAAAAAGATGGAAAGATGTGAATTTTACTACAGACGGA<br>AGTGCAGCTCCGACTGGAATCGGCTTAACAGTGGCTGCCTACAATTTTCTTACAATTTCC<br>AAACAGTATGATTTTGCAACGGGGAAATATAAATATAATGATCTAAGTGCTCTTAAAAAT<br>TTAGTACAGAGCATATTAAGCAGTTTTAGACTGGAATATAATCAAGAAGAAGGAAAAGGG<br>GTAGAAAGATTGCGTATAAGCTTACCCACTGAGCCGTATAATGATTTATTTGAAAAGATG |

TABLE 2-continued

| Representative CD-NTase nucleic acid sequences | | |
|---|---|---|
| | | TCTGATAGTCAAATGGCAGATTTTAAGGTAAAGCTGGAAGAACTAAAGACGACATTAAAC<br>AATGCAGAGGTTGAACCTGACCCACATGAGGCTTGCAAGATATTAAAAAGGTATTTGGT<br>AAGGATTTTCCTGTACCACCTAAAGAAGAGACTGGACAGAGAAAAAATCTTGCATTTTTT<br>GGGACAAGTGCATCGGCTTAG |
| NTase010 | 33 | ATGAGTCTTCAAAACAAATTTAAGAATTTTCATGATGCTATCAAGTTAGGAAGGAAGGAC<br>CTGGAGTACACGACGGCCCGCCTCAAGGACGATAGCATTACTGCCGATATCGTTGAACGA<br>TTCAAAGAAGATGGATATCCGGTTGTTGAGGATTTCATTCAAGGGTCTTTGGCGACCTTC<br>ACAGGGATCCGGGAAAAAGGGCAGGATTTCGATATTGACCGTGCAATCGTAATCGAAGCG<br>GAGCTGGCTCCGGAAAACCCAATAACGCCTAAACTCGCTGTACTTGAAGTGCTGGAAGGC<br>CGAGGTTTTAAAAATGCTAAGATCAAAAAACCTTGTGTGACTGCTGATTACAAGGCTGAT<br>GACCTTCATATCGATATCCCAATTTACCGCAAGTACAATAACGGCGAATACGAATTGGCC<br>GTTGGCAAGAGACATTCAACTGAGGATAATCGTGAGTGGGCCAGAGCAGCGCCACGTGAG<br>CTTATCGACTGGGTGAATAATTATGACGCTGATGAAACTTATGGTTCGAATAAGCATGAC<br>CAGTTTCGGCGTATTGTCAGATACCTCAAGCGCTGGAGAAATTTTACATTTGGCGATGAT<br>GTGCGTCGTAAAGTCTACTCAATTGGTATCGCGGTCATGGTCAAGGAATCCTTCGACTCC<br>TCCATCAACGATGAAGGCTTCCCGGATGACCTCACTGCACTGAGAAAGACAATCAACCAC<br>ATGCTTAACTATCGTAGCTATTTCACTCAGGTTGGTGTAGATAAATATAGTGTTAATGTT<br>ACGCTTCCAGTGAGCCCCTACAGAGATATTTTTCATAGCAGCAGTATCGTTACGGGAACA<br>CAGTTTCGCAATAAGCTGAGCGCACTGTTGAAAACCCTGAATAAGGTTGCTGATGAAGAG<br>CAAGAGTCCAAACAGTGCGAGTTGCTACGAAGTGTATTCGGTGAAGATTTTCCTGAGTGC<br>GCAGAAACATCATCTGCATCGTCAACTGCTGTTAAAACTGTTTTCGCATCTGCCGGAGTA<br>GTGGGGACATCGCAAGGCGCATGA |
| NTase011 | 36 | ATGAGTTTGCAAAATAAATTTAATACGTTTAATCAACGAATCTATTTAACCCGTCATGAT<br>TCCGAGTATTCAAATGCTCGTGAAAAAGACGATAGCATTACAGCTGCAATCAAGGCTAAA<br>TTTAAAGAAAAAGGTTATCCAGTTATTGATAACTTTGTTCAAGGGTCACTTGCTACTTAT<br>ACGACAATCAAAGAACCTGGCAAAGATTTTGATATTGACCGTGCCATAGTCATTGATTAT<br>GAAGAATCTCCATCAGATCCATTAGTTCCTAAAAAAGTCATTTTAGAAATTCTGGAAGAT<br>CGTGGATTTCAAAATGCTAAAATCAAAAAACCTTGTGTTACTGCTGATTATAAATTTAAG<br>AATCTACATATTGATATCCCAGTGTATAGAAAGAATTCCTGGGGAGGATATGAATTAGCA<br>GTGGGGAAAAAAGACTCAGCTGATGAACATAAAATTTGGTCAGAATCCTCGCCAAAAGAA<br>CTCATTGACTGGGTCAATGACTCATCTCAATATGGCGTATACGCCACAGAAAAACTACAT<br>CAATTTCGCAGATTGGTAAGGTACCTCAAACGTTGGAGAAACCTGAAGTTTAGTCCTGAT<br>GTGTGTAGAAAGATCTATTCAATAGGTCTAACTGTAATGATTAAACAGAACTTTAAACCA<br>AGTATTGATGAAGACGGATTTCCAAATGATTTACTCGCACTAAAAGCTACAGTTGATTCA<br>ATTCTGGATTGGTCTTGTTATTTTCAATTGCACTCTGATGATCAATGGAAAGTAAAAGTA<br>GAACTTCCTGTTTATCCATCTAGAGATATTTTTCATGGTAGTAGCCTAAATACGGGCACT<br>AGATTTAGAAATCAATTCACTAATTTGCGATCAACATTGCAGGATGTAATTGATACATCA<br>GATGAAGCTGAACAATGCTCTTTACTGGTCAAAGTATTTGGTGATGACTTTCCAAATAAT<br>GTAAATACCAATAGTGCAAGCAATGCTCAAAAAGTGCAATTCGCTACCTCTGGAGCTGTA<br>GGGACATCTCAAGGCGCATGA |
| NTase012 | 39 | ATGGCAAATTTACAATCATATTTTAATAGTTTCCATGATGCAATTAAACTTGATTATGAC<br>GACAACAAAGAATTAAGAGACAAACGGGATGAATTATTAGAAATATTAAAGGCGAATATG<br>CCTTCAGATGCTGGATCTTTTGAAATCTTTCATCAAGGTAGTTATGCCATGTACACAGGA<br>GTCAAGCCATTGGATGACGGCGACTATGACATTGACGTGGGGCTGCTGTTCAATATTTCT<br>AAAGATGATTACCCTAACCCTGTTACTGTAAAAAAATGGGTTTATGATGCTCTAACCAAA<br>AATTATGAAGATGTCGAAATGAAAAAGCCTTGCGTTACAGTGAAGTTTAAAGCGGAAGGC<br>GAAGATGAACGGAATTACCATGTAGATTTTGCTGTTTACGCAGACTATGAATCTGATGAA<br>AAAACTTATCTGGCAAAAGGCAAGTTAAACAGCAACGCTGAAAATCGTTATTGGGAAGAG<br>TCTGACCCGAAAACATTGGTAAATGACATTAAGAATCATTTTACAGATAGTGAAGACAGA<br>AAGCAGTTCAGACGGGTTATTCGATATTTAAAAAGATGGAAGGACATCAAATTTAAAGGA<br>CAGGTAAATCGTCCATCGGGGATTGGATTAACCGTTGCTGGGTTAACGCACTTCCAACCA<br>AAATATACCTATGATGGTTTTACTAATACAAAGAATTATAAGGATTTGGACGCTATAGAA<br>TCATTTGTTCAAAGTATGTTGAATGCTTTCGCTTGGGTTTTCAACGAGGAAAATGAGCTT<br>GAAGAAAGATTGCAAGTTTATCTTCCTACACCACCTTACAACGATATTTACGAAAAAATG<br>ACCGGGAAACAGATGACCGATTTTAAAGAGAAGCTTCAATGTTTATTGGACAAGCTCCAA<br>CAAGCGAAAAATGAAGCGGATCCAGTAGTAGCCTGCAAGTTATTACAAGAGGAATTTGGG<br>GATGACTTCCCAGTTCCTGAAGAGTCAACTACCGCTCAAAAAAGAGGACCAGCAATCATT<br>GTAGACCATTCTTCTGCATGA |
| NTase013 | 42 | ATGGCAAATATTCAAACAAGTTTTATTGATTTCCATAATTCAATTAGATTGGACGTAGAA<br>GACAATACGCTACTTAAGGACTATAAAGACCAAGTAATTGATGGATTAAAAGATTACTTA<br>CCTGATGATGTGAAGTTTGAAACTTTTTTACAGGGAAGCTATTCTGTTTATACCGGAATA<br>AAAAGCTGTGATGAAAAAATTGATTTTGACATCGATATTGCAGTTGCTTTCGAAATTGAT<br>CATACTGTTTATGAAGATCCAAGGGAGCCTAAACTGTGGGTAAAAGAGGCGCTAGTTGAA<br>ATTTTTCCTAATGCTCAAGTTAATTTAAAAGTACCTTGTGTAACTGCTACATTTACTGGA<br>AAAAAGACAAAAAAAAATGTGCACGTTGATGTTGCGGTTTATGCTAAAGAAGATGAAAAT<br>TATTTCTTAGCAAAAGCAAAAGAATTCAGTGCTCCCGAAAACCGATGCTGGGAGGAAGCG<br>GATCCCAAAGTATTAAAAGAGAAAATTAATAGTCATGTAGCAGATTCAGATGATCGAAAA<br>CAATTTCGAAGATGTATTCGCTATTTAAAAAGATGGAAAGATAACAATTTTAACCAAGAA<br>TATAAACCAACAGGAATTGGACTTACAATTAATGTGATGGATACGTTCCTAGTTAATAAG<br>TCCACTGATTTTTTAACTAGAAAAGTTCAGTATAATGATATGGAATGTATGAAGCAGATT<br>GTTTCTTCGCTGAAAGATTCATTTGTGTATGAGTACAGTGAAACAGATGGTTGGCATTAT<br>CGTCTACATGCATATCTTCCAGTGAAGCCTAACAGTGACACCTATTCAAAAATGACAGTG<br>AATCAGATGAGTGATTTTAAAAACAAACTTTCTAAATTATATGATGATTTGATTTTCGCT<br>ATCGATACTGAAGATGAGTATGAAGCTACAAAACGATTAAATAATCAATTTGGGGAGGAT |

TABLE 2-continued

| Representative CD-NTase nucleic acid sequences | | |
|---|---|---|
| | | TTTTTAATTATTTCAGAAGAAGAAGTTACAGAAAAAAACTTAAGAAATGCATTTGTTACA<br>GACTATCCGAGTGCTTAG |
| NTase014 | 45 | ATGCCAACTTTACAGTCACAGTTTATTAAATTTCACGACACAATTAAGCTAGATGCTGAT<br>GATAAAAAGGTTTTAATCGACAAACGTAAAGAGCTTGAAGAAGTAATTAACAATGGTGTT<br>TCAGAATTTGAAAAAAGCTTTTTCAACCAAGGAAGCTACTCAACTTACACAGGTATTTTG<br>CCAATCGATGAAGGAGATTATGACTTAGATAGAGGTTTAAAAATCGATGTTGATAGACAT<br>GAAAATAGAGTCAAAGTAAAAAATCCATGTGTGACAGTATCATTTCCTGAAGATAATGTT<br>CACATTGATATAGCGGTGTATTGTACTGAAAATGATAACTATTTTTTAGCCAGAGGAAAA<br>CTTAATAGTATTTATGAAAATATTAAGTGGGAGGAAGCAGACCCTGTAGAATTAACGAAA<br>AAAATTAATAATGCTATGGAGAACTCAGAAGACAGAAACCAATTTCGGAGAGTAATTCGT<br>TACTTAAAAAGATGGAAAGATCTCAAATTTAAAAATCAAGATAATAGACCGACAGGAATT<br>GGAATTTCAGTTTTTGCTGTCAGTAATTTTTCTGTAAGCAAAAAAGTAGACTATTTATCA<br>GGAAACACTACTTATGATGATATTTCAGCTTTAAGAAATTTAGTAAATACTATGATTAAT<br>TCATTTTCGGATACATATGATGTTGATAGAAACTTATTTTATCCGAGATTAGAGGTTTAT<br>TTACCGGTTAAGCCATATACTGATGTATATGAAAGGGTATCAAATATACAAATGGAAGCC<br>TTTAAGAATAAATTAGAAAAATTAAGAGACTCACTAGATGAAGCAATAAATTCTACTGAT<br>TTAAGTGAGTCTACAAAAGTATTGAGTAAACAGTTTGGTGATGATTTTCCTATTATTGAA<br>CAAAAAGAGACAGCAGAAAACTTTGGAACTCGGGCTATAATCAGTGATTATCCAAGTGCT<br>TAG |
| NTase015 | 48 | ATGAATTGCAGTGACCTTTTTTATGCTGATACAAATACAGAAAACACACTTCATCAGAGA<br>ACTCAATTATCTGAAGTTATATTATCTAAAGGTATTGCAAAGAAAAATGAGTTAATAGAA<br>TTTCTAAGACAAGAGTTAAAGGAAGCGTTTGACTGTGATGTGCGATTTTGGTTACAAGGT<br>TCATATAAAAGCCATACGCTGATAAAACCGGTAGATAAGTTTTCATCATATGATATCGAT<br>ATCGGCGTATATTTATTTTTCGATGCTGAAAATGAGGGGGTTGATTCTAAAGATGTTAAG<br>GAAACGCTGAGGGATGCACTATTGTCTTATTGTTCCATTAATAATGAAGCAAAACTGCAA<br>GAGTCAAAAAATGCTTGTGAAGGACTAAAGTTCTCTACTTTTCTTACTGTTGATACTCCT<br>ATTTATTATAAAACAGATACTAAGATAAAATTAGCGACAGACAAAGGCTGGAGTGACAGT<br>GATCCAAAAGCTATTCAGGATTGGATTACAAATTATTATAAAGACAAATCTGACAGAGCT<br>TTAATGAAGCGACTCGTTCGATACTTCAAAGCTTGGGTAAATGTAAAGTGGCAAAACACC<br>GGGTTTAAAAAAATACCCTCATTAGCTATTAATGTTTTGGTAGCCCAGCATATGAAACAG<br>CATGTGCGAGAAGATGATTGTTTTATATATACGGCGTTAAGTATTTGCGAGGAACTAGAA<br>TCTACATTAATAGTTAGAAACCCTTTAAATAATAGCAACTTAATTTCCATGCCTCAAGAT<br>GCTGAGTGCTTTGCACATCAAAAACTTGATGAATTAAAGCAAGTATGCCTTAGCTGCATT<br>AAGTCCGATGATATTAAAAGGGGAGCCCATTTTTCAAATCTTTTCCAACATTACTTCCCA<br>CAAATATCATTAGATTCTGCTACAGGTAGCACTGGTCTGCCTACGGTAGTTAATGTTCCT<br>GAAATCTCAGTTTGTAGATATGATAAAAATGGTAATCATGTTGAAACAATAATTACTGAT<br>AGATTGACTGTTAATAAAGGGGATTCACTAACTTTTACAATCCGTAATCATTATGATTTT<br>AATATCTATTCTAGTGCGCAATGGACAGTCAGAAATATTGGCTCACAAGCAAATGATGCT<br>AATGATATTGGACACTCAGTCACAGGTAAACCTAGTGAAAGTCATAAACGAGGCACTTCG<br>TATACGGGGTCTCATACTATGGAATGTATGATTTTACATAATGGGGCAATAATAGGATTT<br>AAAACTATACATGTAATAGTAAAACCTGCGCGTACAGTAAGAAGAAAAACACTTAAATTC<br>TGGAGGGCATGA |
| NTase016 | 51 | ATGAGTTTTGACAAAAACAAACATTTAAGAGAAGTGTTAGATACACACAAAATGTGCCAC<br>GTGCAGGATTTCGTGAATAAAGTAAAAAAACGTAGAGAGGAGATTAAGGCCAAAATGCAC<br>GACCATTATGGTTGCGACAAGTATTCTTCGTTTGGCTCTGGCAGTTTTGCTAAGCATACT<br>GCCACTAATGTGAAATTCGACCTTGATTTGGTGGAACCGTTCAAGCGTAATTCTTTCGGA<br>ACATTACAGGAGATGTTTGATAGCGTACACGATTTCCTTGCAGAGGAATATAAGAATACT<br>GGTGTGACTATTCGCAGGCAAAAGGTTTCAATCGGTGTAAGTTTCCCTATTGAAGAGGGA<br>GATGAAAAGCCGGTTGAACTTGATGTGGTGCCTGGTAGAGAACTAAGCGATGATAACTAT<br>CTTGATTCGCATGATTTGAACCTATGTTTTAATGAAGACCATTGGGGATTCCAAAAGGGA<br>TCAAGCCAGAAAACGAATATCCAGAAGCAGATTTCGCATATCGAAGGTAAGTCGAGTGAA<br>CGTCAAATTATTCGTCTGCTTAAAATATGGAAAAAGCAAAAAGATAAGAAATATAAGTCT<br>TTCGTTATTGAACTGGCCGTAATTAGAGCCTTAGATGGTTATAATGGTGATATGGGTCTT<br>TGGCCAAGATTAAAATACACGATGGAGTATCTACGTGACCACATCGCGGAAAGTAGTTTC<br>CACCTTTTTGACCCAGGTAACACGAATAACGATGTCGTGGGGACTATGCAGGACTACGAT<br>AGACAATCGTTTAAATCTGATATGGAAAGCATGCTCAACAACATAGACAGTAATCCTGAT<br>TTATATTTGCCCTACTACTTCAAGGTAAACGAAAAATATTGCGGATATAAAGAGAAAGAT<br>TTATATTTGCCCTACTACTTCAAGGTAAACGAAAAATATTGCGGATATAAAGAGAAAGAT<br>ACAGGTGCTGCTTATCCTACAAGTACAAAACGGTTCGGATAG |
| NTase017 | 54 | ATGAGCAGCGCCTACTTAAACGCGATTCTGGCTAGGGAGGCCGTTGATACCAGCGCGTTC<br>TCACCTGTTCGGCAGGTCCAGACAATAATCGCGCCTGTGCTTCAGCAATGGGCAAACCGT<br>TTCTTACTGTCGATTTCTCCGAGCGGCTCGTTTGCCAAAGGCACGGCCAACCGAAGCGGC<br>ACTGACATCGACCTTTTCATTTCGCTGCACGAAGACACGCCCGAGACTTTGAAGGATATT<br>TACGGCTCGCTCTTCAACGCCATTGCAGGCGCCGGCTATGTGCCAAAGCGGCAGAATGCG<br>TCGATCAACGCGACGATCGGCGGCTTCGATGTCGATCTCGTCCCCGGCAAGCGGCAGTCC<br>GCCTGGACGACGGATCACAGCCTCTACCGGCGCACGGCCGATACCTGGACGAAGACAAAT<br>GTGACGACACATATCAACACCGTCGTCATGGCGGGCCATCAGCGCGAGTCGCGGCTCCTG<br>AAACTGTGGCGCAACCAGAAGCGGCTCGAATTCCCATCTTTCTATCTTGAGCTGACCGTG<br>ATCGCAGCCTTGAGCGGGAGGACATCGCCTGACTTGGCGGAGAATGTCGTGACGGTGCTG<br>GAGTATCTCAGGGACAAGTTCACTGCAGCACGGGTGATCGATCCCGCCAATGGAAACAAT<br>GTCATATCGGATGATCTCACCGGCACGGAGAAGCAAGCGGTGCGGCGGTTGGCGGAAGCT<br>GCGCTGGGCGGCAATTGGAGCGGCTTCGTGCAATGA |

TABLE 2-continued

Representative CD-NTase nucleic acid sequences

| | | |
|---|---|---|
| NTase018 | 57 | ATGTCGTCCGGCTTGGATAGAGTGAAGACTTCTAGTGAGGATGAGATGTCAACAGAACAT<br>GTCGACCATAAAACTATAGCGCGATTTGCCGAAGATAAGGTAAATCTTCCAAAAGTAAAG<br>GCTGATGATTTCAGGGAACAGGCCAAGCGATTACAGAACAAACTGGAAGGGTATCTTTCT<br>GATCATCCTGACTTTTCATTAAAGCGAATGATTCCATCAGGTAGTCTGGCTAAAGGAACT<br>GCTCTTCGTCGTTAAACGATATTGATGTGGCTGTGTATATCAGCGGCCTCTGATGCACCA<br>CAGGATTTACGTGGGTTGCTTGACTATCTTGCTGATAGATTGCGTAAAGCATTTCCTAAT<br>TTTAGCCCTGATCAGGTTAAACCCCAGACATACTCTGTAACGGTTTCCTTCCGGGGCTCT<br>GGCTTAGATGTCGATATTGTCCCTGTATTGTATTCGGGGTTACCTGACTGGCGAGGTCAT<br>TTGATAAGCCAGGAAGATGGCTCGTTCCTTGAAACCAGTATTCCTCTGCACCTTGATTTC<br>ATCAAAGCCCGCAAGCGTGCTGCCCCGAAGCATTTTGCTCAGGTTGTTCGTTTAGCGAAA<br>TATTGGGCTCGTTTGATGAAGCAAGAGCGACCGAATTTTCGCTTTAAATCGTTCATGATT<br>TAATTGATTCTTGCAAAATTACTGGATAATGGTGTGGATTTCTCGAATTATCCGGAAGCT<br>TTACAGGCATTTTTTTCCTATCTGGTGAGCACCGAATTACGTGAACGCATTGTCTTCGAA<br>GATAATTATCCTGCGTCAAAAATAGGCACGTTGTCAGACTTAGTGCAGATCATCGATCCC<br>GTTAATCCTGTTAATAATGTTGCTCGTTTATATACGCAGTCTAATGTGGACGCCATCATT<br>GACGCCGCAATGGATGCCGGTGACGCTATTGATGCTGCATTCTATGCACCAACCAAGCAA<br>TTAACCGTAACCTATTGGCAGAAAGTTTTCGGTTCTTCATTCCAGGGGTGA |
| NTase019 | 60 | ATGCCACTCACTAATACTCAGATCCGATACTACGACAGCAATGTACTGCGTTTGCCTAAG<br>GATAAGCGTGAAACCTACAATGCCCAAGTAGATCGGCTTATTACAGCGTTACGTAAGAAA<br>CTGAAAGATCAGGATAAAATAACAATAAAACGTGTCGTCAAAGCTGGTTCGTTTGCTAAA<br>CACACTATTCTACGCAAAACCTCAGACAGTCAGGTCGATGTAGATGTTGTGTTTTACGTT<br>AGTGGAGAGAAAGTTGCTGAGGAAACCTTCGCAAGCCTGAGCGAAAAAATTTACGAAGCC<br>TTACTTAAAATGTATCCCAACAAAGCTGTAGAAGATTTCGAGATTCAACGTAAGGCTGCT<br>ACTGTTTCTTTTGTCGGGACTGGATTAGATGTTGATATTGTTCCCGTCATCGAAAATCCG<br>GACAAAGAAGGCTATGGATGGCAGTTTGACCGTATCGATGGTTCGAAGACAGAGACTTGT<br>GCTCCTTGCCAGATCAAATTTGTGAAAGAGCGCAAAGACCAAGACCCGGACTTTCGTACT<br>TTAGTACGCTTAGCTAAACGTTGGCGTACCAACATGGAATGCCCACTTAAGTCATTTCAT<br>ATAGAACTAATCATGGCTCATGTACTAGAAGTCAATGGAAAAGATGGTTCGTTGGAGAAG<br>CGATTTCGGGATTTTCTACTGTACATTGCTGAATCAGGATTAAAAGAAGTTATCACCTTC<br>CCTGAAAATAGCACTATACCAGCATTTTCCCATCCAGTTGTCATACTGGATCCTGTTTGC<br>GATACGAACAACGTTACCAGCCGTATTACCGAGGATGAGCGAAAAGAGATCGTCCGGATT<br>GCTGAGAAAAGTTGGGCGACGGCAAATTTTGCGTCGGTAGAAGGAGACTATGATATCTGG<br>AAGGAGCTGTTTGGTCGTTCATTTAAAGTGGAGGATGCAGCATGA |
| NTase020 | 63 | ATGTCTCTATCAAATACGGCTCTTGAATATTTTGACCATAACGTGCTGCGCCTCCCTGGA<br>GAGAAACGCAAGGAATATCACGCACAGGTCGACAACCTCGTAAGCGAGCTAAAAAAACGC<br>ATTACCGATAAGTCAAAACTCAAAGTCAAGAAGGTAGTGAAAGCGGGTTCATTCGCTAAA<br>TACACTATTCTGCGCAAAATTGACGACTATCCAACGGATGTTGATGTTGTTTTTTACATC<br>ACCGGTGTTGAAGAAAACAGCAAGTCCTACGAAGTTCTGTGCAACAGGATCTACGATTTG<br>TTGATAGAGATCTACCCAACCAAAAAAGTTGAGGACTTCGAAATCCAGCGTCGTGCAGCA<br>AAGGTAACATTCGTCAAGAGTGGTCTTGAAGTAGATGTTGTCCCTGTTCTGCAACACAGC<br>ACTCTGGCAGACCACGGTTGGCAATACGATATCCAAAGCGGAGCCAGGAACCTTACCTGC<br>GCACCGTGCCACATCCAATTTATCCGTACAAGAAAGGATAAGGATAAGCACTTTCGCACG<br>TTAGTGCGTTTGGCAAAACGCTGGAAGCATTTCCACGATATCCCGGGTCTGAAGTCCTTC<br>CACATCGAACTGATTCTGGCCCATTTAGTTGATACGGATGGCGCAGCAGAAAATATCGAG<br>AAACGTTTCCGGGAATTCTTAGTTTATATTGCCCGTACCAAACTGGGCGAACGTATCGAC<br>TTCCCAGAAAACGAAGGCAAGACATCTGTTAGCTTCAGTGACCCTGTTGTGATCATTGAC<br>CCGGCTAGTCCAGAAAACAATGTGGCATCTCGTATAACGAAAGACGAACAAGAACAAATA<br>GCTAAAGCTGCTGAAGCTGCCTGGGAAGCAGCAACATATGCATCTACTAAAAACGATGAT<br>GATCTCTGGAAAGAAATTTTCGGTGGCCGTTTCAAGACCAAGGATTAA |
| NTase021 | 66 | ATGCAACTCGCTGACCACTTCAACGTCTTGCTGAAAGACACGGTCAATCTCAGCCAGTTC<br>AAACTGGACCTACTCAACCAGCGCGTCGAAGCCATCTATAAGGCACTCAAAGCCGACGTC<br>GAAATCGGTGCGCTGATCACCGGCAAGACGCCGCAAGGCTCCTGGGCACACCGCACGATC<br>ATCAACCCCGTCGGTGACAACGAGTTCGACGCCGACTTCATGCTCGACATGAGCCAGAAC<br>CCGGACTGGGCCGACAACCCCAAGACCTACATCGATGAGGTCTACGCAGCCCTGCATCGG<br>CACAGCACCTACGGCACCATGCCGCACTCACGTAAGTGCCGCTGCGCGCGGCTCGTCTAC<br>GCCAACTCCATGCACGTCGACATCGTCCCTCACCTCAACCTGGCCGACGGTCGAGAGGTC<br>ATCGTCAACCGCGACGACAACGAGTGGGAGCTGACCAACCCGCAGGGTTTCACCGATTGG<br>ATGAAGAAACAGGACTCTATCGCCAGCGGGAACTTACGCAAAGTGATCAGACTCATGAAA<br>TACCTTCGTGATCACAAGAATTCGTTCACCGGCACACGTTCAGTCCTGCTGACCACCATG<br>CTGGGGGAGCAGGTAACAGACTTGCGCAAGCTCCTGGACCCGAGTTACTACAGCAACGTC<br>CCCACAACTCTTCTTCATGTCGTGCAAGACCTCGACACCTGGTTGCAAGCGAACCCGATC<br>AAGCCCTCCATCGCCGACCCGTCCGGTTCCGGCGTGACGTTCGACCACCGGTGGGGACCA<br>GACCCCGAGAGCGCTCAGGCGACCTACAGCTACTTCCGTGACCGAATCCACGTGCATGCC<br>GCCGACATCGAAGCGGCCTACGAGGAGAAAGACAAAGACCGCAGTGTCCAGCTGTGGCAG<br>AACATCTTCGGCGACGGATTCAAGGCGCCGGCCACAACAACCGCTAGCGCGAAGTTTCCA<br>GCAGCCACCTCTGCCGCGGACTCAACAGTGGGGCGCTCTGGTCGGGCAGGGTGA |
| NTase022 | 69 | TTGCCCATGCTGACGGTTGCTCAGGCATTCGAGACGTTCATGAACTCCCTGCGTCTCCAT<br>GATGGAGAAGCACGAGATGCAACGCGACAAGAGCAGTACGTCTTCAACGCAATGCGCCGA<br>CAGTTGCGGCCCACCGAGTCCTTTATTTCAGGGTCCTATGGTCGGAACACGGCGATTCGA<br>CCACTCCACGATATCGATCTCTTCCTCGTTCTTGCAGATGATGGAAGGAATCCACCTGAA<br>CCTGAGGATGCGCTAGCCCGCGTGCAATGGGCGCTCCGTGCGGAGTTCCATGATAAGGAA<br>ACGCGACTCCAGAATCGCTCGGTCAATATCAACTTCACTGGGACCGAGATCGGCTTCGAT<br>GTTGTTCCTGCGCTCTACGACCCGTGGGAACAGGGTGGCTACCTGATTCCAGATAGGCGA<br>GCCGGTCAGTGGATTCGCAGTAATCCTCGCAAGCATCAGGAAGCGTGCGACGATGCGAAT |

TABLE 2-continued

| Representative CD-NTase nucleic acid sequences | | |
|---|---|---|
| | | GACGTGGCGAAGAAGAAGCTGAAACCTTGGATAAAGGCCATCAAGCGCTGGAATTTTCGC<br>CACGACAAGCCGGTGCCTTCATTTCTCCTAGAAGTCTTGGCCTGCCGAGGAGTGACCCAC<br>TCGCTAGGGGATAAGAGCTACGCGGAGGGACTGGCGCAGTTGTTTGATTATATGTGCGCC<br>AATATTCTGAATCAGTGCCCTGTCCCTGGAAGCTCTGGACCAACCATTACCAGTTGGATT<br>CCTCAGGGACGCCTCGTTCAAGCGCACCAGCGGTTGACGCAAGCCGTGCGTGTGTCCAAG<br>CGAGCACTGGAATTGGAGTATTCGGGATACACGGTCGAAGCACTTGATCTCTGGCGAGAA<br>CTCCTGGGAACGGACTTCCCGGTTCGGTAG |
| NTase023 | 72 | ATGCTGTCGATCGATGAAGCTTTTCGCAAGTTCAAGTCGCGTCTGGAACTCAACGAACGC<br>GAACAGAAGAATGCCTCGCAACGCCAGAACGAAGTGCGGGACTACCTGCAGACCAAGTTC<br>GGCATTGCGCGCAGCTTCCTGACCGGTTCCTATGCTCGATACACGAAGACGAAGCCGCTC<br>AAGGATATCGACATCTTCTTCGTGCTGAAGGACTCGGAGAAGCATTACCACGGCAAGGCC<br>GCATCGGTAGTGCTGGATGATTTCCACTCTGCATTGGTGGAGAAATACGGTTCGGCGGCC<br>GTGCGCAAACAGGCGCGCTCGATCAACGTGGATTTCGGTGTTCACATCGACGCGGAGGAC<br>AACACGGACTACCGGGTGGTCAGCGTGGATGCGGTGCCCGCATTCGACACCGGCGACCAG<br>TATGAGATCCCCGATACGGCGTCCGGAAAGTGGATCAAGACGGACCCGGAGATCCATAAG<br>GACAAGGCGACCGCAGCGCACCAAGCCTATGCCAATGAGTGGAAAGGTCTCGTGCGCATG<br>GTGAAGTACTGGAACAACAATCCCAAGCACGGCGATCTGAAGCCGGTGAAGCCCTCGTTC<br>CTGATCGAGGTAATGGCCCTTGAGTGTCTTTACGGCGGCTGGGGAGGATCGTTCGATCGC<br>GAGATCCAGTCGTTCTTTGCCACGCTTGCCGATCGAGTTCATGACGAGTGGCCGGATCCC<br>GCCGGACTTGGCCCGGCGATCAGCAACGATATGGATGCCGCGCGCAAGCAGCGCGCGCAG<br>CAGCTGCTGTTCCAGGCGAGCCAGGACGCAAGCATCGCCATCGACCACGCGCGTCGTGGT<br>CGCAATATCGAAGCGCTTCGCGCCTGGCGCGCACTGTTTGGCCCCAAGTTCCCACTGTCC<br>TGA |
| NTase024 | 75 | ATGTCGGATTTTAGAATCAATAAGGCGATTAATGCATTTGTAGCCGAGCACATTGACTTG<br>CATAAAGACACTGTTCAAAAAGGACGAAACAGTCGAAATTGGCTGCTTGATCAACTTGAG<br>TCGATGGCTCAGAAAGCGGAGCATTTTCCTCCTAGATACACAGATAGACACAAAGGATTT<br>GGTTCATTTCATAGAAGCACAAAAAAACAACCTTTAGACGATATAGATCAGCTGTTTTGC<br>TTTTCAGCACGAGGAGATATGTATTACTCGGAGGTGGGAAGTACTGTTTATATCAATATA<br>GCTGGTGATAATGAGATATATGGGCATCTAACCAGTACCAATGACAATACAAAATTAAGT<br>TCTATCAAAATGGTTAACCTTATGGTTAGCTCTTTAGATAGTATTGGTCAATATAAAAAT<br>ACACCTCACAGGAATGGTGAAGCCGCGACTTTACAAGCTGCTGCTTACGATTGGAACTTT<br>GATATCGTGCCTTGCTTCTTTACAGCGGCAGATGCAAACGGTAAAGACTACTACTTGATT<br>CCGGATGGAAGTGGTAATTGGAAAAAAACTGACCCTAGGGAAGATAAAAACCGTTCTGCT<br>CGGATTAATCAGTCTCATAGAGGACAAATATTACAGCTAATCCGAATAATAAAATATTGG<br>AATAAACGACAAACGATGGCGACTATGGGCTCTTACCTTTTAGAGAATATGGTTCTCGAT<br>TACTTTGAAAACAATAAACCTTCTGAGGAATATATTGAGTTTTCAATACGTGCAATTTTT<br>GACTACATTGCAAATGCTGTCTATTGCCCTGTAAATGACCCCAAAGGTATTCAAGGAAAC<br>TTAAACAATCTTGACTTCGACAAAATGAAGTCGATCAGCGAGAGAGCTAAACTTGACTCT<br>TTAAGGCTACATAATGCTGATCAATATGAGTTTTCTAATCCGGATAAAGCAATCAACGAA<br>CTAAAAGCCATTTTTGGCTCTGACTTTGTTGGGTAG |
| NTase025 | 77 | ATGGCTACGACAGTTATCTCAGCATTTAATGAATTTCTCAAAGAGAGCGTAAATTTAGAT<br>TCAAATAAAACAATAACTGCTCGCAGTAGTAGAGATTGGTTAATTAGTAAGATTAATAAC<br>TTCGATAATAATCAAAGTTTTCCTTACATATATCAAGATATTCATATTAACTTTGGTTCT<br>TTTGCTCGAAGGACCAAGATAAGACCTCTTGATGATATAGATATCATGATTGGTATAAAA<br>AGTGATTATTGTACTTACTATGAAAATAATGAAGACATAAAAATATTAATAGATTCAAAC<br>ACAGCAAGATTAAATAATTATACTCATGATAATACTACATATGTAAATTCAAGAAAAATA<br>ATAAATCTTTTTGTTTCTGAGTTGTCGAAAATAGAACAATATTCATCTTCGGAGATCAAC<br>AGGAGACAAGAGGCTGCTACACTAAAGTTGAAATCTTATGATTGGAATTTTGATATAGTA<br>CCTTGTTTTATAACAGTGCCAGATATTTATGACAGAACTTTTTATCTTATTCCTGATGGG<br>AACGGTCACTGGAAAAAAACAGATCCAAGAATAGATAAAAACAGAACAACTGACATAAAT<br>GTTAAACATGACGGAAATATGTTAAATGTAATAAGAATCGTTAAATACTGGCAAAAAAGA<br>AAAACAATGCCCACGATGAGTTCATATTTATTAGAAACTATTTTACTTAATTATTATGAT<br>AATAAATCATATTGTTCACCATATGTTGATATTGAGTTAGAGGGGGTTTTTAGACACATA<br>TCTGATGTAATATACAATACTGTAAATGATCATAAAAACATCCAAGGTGATATTAATAAC<br>CTACCTTGGGATGATCGAGTGAAAATATCCAATAAAGCATTATCAGATGCTGAAAAAGTA<br>AATTTAGCTAGAGATTTAGAAGAAAAATATGATTATCAGAAGTCGATAAATGTTTGGCGT<br>GAAATTTTTGGTGATGCATTTCCACAATATGGATAA |
| NTase026 | 79 | ATGGCGACAACTGTAAATAATGCATTTAAAGAGTTTATGCGAGATAAGGTCAACTTGGAT<br>CCGGACAAAACAAAAACTGCAAGAAAAAGCAGGGACAATCTTATAGATAATATACATAGT<br>TTGGGTTCTAATGAAGATTTTTTCAATTTATATCATGACATTGATATTGCATTTGGCTCA<br>TTTGCAAGAAAAACAAAAATAAGACCCTTAGATGATATTGATATAATGATTGGGATTAAC<br>GGTGACGGTAGCACTTATTATGATTCAGGCTATGAGGTTAAAATTTATGTAAATGATGAT<br>AATTCTCCACAAAAGAGTTGTTGCAATGACAATACTAACATACTCAATTCAACAAAAGTT<br>ATTAACAAATTTATAAAAGAACTTAAAAATTTAAACGATTATAAGAAAGCGGAGACCCAT<br>AAGAATGGTGCGGCAGCCACCCTTCAACTAAAATCTTATGAATGGAATTTTGATATTGTA<br>CCATGTTTTCGAACAACTAAAGAATCTGATGGCCGAGATTATTATTTAATACCAGATGGA<br>AAGGGAAATTGGCAAAAAACAGATCCACGCAAAGATAGGGATAAAGTAACTACTTTGAAC<br>CAAAAACATAATGGATTAATGTTAGAGACTATAAGATTGGTAAAGTATTGGAATAGAAGA<br>CCTACAATGCCATTGATGCCATCTTATGCATTAGAATGTTTATTACTACAATATTTTGAT<br>AGCGTAGATAGTGTAAGTGATTATATTGATTTAAGATTTAGAGATGTTTTATATTATATC<br>AAAGATAACATTTGGTATTCCATTAATGATCCAAAAGAAATTCAAGGAGATTTAAACACA<br>CTTACATATGATGAAAAACTGAAAATTTCAAACAAAGCAGAAAGTGATTATGAAAAAGCA<br>AAAGAAGCGATTTCTGCAGAAATAGATGATAAAGATCATGAGAAAGCCATTAAAAAATGG<br>GCTGAAATATTCGGAAGCGAATTTCCAGAATATAGCGAGGATTAG |

TABLE 2-continued

| Representative CD-NTase nucleic acid sequences | | |
|---|---|---|
| NTase027 | 82 | ATGGCGACCACAGTAATAGCTGCCTTTAACGAATTTATGAAAGATACCGTGAATCTCAAA<br>AAGGCAGATACCGATGACGCGCGTGCAAGTCGCGACTGGCTTATCGGTAAGATGAATGAT<br>TTTGAGAAGGACGATAAATTTCCGGTGAGTTTTCCAGCGATCCATATTGCCTTTGGCTCC<br>TTTGCCAGAAGAACCAAAATCCGTCCGCTTGATGATATCGATCTGATGTTTGGCTTAACC<br>GGGCAAGGTGCCACCTATACCATCCTGAGTGACCGGATAACTGTAACCTCCTCCGGAGAG<br>GGGTCACGTCTGCACAGTTACCGCCATTCCGGAGCTGACACCGTCTGCTCCGTCAGAATT<br>CTGAATGCCTTTAAAAACCGCCTGCAGGACATTGCCCAGTACGCCCAGGCTGATATCAGG<br>CGTAACCAGGAAGCTGTCACGCTGAAACTGGTCAGCAAGGACTGGAATTTTGACATCGTC<br>CCCTGCTTTATTACCAGCGAAGATGCCTTTGGACGGACTTACTACCTGATCCCCGATGGC<br>AACGGCCACTGGAAGTTTACCGACCCCCGTAAAGACAGGGACAGAGTCACTACTATCAAT<br>GTGCAGAATAACGGCAATGTGCTCAATGTCATCAGAGCAGTCAAATACTGGCAGCGGCGA<br>CCGACGATGCCATCCATGAGTTCCTACCTGCTGGAAACGCTGATTCTGGACTATTACGCT<br>GGCAGGACATCCTGCTCATCGTTTGTTGACATGGAGCTGGAAGCGCTTTTCCGCCACCTT<br>GGTCAATCCGTGCGGTACTCTGTCAACGATCCCAAAGGCATACAGGGTGATATCAACTCA<br>CTTTCAGCCGAGGCACGTAAGGCGATATCGGACAGATGTTATCTCGATGCGCAAAAGGTA<br>TCGGAGGCGAGATGGTTTGAAAATAATAAAGAGTATGAAAAATCCATCAATAAATGGCGC<br>GATGTGTTCGGGCCATTCTTTCCTGTTTACGGGTGA |
| NTase028 | 85 | ATGACCATGACCGTAAATGCTGCCTTTAACGAGTTTATGAGGGATACCGTGAACCTCTTA<br>AAGGCAGATACCGACGACGCACGTGCAAGTCGCGACTGGCTTATCGGTAAGGTAAATGAT<br>TTTGAGAAGGACGGAACATTTCCGGTTAACCATCCGGGCATACACATTGCATTCGGCTCT<br>TTCGCCAGAAGGACTAAAATACGCCCGCTTGACGATATCGATCTGATGTTCGGGTTATCT<br>GCTGAATCGGCGACACACACGATATACAGCGGTCACATAACGCTGAATTCTTCCGGAGAA<br>AACTCGCGGCTGCACCAGTACAGGCATCCTGGAGAAAATACCATCTGTTCTGTAAGGATC<br>CTGAACGCCTTTAAGAACCGACTGCAAGGTATTTCTCAGTACGCACAGGCTGAAATCAGG<br>CGTAATCAGGAGGCCGTTACGCTCAATCTGAGCAGTAAGGACTGGAATTTTGACATCGTG<br>CCTTGCTTTATTTCTACCGCAGATGCGTTTGGTAAGAATTATTACCTGATACCTGACGGC<br>AAAGGGCACTGGAAGAAAACCGATCCCCGGATTGACCGGAACAGGGTTACGGATATCAAT<br>GTTAAAAATGACGGGAATGTCCTTAACGTCATCAGAGCAGTTAAATACTGGCAGCGGCGG<br>CCCACGATGCCCGCGATGAGCTCCTATCTGCTTGAAACAATGATACTGGACTATTATGCA<br>AACAAGACTGACTGCTCAGAGTTTATTGATATCGAGCTGCGGGCCCTTTTCAATCATTTA<br>GGCCTGTTTGTTCGGTATTCTGTTAACGACCCGAAGGGTATTCAGGGCGATATCAATACC<br>CTATCAATGGAAGATCGTCAGAAAATTTCGGACAGATGCTATCTCGATGCTCAGAGGGCT<br>GCAGAAGCCAGACAGTTTGAAAGGGATAATGATCATGAAAAATCCATTAACAGGTGGCGG<br>GACGTGTTTGGCCCTCAATTTCCGGCTTACGGGTGA |
| NTase029 | 88 | ATGAATGTATCAAATACTTTTCAAGAGTTTCTTCAAAATCTAGCGATAGATAATAAAGAA<br>GAAATTAGTAACAGATATAAAGAAATTACAAAAGTACTTAATATTAAATATAGAAATACT<br>GAATCTAAAATATCAAATAGTCTGCAAGTAGGTTCCTATGGTAGATTTACTGCAATTAAA<br>GGCATTTCTGATTTAGATATGATTTATATTTTACCGCGGACAGAATATAAAAGATTTAAA<br>GATCATGGACAATCAGCATTACTTCAAGAAGTTAAAAAAACTATTCAATCAAGATATCCA<br>AAAACAGATATGCGAAGAGATGGGCAAGTTGTAGTCATATCTTTTACTAATTATCAAATA<br>GAAGTACTACCAGCTTTTGAATGCAAGAATGGAAGTTTTTTATATCCAGATACAAACGAT<br>GGAGGTAGTTGGAAAAATACTAATCCACGACTCGAAATAAAAGCCATATCTGATTTACAT<br>GAAAAAAATAAAAATTTGAGAAATTTATGTAAAATGATTAGATCTTGGAAAAACTACCAT<br>AGTGTGGCAATGGGTGGACTTTTAATTGATAGTTTAGCTTATAATTTTTTAAATTCAACT<br>ACATATTATAATGACAAAAGTTTTGCACATTACGATCAGTTAATTAAAGATTTTTTTAAA<br>TATTTATCAGACTTACAAAATACAAACTATGTTTTTGCACCTGGTAGCTATCAAAAAGTT<br>TATATTAAAAGTAAATTTCAAACAAAAGCAAAAAAAGCACATAAGTTGGTTTTGGAGGCT<br>ATTGAAGCACAAAAAAATAAAAATGCTAATCAGAAGTGGAAAAAGATATTTGGAAGAGGA<br>TTTCCATCAGCTGTTCAGTTAGCTACAGAAGCTATGAATGAATCTATATCAGCTTGGACA<br>AATACAGAAGAATTTATAGAAGATAAGTACAATGTTGATATTAGATATGATTTATCAATC<br>GACTGTGAAGTAACTCAAATAGGATTTAGAACAGATAAGCTTTCGAATATTCTTGCTAAA<br>AATATTAGATTGTTACCAAATAAAGAGTTGAAATTTCAAATAATTCATAATGACACAAAA<br>GGAGATTTTGAAATTTATTGGAAAGTCTTGAATAGGGGTGATGAGGCACAAAAAAGAAAT<br>ATGATTAGAGGACAGATTGTTAAGGGAACCAAGATAAAAAAAGAAACAACAAATTTTCGT<br>GGAGATCATATAGTTGAGTGTTATATTGTACAAAATAATACAGTAGTTGCTAAAGACAGA<br>ATTCATGTACCAATCAGTGAAGGAATATATTCATGA |
| NTase030 | 91 | ATGTCAATATCCGATAAGTTTAGTACACTAATTGATAACCTTAAGATTACGAATGGGGAC<br>ACCATTTCTAGCCGATATAAGGCCATTACGAAAAGACTGAACACTGATTTTTGGAATTCT<br>TCCTCAGAGATAAGCCATAGCAGATATGTAGGCTCAGTGGGTAGGGGTACTGCTATTAGG<br>GGTGTAAGTGACGTTGATATGGTCATGGAATTGCCAAGTGATGTTTACTGGCAACATGAT<br>GCCTATAAAAGTAATGGCCAATCGGCCCTTCTACAAGCTGTTAAGGAAAGCATAAAGAAA<br>ACCTATCCTAATACTCATAATGTTGGGGATGGACAAGTTGTGGTTGTGAGTTTCACTGAC<br>GGGATTAAATTTGAGGTTATACCAGTATTTTTAAATCGTGAAGGAACCTACACTTATCCA<br>GATGCTAACAATGGCGGAGGTTGGAAAGTAACCGACCCAGTAGCCGAAATTAATGCCATT<br>AATGATGCAAACAACACCTACAATCAAAAAGTAAAGCACCTAGCCAAAATGGCCAGAGCA<br>TGGAAGGAAAAGTGCAATGTACCTGTTCCGGGCATATTGATTGATACCCTGGTTTTTAAT<br>TTTATGAAGAAATGGGAATACAATGATAAATCGTTTTTGTATTATGATTTTATGACCAGG<br>GATTTCCTAAAGTATTTATCCGAACAAAACCCTAGCCAGGGTTACTGGCTAGCCCCTGGA<br>AGTAACCGAAGAGTGTATGGAAAGGGTAAATTTGAATCAAAGGCTAAAAGCAGTTACAAC<br>GATGCTCTTAGGGCCATAGAATATGAAAATGCCAAGAAAGAGTACTCAGCTAACCAAGAA<br>TGGAGGAAAATATTCGGGAACTATTTTCCGAGTTAA |
| NTase031 | 94 | TTGTCTACATCTGATTTGTTTTCATCATTCATAGAGAATCTTGCAATAAGTAATATGGAA<br>TCAATTAGCTCACGATATGGAGAAATTACAGCAGCGCTAAACAAGGAATTTCGAAATACT |

TABLE 2-continued

| Representative CD-NTase nucleic acid sequences | | |
|---|---|---|
| | | GATTCAAAAATTGCGAACACCTTACAAGTTGGATCCTTTGGAAGAAAAACCGGCATAAAC<br>GGTATCTCAGATTTGGATATATTATATTTTATGCCTAAGGGCAAGTGGGATACTTATAAA<br>GATTCAAAACAACTCAGCCTTCTCCAAGATGTAAAATCAGCGATACTTAAAAGATATCCA<br>AAGACAGAAGTACGCGTTGATCGCCTTGTCGTTACGATAACTTATACGGATTTCCATATA<br>GAAGTGCAGCCAGTATTTGAGCAAGACGACGGTAGCTTTAAGTATCCAGACACTAAAGAT<br>GGTGGCAATTGGAAGATTACAAAACCTAGAGAAGAAATGGAGGCCGTTTCGAAGTTAGAC<br>GCAGATAAAAATTCAAATCTTAAAAGACTTTGTAAAATGGCTCGGGCATGGAAAAATAAA<br>CACGGTGTCGAAATGGGCGGGCTGCTTATCGATACATTTGCATATAATTTTCTAAGTTCG<br>ACTGATAATTATGATACAAAAAGTTTCAACTCGTACGGAGAACTCAATAGAGATTTTTTT<br>CAATTTCTTTCAGAGCAGCCAGAGCAGGATTACTACCGCGCACCGGGTAGCAACCAGAAT<br>GTAAGAGTGAAAAAACAATTTCAAAAGAAGGCAAAAAAGGCTTATGATCTTTGCGTCAAA<br>GCAATAGAAGCCAAAGATGAATCAGGCGTCAATGACAAGTGGAAGAAAGTTTTTGGTCGT<br>CCATTTCCTTCAAATATCGAGTCGACTTCCGATAGCGTTCAAAAAACTGCTTCCACTCTT<br>TGGACTAACACTGAGCAATTTATTGAAGACCAATATCCAATCGATATACGTTATGATATG<br>AGCATTGATTGCAATGTTAACCAAGATGGCTTCAGAGAAAGTACTTTAAGACAAATGATA<br>GAGAAGAAATATCCGTTGCACCTAAGAAAACATTAGAATTCAGGATTACTTCTATCAAC<br>GTTCCAGGATCTTATGAAATCTACTGGAAGGTGCTTAACAGAGGCGAGGAAGCGCGAAAG<br>AGAAACCAAATTAGGGGACAAATTATTAAAGATTCTGGTAACTATGAAAAAGTTGAACAA<br>ACGTTATTCAAAGGAGATCATGTTGTTGAATGTTATGCCATAAAGAATGGAATCCTGGTA<br>GCAAAAGATAGAATTCACGTCCCGATCAGTTTAAACGGATAG |
| NTase032 | 97 | ATGAGCCACAGGGAATTGTTCAGCGAATTTCTTGAAAATTTGAATCTTGACCTCAAACAG<br>GCAAAAAAGATCAGCTATCACTATCGAAAAATAACCAAGTCATTAAATCTTGCGTTCAGA<br>GGAACGAGTTCCCGGGTAGCAAACCGCTTGAAAGTGGGGTCAGTAGGCAGACATACCGCA<br>ATAAAAGGCATATCCGATCTGGATATGCTTTATATTATGCCCCCCAATCAGTATGAATAT<br>TATAACCGTAAGGATAATGGTCAGTCTGCATTGCTTACAGATGTCAGAAACATTCTGGCG<br>GAAGAATATCCTGACCAGACTGTGAAAAAGGACAGACTGGTTGTTCAGATCATCTTTAAA<br>AACTTTTATGTCGAGGTTCAACCTGTATTCAGACAGGATGATGACAGCTTTAAATTCCCT<br>GAAAGCTATAATGGAGGAGCATGGCGCATTACAAAACCTCTTCACGAAAAGGCGGCCATG<br>ACCGCATTTTCGCGAGATAAATCCAATAATCTGCGCAAGCTGTGTAAAATGATCAGAGCC<br>TGGAAGAACCTGCATGGCGTCAATATGGGTGGCTTACTGATAGACACAGACTAGCGTATCGC<br>TTTCTTTCATCAACATCAGATTATGACAATACCGGAAATGGCAGCCTGGGAGCCCTCGCC<br>AGAGACTTTTTTGAATATCTGTCAAATGAGGAGAGAAAGGAAAGGTATCTCGCGTTAGGC<br>AGTAATCAGCATGTACGTGTTAAATCTCCCTGGTTTGGCCGGGCAGCGAAACACGCGTAT<br>GAATTATGTTGTGATGCCTTAGACGCTGAGGGGGCTGCCAGTGAAAATGACCGCTGGCGC<br>AAAGTGTTCGGACGAGCCTTCCCCAGACGTAAAGTGGGTATTATGGAAGCCCGTCTTGGT<br>CTGGAATCGCATGCGGCAGATGCTGTTCCCTGGACCGATACCGAAGAGTTTATAGAGGAT<br>AAATATCCGGTGGATATCAGGTACTCACTCAACCTTGACTGTACCGTAACCCAGGATGGT<br>TTCCCTCCCAGAAGCCTGAGGGAGATGCTTACCAGAAGATTCCGCCTCTCCGCTCGAAAA<br>TCTCTCCTTTTCCGGGCAGACTTGACAGAAATGGAGGCAGAGGAACCCTACACCGTTATG<br>TGGAAGGTACTGAACGTGGGTGACGAAGCACGCAGAAGAAATATGATCCGGGGACAAATC<br>GTTTCGGACGGCGGCTACTGTACGAAGAAAGAAACTACCGACTTCCGCGGAGATCACATG<br>GTAGAATGCTATGTGATAAAAAATGAGGTTGTGGTTGCCCGGGCCCAGATTGAAGTTCCC<br>ATAAGCTGA |
| NTase033 | 100 | TTGGCAGATATCACAAAATCTATAAATCAATTTATCACAGAAGAAATAAAATTAGTACAA<br>GACGACATAAGTTCAGCTGTATCTAGTAGGAAATGGTTCTTGAATAAAATTGAAACTGCT<br>ATTCAAAATAGAGAAAATGAGCCTGTACTATACACTCCTAAAATTTTTAACTTTGGTAGT<br>TATTTTAAAGGTACAAAGGTCACCAATGTTGATGAATTCGATGTGTTAGTAGTCATTGAT<br>TCTAGCCCTGGTATATTTAAAGAAGGAGAAACTGTTATTGGGACAGGGGTAGGGAGTGCT<br>AATCCTAACCCTATTTATAATGAAAAATATAAAAAAAGTGATGGTTCGGGAGTTAGCCCA<br>AGTAAGTTGTTAAATTGGTTAAAAGGAATTACAGAAGAGGTTGTTAAAGGTTTTAATGGG<br>CAAGCGCCAGAAAGAGATGGACAAGCTATAACAGCAACCATAAAGTCTAAAAATTTAAAA<br>ATTGATTTGGTACCAGCGCTTAAATTTGAAAAAGATGATGGTACTGGTTTTTATGCTATT<br>CCTAAAGGAGATAAAGGGAATGGATGGATTAAAACTCAACCAAAGGACGATATGGACGCT<br>TTGGAAGATGCTGCAAAAGAAAAAGATGGATTTAGGAATGTAATTCGTTTATTGAAGTTT<br>ATTCGTGGTGAATATAACTTTAAAGTATCTTCATTTGCTATTGAATCAGCTGTTGTTAAC<br>TATAGCGAAACAGGATTGTGGGAAAATGATTTGTACATTGATTTAAAAGGTTGTTTAGGT<br>TATTTGGCACAGAACTTTAGAGATGGAGAAATAAAAAGTACCGTCGATAAAAGTGCTAAT<br>TTAATTAGCGGTGTAGAAAGCCTTGCTTCTTATGCTACTAAAATAGATAAGATTATAACA<br>GCACTTGGAAACTTGGAAAGTGAACAAGATCAAAAAGTTGCTAATGAAGAAGTGAGTAAA<br>ATATTTAAAAATGAATAG |
| NTase034 | 102 | ATGTTAAGATTTGGAGAGGGGGAGTTAGGTTTGGCAGATATTACAAAATCTATAAATCAA<br>TTTATTACAGATGAAATAAAGTTATTTCAAAAGATATAACTTCAGCCGTGAAAAGTCGA<br>GAATGGTTTTTAAGTAGAATTGAAAGTGCCGTGCAAAAAAGAACTAATGAGCTTACTCTT<br>TATAAAACACCTTTTGTCTATTTTGGTAGCTACTTTAAAAAAACAAAAGTTACTAATGTT<br>GATGAATTTGATGTTTTGGTTGTCATTGATTCTAATGATGGTCAATTTAGTCAAGGGGGA<br>GAAGTTATTGGAAAGGGATTAGGAAGTGCTAGTCCTAATCATAAATATGATAAAAAATAT<br>AAAAAAAGTGACGATTCGGGAGTTAGTCCAAGTAAGTTACTGAATTGGTTAAAGGGAATT<br>GCGGAGGAAGTTGTTGAAGGTTTTCATGGGCAAGCTCCAGAAAGAGATGGACAAGCCATA<br>ACTGCAACTATTAAATCTAAAGATTTAAAGATTGATTTGGTGCCAGCCGGTATATTTGAA<br>GAAGATGATGGTACTGTGTTCTATATCATTCCTAAAGGTGACAAAGAGAATGGTTGGATT<br>AGAACTCAACCTAAAGACGATATGAAAGAATTAGAAGATGCGGCAAATGAAAAAACTCAA<br>TTTAGGAATATAATTCGTTTAGTGAAGTTTATTCGTGGTAAATATAAATTTAAAGTATCA<br>TCGTTTGCTATTGAGTCAGCTGTTGTTAACTATAGTAAAACAACAACATGGAGAAATGAT<br>TTATATACTGATCTAAAAGGTTTTTTAAGTTATTTGGCGCAAAATTTTAGAACTGGAGAA<br>ATAAAGAGCACAATTGATGAAAATGCCAATTTAATTAGTGAAGTAGAAAGTCTTGTTTAT |

TABLE 2-continued

| Representative CD-NTase nucleic acid sequences | | |
|---|---|---|
| | | TATGCGAGTAGGATAGATAAGATTATAACGACACTTGGGGACCTGGAAGGTGAATTGGAT<br>CAAAAAGTTGTTAATGAAGCAGTAAGTAAATTATTTAAAAATGAATAG |
| NTase035 | 104 | TTGAGTGTAAATAGTTATTTAGAAAATCTATCTCATGAATTAATAATAAGAGATAATGAA<br>AAGGAAAATATAAAAAAATCAATAGAAGTTATTAAGAGTAGGTTAAAATCATATTTTGGA<br>AACAATATTGTAGAAACATTTTGTTTTGGCTCTTATACCAGAGGAACTATGCTGCCTAGA<br>AAAGTAAATGAAAATTCGGATGTAGATTACATGGTAGTTTTTTCAAATAGTTTTTTATAT<br>GCTCCACAGACTTTACTAAATAAACTTAGAGATTTTGTGAGAACATATTACTCTAAGTCT<br>GAAATATACCAGTCTAATCCAACAATAGTCTTAGAGTTGAATCATATAAAATTTGAATTA<br>GTTCCAGCATATTCTAATAATATGTATCTTTGGCAAGAAAATCACTATAGAATACCTGCA<br>AAAGCCTCTAATTATAACGACTGGATAGATACATGTCCAGATGATATTAATAGTAGATTG<br>ACTAGACTAAATGTTGAATCAAATAATAAATTAAAACCTGCAATACGAATAATTAAATAT<br>TGGAATTCTTTAAACAATAATGTTTATAGTTCATATGAACTTGAAAGTGCAATTTTAGAA<br>AATATGCATTGTTATTGGAGAACATCTATTCAGGATTATTTTACAGCTATAACAGAATCT<br>TTAATTTATAATTTCGGTACACCATCATGGAAGGTTGATAAAATCTCTTCTCTTAAAAAA<br>TGGTATAATCATGCATTAAAAGAAGAATATATTTGGAGAAATTATATACAATCTAATTTA<br>TATATGGAAAATATTTTACCTTCAATAAAATAA |
| NTase036 | 107 | ATGAGCGTACAATCACACATTGATAATTTAGCTAGTAAGTTAAATTTGAAGCAAGATGAA<br>AAAGACAAAATAGAAAAATCAATCGCTACTTTATCAGACAGATTAAACAGGTATTTTGAT<br>GGTGAACTTACGGATCATTTTAAATTCGGCTCATATACTAGGGGGACTATTTTACCTAGA<br>AAAGCAGATGAATACTCCGACGTCGATTATATGGTCATCTTCAAGAATCCAAACAATTAT<br>AAACCCCAAACGTTGCTTAATTATTTGAAGAGCTTTGTCAATTATTATTATCATAGTTCA<br>GTTCCAGCAAAAAAAGACATTTGGGGTAATATTTACATACCATCTCCATCATCTTCTTTT<br>GAAGAATGGATGAAAACCGATCCTAACGCTTTTAACAAAAAGTTAACTGATGCGAACGTG<br>AAGTATTTTTATAAGATAAAGCCGTTGGTGCGTTTAATGAAATACTGGAATAGGTTAAAT<br>GGAAGTTATCTTTCTTCTTACGAATTAGAAAATTGGATTGTTGAAAATTATTATTGGAAC<br>TGCAACAATCTAAAGGATTTTGTGTATAGTACCTTCGAAAAACTGAGCTATAACTATAGC<br>GATCCACAAGGTTATAAGGATAAAGTGGATAGAGCTAAAAAAATCATAGCTCAAACAAAA<br>GAATATGAAAGGAATAATATGCCATACTCAGCAGAAGCGGAAATAAAGAAGTTATTTCCA<br>GATTTTTAA |
| NTase037 | 110 | ATGGGCTCAGAGAGAATTATGACAACTCAACAGCAGTTTCTTGACCTACTTTCCGATATT<br>GAACCCTCTACAACAACGGTTAATGATTGTTCAAGCGCACATAATACGCTTCGTGATGCT<br>TTAAAAGTGCATAATGAATTCAGCAAAGTACATGTGCATACATTCTTATCAGGTTCTTAT<br>AAAAGAAATACGGCAGTACGTCCGACTACCATAGGCGGAATCACACAAAGGCCAGATGTA<br>GATATTATTGCCCTTACAAATCACACAATTAATGATGACCCTCAAATTGTCCTTGATGCA<br>GTACATACGGCATTAAAGGATATTGGATATACCGATCTTACCGTTAACCGTCGTTCAGTA<br>AATGTTAAGTTGAAAAAAGTTGATATGGATGTTGTCCCTATCATTTCAGATGGATATGGC<br>GGCTATCTGATTCCAGACATTCATCTTGAAGAATGGCTAGTTACCAACCCTCCAGCTCAT<br>ACCGAGTGGACTGTTGAGGTGAATAAAAATGCAAATGGTCGATTTAAGCCTCTTGTGAAG<br>CTATTTAAATGGTGGCGTCGTGAGAACTTGTCTGATTTAAAAAGACCAAAAGGATTCATT<br>TTAGAATGCCTGGTTGCCAAGCATATGAATTACTACGAATCCAACTATGAAAAGTTGTTT<br>GTTTATCTTTTAGAAACGATCAGGGATTCTTATGGGATTTATGCGTCACTAGGCATAATT<br>CCACATTTAGAAGATCCTGGTGTTGCAGGCAATAATGTTTTTTCTGCGGTTACAGCAGAT<br>GAGTTCAAAACTTTTTTTGAAAAGGTAGAAGAACAAGCTGCTATTGCACGAAACGCCTTA<br>AATGAAACAGATGATGATAAAGCATTAGCCCTATGGCGGCAGGTTCTGGGTAATCGTTTT<br>CCACGTTCGGCTTCACACAAAAGTGCAAACTCTGCTGATATGGCCAGCTCTTTAATCCGT<br>TCTGCTCTAGGTGCGGGATTAACATTTCCATCAACCCCTGTTTATCCAAATAAACCAGGA<br>GGCTTTGCGTAA |
| NTase038<br>aka Ec-<br>CdnD02 | 113 | ATGGAACTTCAACCTCAGTTCAACGAATTTTTAGCAAATATCAGGCCGACTGATACACAG<br>AAGGAGGACTGGAAAAGTGGTGCTAGGACATTGCGCGAGCGCCTAAAGAATTTCGAACCA<br>CTCAAGGAAATTGTCGTATCAACGTTCCTGCAGGGCAGCATTCGTCGTTCAACGGCAATC<br>CGTCCGCTCGGCGATAAGCGCCCTGATGTTGATATTGTCGTGGTGACCAATCTTGATCAC<br>ACCCGGATGTCTCCCACTGATGCAATGGACCTGTTCATCCCATTCCTCGAAAAGTATTAC<br>CCGGGTAAATGGGAAACTCAGGGGCGCTCTTTTGGTATTACCCTCTCCTATGTCGAACTG<br>GACCTGGTGATCACCGCCATCCCAGAGTCAGGGGCAGAAAAAAGCCATCTTGAGCAGCTC<br>TATAAGTCAGAGTCAGTTCTGACTGTTAACTCTCTGGAAGAGCAAACTGATTGGCGCCTG<br>AATAAAAGCTGGACCCCCAATACGGGATGGTTGTCTGAGAGCAACAGTGCGCAGGTAGAG<br>GACGCCCCCGCTTCAGAATGGAAAGCGCACCCGTTAGTGCTTCCTGACAGAGAAAAGAAT<br>GAGTGGGGCCGGACACATCCACTCGCGCAGATCAGATGGACCGCCGAGAAAAATCGTCTT<br>TGTAACGGTCACTACATCAACCTTGTCAGGGCGGTGAAATGGTGGCGACAGCAGAACAGC<br>GAAGACCTGCCGAAATATCCTAAAGGCTATCCGCTGGAGCATCTGATTGGAAATGCGCTG<br>GATAATGGCACCACATCAATGGCCCAAGGGCTTGTTCAACTGATGGACACTTTTTTATCG<br>CGCTGGGCAGCCATTTACAATCAGAAAAGTAAGCCGTGGTTGTCAGATCACGGGGTTGCA<br>GAGCATGACGTGATGGCGCGCTTAACAGCCGAAGATTTCTGTTCATTTTATGAGGGTATT<br>GCGAGTGCGGCGGAAATTGCCCGTAACGCGCTGGCGTCTGAGGAGCCTCAGGAAAGCGCA<br>CAACTCTGGCGCCAACTGTTCGGATCCAAGTTTCCTTTACCCGGCCCTCAGGGCGGCGAT<br>CGCAACGGTGGATTTACAACACCAAGTAAACCAGCAGAACCACAGAAAACCGGACGCTTC<br>GCTTGA |
| NTase039 | 116 | ATGTCGAATTTTCCGTCCCTGCGCCGCGATGATCGGCCTGATGATCCCTTTGCCGACCCG<br>CTGGACGCGGTACTCGCCGAGCTTGCCATCAATATTCAGCTTCCGCCCGGCCTGCATGCC<br>AAGGCGGTCGAGCGATATGAGGCGGTCCGACGCTACATCGAACGACCCGGTAGTCCGCTC<br>GAAGGCAGGGTCGCCTGCTTCTATCCCCAGGGCTCCATGGCAATCGACGCAACCACGTCG<br>ACCCGCGGCACGGACGACGAGTACGATCTCGATATCGTCGCCGAGATCGAAGGCCCCGAC<br>CTCGGTCCCGAGGCGCTGCTGGATGACCTGGAAGCCGCACTCGAGAGCTACCCGGTCCGC |

TABLE 2-continued

Representative CD-NTase nucleic acid sequences

| | | |
|---|---|---|
| | | AAGGTCGTGCGCCAAACTCGGTGCATCACGCTCTACTACGCCGACGGCATGCATCTTGAC |
| | | ATTACGCCGTCGCGGCGGCGGGCGCCGAAGGAGAAGGAAGGCGAGATCCCGCATGCGAAG |
| | | AAGGGGACTCGCAGCGACCCGGCGCGCTATGTGCCGATGAACTCATATGCCTTCGGGAAG |
| | | TGGTATTGCGCCCGAACGCCTACCGAGGAGCGGTTCGCGCTGGCGCTGAATCGTCAGCTG |
| | | TACGAACAGGCCGGAATCGCCTTCGCCGCAGCGGACGTCGAGGACGTTCCGCCGCAAACG |
| | | CCGCTCATCATCAAGAGCGTGACGACGGTCGCGCTGCAGCTAATCAAGCGGCACCGCAAC |
| | | ATCGCCTACGCGACCGAGACGGGCCGGATCCCGCCATCGGTGATGTTGTCGTGCCATGCC |
| | | GGCCATGCCGCCCGTCCGGGCATGAGGCTTGCGGAAATGCTGATCCGGCAGGCGCGCTGG |
| | | ACGGCCCGCGCGATCGACGACGCCGCGAAGCGCGGCCAGCTCCTGGTCGTGCCCAACCCC |
| | | GAATTTCCGGTCGAGCGTTTCACCGACCGTTGGCCAGAATCTCAGCTGCAACAGACAACC |
| | | TATTCTCGCCACCTGCACACCCTCGCTAACGGGCTCGAAGCCGCCCGCACCGGCGACGTG |
| | | CAGCTGGAGGACTTGCAGGAGTGGTTGCGCGGGCAGTTCGGGGACCGGGTCGTCACGCGT |
| | | TCTGTCAAAGCTTTCAACCAGCGGCTCGGGCGCCAAGTTCAATCACGGCAGCATGGTTAT |
| | | ACGCGCTCCGGCGGCCTGTTCGTTCCCGCCGCGCCGGCGATCATCGGCGCGGCGACCAGC |
| | | CTGGCGCCAGTCGCGGCTCGCGCACACACCAACATGGGAGAGCGCCGATAA |
| NTase040 | 119 | ATGACTACATTCGCATACCAGGGGAAGAACCCCTTTGAAGATCCGCTTGATCGCATCCTG |
| | | GCGGAAATCGCCTTCAGCGTTCAGTTGCCGCCGTTCCTCCATGGCAAGGCCTGCCAGCGC |
| | | TACAAGGCTGTGCGCGAGTACCTGGAAGGCACGACGTCGTTCCATGATCAGATCGAGCAC |
| | | TTCTATGTACAGGGATCGATGGCGATCGACGCGACTATCTCCACGCGCGGTACCGACGAT |
| | | GAATACGATATCGACATCGTAGCCCAGCTCGGCAGTCAATATCGTCACATGACGCCGCTC |
| | | GGGATCCTCAAGGCGCTCGCCGCGGCCCTGAAGGACTATCCAGTTCAGAAGATCGTTCAG |
| | | CAGACCCGCTGCATCACGCTGTTCTACGCCGACAACATGCATCTCGATGTGACGCCGGCG |
| | | CTTCGCGACTACGGCACCACCGATCGCCAGTCGGCGATCACCCATGCGAAAGGGCCGCTG |
| | | CCGTCGAATGACGACTGCATGGTACCGATGAACGCATACGGCCATGCGGAATGGTACATG |
| | | GCGTCGACTCCGAACGAAGAGCGTGTGATCGAAGCCTTCAAGGACCGCTGGTCCGGCGAC |
| | | GATCGTATGAGGATCCGCGCGGACGCCGATGTCGACGAAGTTCCCGATCAGACGCAGTTC |
| | | GTTGTGAAGAACATGGCAACCGTCGCACTGCAACTGCTGAAGCGCTATCGTAACGTTCGC |
| | | TATGCAAACTACAGTGGCCGCATCCCGCCGTCGGTGATGCTGTCGTACTTTGCCGGCGCG |
| | | GCGGCGCTTCCCGACATGAATCTCTCGGACATCTTGATCCGCATCTGCCGGTGGATCATC |
| | | GGCGAGATCGAGCGGGCGACGATCAACCGTCAGAAGCTTCACGTCGTCAATCCGACCTAC |
| | | AGCGCCGACGTCTTCACCGACCGCTGGCCCGAGAACTTGGATCAGCAGAACCAGTTCGCC |
| | | CGCTATCTCCACGATCTCGTGGCCGGCATCGAGCGCGCCAAGCGCGGCGAGTTGGACCCC |
| | | GTCAAGCTTCGCAACTGGCTGCGCGAGATGTTTGGCGACCGCGTGGTGACGCGCGCGGCT |
| | | GACAGAATGGCGGACGCCACCGGCGCTGGGATCGTGGCAGGGTCGCAGGTCTACAGCAAG |
| | | AAGGGCAGCATTCTCCTGCCGGCTGCGGCCACGATCGTCACATCGGTGGCTCCGGTCGTC |
| | | GCCAAGCCGCACACCTTCTTCGGAGATCCGGTTGATGAATAG |
| NTase041 | 122 | ATGAATAGCAAACGCACGCTTGCAAAAGCGTTCATGGAGAAGGTGGCTGCCGACCAGGAA |
| | | CCCCGGCAGTGGGAAGAGTTGATGGTGCAGCTCCTGTCGAAGCTCGAGCTGAGTGAGGAG |
| | | GAGCGGGGGCGCGCCTCCGGCCACTATGACACGCTCGCAAAGCAGGTCGCGCGCAAACTG |
| | | GGGGTCGGCGAAACCGATGTGCACATCGTCGTCCAGGGGTCGATGCGCACACAAACCACG |
| | | GTCGCGCCGCGGGGCCGAGAGAAGTTCGACCTCGACATCGTCGTGAAGATGGACGGCGAC |
| | | CGTTTTATCGGCATCGACCCCGACGAGTTCTTCAAGGAGTTCGGTGATTCGCTGCGTGGA |
| | | CTCAACAACGCGGCTGGCGACCCCAAGCCGAAGCCGCGTTGCTGGCGCCTGCAATACCCG |
| | | AACGAGCCGTTCTATTTCGATGTCACGCCAGCGCTGCCGGGCAGCTTTGACATCACGGGC |
| | | ACGGACCTGCGCGTTCGCGACCCGGACACTGGCTGGAGCCCTTCGAACCCCGAAGACTTC |
| | | GCGGACTGGTTCTGTGAGGCTGCTGAGCAGAAGTTTCAATTCCAGATGTTGCTCAAGGTC |
| | | GCGATGGACGCGCGACATCAAATTGAGGACGTCCCCTCGGACCCCGTGGCTATCGACGAC |
| | | ATCTTGCGCCGCACTGTGCAGCTCATCAAGCTGCATCGTGACCTGATGTACCACGGCGCG |
| | | TCCGATGGCGTGAAGGAAGGCAAGCCCATCTCCGTCATCCTCGTGACGCTGGCAACCTGG |
| | | GCGTATAACGATGTCTATCAGGACCGCCACCTCTATTCCAACGCAATCGAGGTTCTGCTC |
| | | GACGTTGTCGAGCGCATGCCCGAGTACATTGAGTTCGACGACGGCGTGTACACCGTGCGC |
| | | AACCCGAAGCATCCCGACGAGAACTTCGCTGAGCGGTGGAACGGGGACGACGGCGTGCGC |
| | | GCTAGCGCGTTTTACCGCTGGCACGAGAAGCTCCAGAGCGACCTGACCGCGCTGTTCTCG |
| | | GACTCGTATTCGCGCAGTACCGAGGAGCGCATCCGTAAAATCTTCGGGCAGCACGGTGTC |
| | | GATGCATGGAAAGCCAGCATCGCGCCGGCGACGAGCGGTCTGCTCAATTCGCTGATGAAA |
| | | TCTGTTCCCGGCGGTGAACGCAGGGACCCGGTAACGCCCGTGCCTCCCGGTAGCAGGAAA |
| | | GACACCCTCGCATGA |
| NTase042 | 125 | ATGAGTAACGAACAGACTAAACACCGCAGCTGGGAGTATTTTCTTCTCCGTGCAGCCCGA |
| | | AAAATTTCGTTATCAGCAGCTCAGTACAGCGTTATTGATGCTCGCTACTCTCAGCTGGAA |
| | | AAAATTCTTTCTGCTGCCGATGATCCCCTGCTGGCGGATGCCCATATTTTTCCCCAAGGT |
| | | TCTATGCGTCTTCAGACAACGATTAACCCGGTGCCTGGGGCGCCAGCAGATCTCGGGACA |
| | | ATTGATGCAGATGCGATTGTCTGGTTACCCCATGCCAGGGGGATCGATGCTCGGACTGTA |
| | | TTAGAGGTCATTGAACGTCGTTTCCAAGAGGGCAGTAGGGTTCAGGAGGATATTCAACAA |
| | | CTTCGTCGCGGTGTCAGGATTGTTTACGCCGATGAAAATCCAGGTTTCCACATTGATGTC |
| | | ACACCTGCACGTCCCTGCCATCACAATGAGCAAAGCGACGGACTGGGCATGCTCGAAGTA |
| | | CCCGACAGGGAGCACGGCTGGAAGGCAAGCAGTCCCATTCCTTATGCAGACTGGCTGCAT |
| | | GATGCGTCAAAGCAGGACATCATGCTTGAACATGTTGTTGAGTTTAATAAAAGTCGTGCA |
| | | GCAATGGACTCTGCGACCCAGGCCCCGCTGCCTGAATATAAAGAATATCAAAAAGATGAT |
| | | CCGTTACGTGCGAGTATTAAGCTGATGAAAAGGCACAGGGATGAATGGGCGATCAGGACG |
| | | AAAAATGAAGGATACCGGCCTATTTCGGCAGTTATCACCACGCTTGCGACTCACGCTTAT |
| | | CTGGATGTTGTCGCGCAGTCAGAATATACCGCCTTCACCCCTCTTCAGGCTATCCTAGCA |
| | | ATCGTGAACAGGATGCCTGACCATATTCACCGTTACAGTAATGAGTATTACGTCTGCAAT |
| | | CCTGAAGATAACGGCGAGAATTTTGCGGAAAAATGGAATCGTCCGGATGAAGGTTATAAA |
| | | TACGTTGATGCCTTTAACAAATGGCATGCGAGTGCCCGTTCGGCGCTGACGCTGGGGCTC |
| | | GACAGCCACGCGTCGACAGAAACCTTTGCGAAGGCGGTCCAGGAGCAGTTTGGTATTGGT |

TABLE 2-continued

| Representative CD-NTase nucleic acid sequences | | |
|---|---|---|
| | | CCGACATTCGTTCGCGAAGTTAACGAGAGCATTCCGGCAAACTGGACGATGCCCGGGCGG<br>CAAGACGGTGTGACTCGAAACTCTGTCTCAATGGGGTCTCTGTTCGGGAGTTCAGTCAGC<br>AGTAACCAGTCTCAGGCAAATGTTGCACCTGTCGGGCGACTCGGCTGA |
| NTase043 | 128 | ATGAATATGCTGAATATTCCATCTAAAGTTGACAGTTGGGAATACCTATTATTACGAGCG<br>GCACAGAATATATCGCTTTCAGAGTCGAAATATACCCAAATAATGGAACGATATAATCAA<br>TTAGAAAAAATCTTAACTGCATCTAACAACCCTTTATTAGCTGAAGCACATATTTTCCCT<br>CAGGGTTCTATGCGTTTGAGAACAACGATAAAGCCTGTCTTGGGAGCACCCGCTGATCTA<br>GGTACAGTTGATGCTGATGCCATCATTTGGTTGCCGAATGCACAAGGCGTTGAGGCCAGC<br>GTTATTTTAGAGGCAATTGAAGAACGTTTTAAAGAAGGTGCTCGTGTTCAAAAGGACATA<br>CAACCTTTACGTAGGGGAATTAGAATTGTTTACGCTGATGTTGACCCTGGTTTTCATATC<br>GATGTTACACCTGCTCGCGCTATAGATGGGAATGATGAGGAAAAAGGAGAGGGTAAATTA<br>GAAGTACCTGATCGTGTAACTGGTTGGAAAGCAAGTAGTCCAATACCCTATGCTAATTGG<br>CTCAAATATGTGTCGTATCAAAAGATAGAGTTGGCAATGGAAAGTTATGATTTGGTGAGG<br>AAACATCAGACATTTGATGCTGCAACACAAGAGGAACTTCCTGCATATTCTGATTATTCA<br>GATATGAACCCATTAATTGCAACGATTAAACTCTTAAAACGTCATAGAGATGAATGGGCA<br>ATTCGTACTGGTTGTAAAGATTGGAGACCGATCTCTGCTGTTATTACAACATTGGCGACA<br>CACGCCTATTCTGATGTAGTAAAGATGTCAGCTAGTAACCCCCTTAGACCTCTGGATGCA<br>ATTTTAGCTATAGTTCGAAAAATGCCAGATTATATTCAATATTTAGGTGGACAGTTTTTT<br>GTTTGTAACCCTGAAGATGCAGCCGAAAATTTTGCTGAAAAATGGAATAGGGTAGGTGAA<br>GGATATAAATATAAAGAAGCTTTTTTCAATGGCATACTAATGCTATGGCTTCTGTATCT<br>ATTGGGTTAGAAGATTTTAGTTCTTATGAATCATTTGAAGCTGTTATAAAGGAAAAATTT<br>GGTTTAAGTGGATCTTTCATTTCACAAGTGAATAGAGAAATTCCTCCTGATTGGACACAG<br>CCTGGAAGGGTTGAGGGAACAACTAGAAATGCAGCAGCAATTGGAATATTGTTTGGTGGT<br>GAATCAAATAGTGAAAACATTCAAAATACTGTTAAACCGGTAGGTCGTCTTGGCTGA |
| NTase044 | 131 | ATGTCCATGAGCAATGAACAGACCAAGCGCGGGAGCTGGGAGCACTTTCTGCTCCGCGCC<br>GCGAGGGAGATCTCACTGTCGGAAGCACAGTACGAGAAGATCAACGATCGATACTCCCAG<br>CTCGAGCAAATCCTCAACGCCTCCGACAATCCACTACTGGCGGAGGCGCATATTTTTGTC<br>CAAGGCTCCATGCGCCTGAAGACGACAATCAAACCCGTTTCTGGCGCTCCAGAGGATCTG<br>GACACCATCGATGCGGACGCCATTATTTGGCTCCCTCATGCACAAGGGGCTGGAGCTCAA<br>GAAGTTCTGGATGCCATTGAGGAACGCTTCAAAGCTGGCAGCCGCGTCCAGGAAGAAATC<br>AAGCAGCTACGCCGGGGCATCCGGATCATCTATGCCGATGAAAACCCCGGATTCCACATC<br>GATGTCACACCGGCGCGTGCCATCAATGGGAATTCTCAGGGCAATGGCGAAGGTAAGCTG<br>GAAGTGCCAGATCGGGTAACTGGCTGGAAGGCGAGCAGCCCGATCCCCTACTCCAACTGG<br>CTGCAAGTGGCTTCAAAACAGACGATTTCGTTGGAGCATCTGGCCGTCGCAAAAAGTCAG<br>CGTGCCTTTGATGCTGCCACTCAGGATCCCCTGCCGCAGTATGAAGACTACCTCGATCAA<br>GACCCACTTCGGGCAACGATTAAGCTGCTGAAGCGACATCGAGATGAGTGGGCCATCCGT<br>ACCAAAAATGCAGACCATCGCCCGATTTCGGCAGTCATCACCACACTCGCTACCCATGCC<br>TACCTTGAAGTGGCGAAAGAGTCTCAGACGGCGCCGCTAAAGCCGCTGGACGCCATCCTC<br>GAAATCGTCCGGCGGATGCCGGATCACGTCAAACGCCAGGGGAATGAATGCCTGGTTTGC<br>AACCCGGCGGATAACGGCGAAAACTTCGCTGAGAAATGGAATAGGCCGCTTGACGGGCAC<br>CGTTACCGCCGCGCATTCGAGGAGTGGCATGAGAATGCCAGCGCATCAGTGTCACTGGGG<br>CTTGAAAGCTTCGAATCCGCAGAGGCTTTTGCCAAAGCAGTGAAGGAAAACTTTGGCATG<br>GGCCCTACGTTCATTTCGACAGTGAATAGCGAAATCCCTTCCAATTGGACGATGCCTGGC<br>CGCCCGGACGGAACCACCCGAAACTCCACGTCGATGGGAGCACTGTTTGGTGGTTTCAGC<br>GGAACAGCGAGCTCTCAAGAGGATGTGAAGCCAGTTGGGCGTCTTGGTTGA |
| NTase045 | 134 | GTGCAGACGCCGCAACGGCGATCTACCTTTTCGCACCGCGCGGCGACGCAGTTCTTTCAC<br>CTTGCCGATACGATCGCGCGCTCGCACGAACCTACGTCGACGCAACTGTTGGCGCTCGAG<br>TCCTCCTACATCAGCACCGCGGAGTATCTTGCCGAGAGTGACGAGTTCGCCGGTCTGACG<br>ACGAACATTCATGGCCATGGCTCGAGGGCACTGGGGACGTTGCTCAGGCCGTCGGATGAA<br>TCGCGTGAAGGTTTCGACATCGATCTCGTCGCGCGACTCGATCAGCGTGCCATGTTGAGA<br>TACGGCGGAGACGGTGGCCCAGGATTGCTGCTCAACCACCTGCATGCAGTCCTGTCACGA<br>TATGCGAGCGCACATGGTCTGAAGATCAAGCGTTGGGAACGGTGCGTCACGCTTGAATAT<br>GCAAGCGGCATGTTCGCCGACATCACGCCGGTTGTCCACGATCCGCTATCTTGGGCCCCG<br>TACGGCGACACGCACGGCCGTGTCCCAGATCGTCAGTTGCGGACCTACGAACCCACGAAT<br>CCGCGCGGGTTGACCCGCAGCTTTGCGCGTGCAGCATCGATTGTGCCGGTCTTCACTGCC<br>GTCGAGCATCTGACATTCGCGGCCGATTCCGTTCGCAAGTCCATTTCCCCCCTTCCGAAG<br>GCCGACGAGGTTTTCGAGCGATTGCTGAGCCGCCTTGTACAACTGCTTAAACTGCATCGG<br>AACGTAGCGTTCGGGAAGGCTACCGGTCACGAGGATTTCGCGCCCTCGTCCGTGTTTATC<br>ACCACGCTCGCAGCTGCAGCCTACGTCGACCTGGCTCCGAAACCTCATTCCACGCCGCTG<br>GATCTTCTGCTTGATATCGTCGAGGCGATGCCGCGGTATTTCACGCGGGAACGCGATTTC<br>GGTGGCCGGGAAGTCTGGTACCTCCAGAACCCGTCGTCGCCTTACGACAACCTCGCGAGC<br>AGCATGAATATGCGTGAGCGGCAGGGCGCATTTGACGAGTGGCATGCTCGAATCTGTCGA<br>GATCTGCGTAGGCTCGTCGACATGATCGAAGCAAACGCCGGCCTGGACGCCGTCGTTCGC<br>ATCGTGCTCGCTGTTTTCGGGGAGCGCGCGCGAGCGGAAATTCTCAAGGATGATCGGGCG<br>CGACGGGAAGCGGGCCGGAAAGCAGGGCGCGTGGCGATCATGGGCGGCAGCGCGGCCCCA<br>TCTTCCGTCATCGCAAAATCGAAGCCGCATACCTTCTACGGTGATTGA |
| NTase046 | 137 | ATGCAGAACCTTTTTTCAAAGAATAATTTACTTGATGACTTGCTTCAACGTATAGGGACT<br>AAGCTTCAGATAGGTAAAACACAACGAAAATTGGCAGAAGATAGATATAACGCTGTCGGA<br>ATATGGTTATCAAAAGACGATGACTTTTTTAACAATGCTAAAATTGAAATCTATCCCCAA<br>GGTTCTCTAAGCATAGGTACAACAGTAAAACCGTTGTCTAAGCAGGAATACGATCTGGAC<br>TTGGTTTGTCAAATTAATGAAAACTGGCAAGGCAAAGATCCATTACAATTATTAAACTCC<br>ATTGAAAAACGCCTTAGAGAAAATGAAATATACGATAAAATGATTGAAAGAAAAAACCGT<br>TGTATTCGGTTAAATTATGCAAATGAATTCCACATGGATATTTTACCAGCTCATCCTCTA<br>GATCATTCTACTAGCACAAACGTTAAGGTTCCCGATAGAAAAGCTAAAAATTGGAAAGAT |

TABLE 2-continued

| Representative CD-NTase nucleic acid sequences | | |
|---|---|---|
| | | AGCAACCCAAAAGGCTTTTCACAGTGGTTCAATGAACAAGCTTTACAATACAACACAAAA<br>TTGTTTGAAATACGTGCTGGAATCGAACCATTGCCTAGTGAGGACAATGTGGAGAGAAAA<br>CCCCCCTTAAAACGGGCAGTTCAATTAATTAAACGATATCGTGATATTTATTTTGAGAAA<br>GATCCAGATTCAGCACCAATAAGTATTGTTTTAACTACCTTAGCTTGCAATTTTTATTCT<br>GAGCAGATTTCAGTAAATGAATCAATTTCACACATTTTGAATTCCATTCTCTTAAATCTT<br>CCCAAAAATGGCAAAAGATTAAAAGTTACAAATCCAACTAACCAGAATGAAGATTTAAGT<br>GAACGGTGGATTGGACATCCAGAATTATATCAAAAATTTGTTGAATTCATTCGCGTTTTT<br>AACAAAAAGTGGCAAGGTTTACAGAAAAAAACTGGGATCTCAGAAATCAACGAGGAACTT<br>AAATTCATGTTTGGCGAAAAAGTTGCTACTGAATCCTTAAAAGATCAAACAAAATTAATA<br>TCTGATATGAGAGAGAATGAAAAACTTGCGGTTACACATACTGGATCATTTGTTGCAGCT<br>GCTAGCAATAAAAAACCAACAACAATAAAAAGGAATACATTTTATGGCATATAA |
| NTase047 | 140 | ATGTACGGTTCCGCTACCGCCAGAAGCCTGCCGGCAGGAAAAAAGCAGCGTATCGCCGAT<br>TTATTATCGCAAATTATTGAAACGCTGGATCTCACCAAAACCCAATACGCCAACATCAAA<br>AGCGCCTATAACGGGGTCGGCACCTTCCTGTCTGAAGGCGACGATCCGCTATTGCAAGAT<br>GCCGTTATTTACCCGCAGGGCAGCGTGCGGCTCAACACCACCGTTAAGCCCAAAAATGAA<br>GAGCAATACGATATTGACCTGATTTGTTATCTGCCCCATGCCACCCAGGCGGATTATACC<br>GGCGTAATATCGGCCATTCGCCGGCGACTGGAGTCGCATAACACTTATAAAGATCTACTA<br>AGCGATTTACCCCGTGGATTCCGTATCAACTATGCCGGAGATTATCATCTGGATATCACG<br>CCGGGCCGCGAACACACCGGCGCACAACATCCGGGCCAGCCGCTGTGGGTCGTAGATGCG<br>CACACCGCCTGGAAGGAGTCCAACCCCAGCGGCTACGCCGAGTGGTTCGATAGCAGCGCC<br>AGCGTGCAGCCCCTGCGCACCATTCTGGTCATGGATTCCGCCAGCCGCGTGGGCACCGAG<br>GCGCTGCTCCCGCTGCCGGACAGCACCGACAAGAAATTGCTTAATCGCATCGTACAAATT<br>CTCAAACGCCACCGTGACGAATGGGCCGCCGAGCAGGATGATGTCCGGCAGCGCTGCCGC<br>CCGATTTCGGTCATCATCACCACGCTGGCTTGTCATGCCTACAACCACATCATTGCTGAC<br>AGGCGCTCCTACGACAACGACCTGGATATTCTGTTAGACGTGCTGGAACTGATGCCGGAT<br>TTCATTGTGTCGATACAGGGAGAAATACAGGTCAGCAACCCGCACATGCCGGAGGAAAAC<br>TTCGCCGAGAAGTGGAACCGCTCAGAGCAGGATGAGGGGCCTCAGCGCAGTGAAACCTTT<br>TACCAGTGGCATGCCGCGGCCCAGGCGACGTTTAACACCATCGCCGCCAGCGTGGGGGAA<br>GACAACCTGTTCCTGAGCCTCGAAGACGGCTTCGGCAAAAAGCCGGTCGATGTCGTCAGG<br>CAACGTCTGATGGAGCATATGCAGTCGGCCAGAGAACAAGGCAGCCTGCAACTTGATAAG<br>AAAACCGGCGGGCTGATCGCCACCGGCCTCGCCAGCACGGCGGCCCAGGCCGGCGTGCCT<br>AAAAACACCTTCTACGGTGAATAA |
| NTase048 | 143 | TTGCGCCAATCGCAACTGGTGGACCTGATCGAAGAGGCCTGCCAGCATCTGGAGCCATCC<br>GCCCACCAGCGTGACCTCGCGAAGCAGCGCTACGAAGGCGTCGGCGAGTGGCTCGCTGCG<br>GCCGACGATTGGCTCTTGACCTCCATCGCGATCCGTCTCCAGGGCTCGGTCGCCATCGGC<br>ACCACGGTGAAGCCGATTGGAAAGAACGAGCATGACGTCGACCTGGTCGCCCATGTTGCA<br>GACCTCGACCTTACGGTGTCGCCAGCTCTGCTGAAGCAACGTATTGGAGACCGTCTCCGG<br>AGCAACGGCCACTACGCTCCCCTCTTGGTGGAAATGCCGCGCTGCTGGCGTCTTGACTAT<br>GCCAACGAATTCCACCTCGACATCACCCCCTCGATCCCGAACCCTGAATGCCGCTTCTGC<br>GGCGAATTGGTTCCCGACAAGACGCTGAAGACGTGGAAGGCATCAAATCCGCAGGGCTAC<br>CGCGCCAAATTCGAACGGCGCGCGGCCCTGCTGCCTCGCATCAGATCCGTGTTTGGCAAA<br>GCCTTTGACAGCGCACATGCCAACGCACAGGTCGAGCCGTATCCAGAGGAGAAACGGCTC<br>AAGGGCATCCTGCGCCGCATCGTGCAGATCGCCAAGCGCCACCGTGACATCCATTTCATC<br>GACGACGACCAAGGGCTCGCCCCGCTCTCGATCATCATCACGACGCTGGCTTCGCGGGCC<br>TATGAAACGTGCGTCAGCAACTTCGAGTACGATCACGAACTCGACTTGATCGTTGACGTG<br>CTCCGCCGGATGCCGCAGATGCTGCAGACTAGCATGAGCGAGGGTCGTGTGATGTGGTGC<br>CTGTGGAATCAGACCACTGCCGGCGAAAACTTCTGCGAAAAGTGGAACAGGCATCCCGAG<br>AGGGCGACGGCTTTCTTCGAGTGGCACAGCAAGGTTGTTGCCGACGTTGAACACCTTGCC<br>GCTGCACGGGGTCTCGACCAGGTGCGGCGGGGCCTCGGCGATATCTTCGGTACGGCACCG<br>GCGAACAAGGTGATGGACACCTTGACAGAACGCGTCGACATAGCGCGCCGCACCAACCGC<br>CTCTTGGCCACCCGGTCGGCAGGACTGATCATGAGCACCGCGGCGAGCGCGACGCCGGTT<br>CGCGCCAACACCTTTTTCGGCGACGGTCCGTAA |
| NTase049 | 146 | ATGAATCAGATGTTCACGGCGCCTCCCCAGACGCATCTGCTTTTGCGCAAAGCCGAGGTT<br>TACTCGCTCCTCGATCAGATTTGCCAAGCGCTGGAGTTGACCGCTGCTCAGCTTGAGGCT<br>GCGCGGACGAGCTACGAGGCTGTCGCGGAATGGCTCTCCGGGTCGGACAACCCTCTTCTG<br>AAGTGGATCGATATTTATGCTCACGGCTCGACCGGCCTCGGCACGACGGTCAAACCGATC<br>GGGCGCGAAGATTTCGACGTCGATCTCATCTGCAAGGTGCTGCGCTTTACCGCTGACCGG<br>CCACCGGCAGAGTTGAAACGCATTGTCGGCGATCGCCTGAAGGAGAACGCGCGCTACGCT<br>GCCATGCTCGAAGAGAAGAAGCGCTGCTGGCGCTTGAACTACGCACGCGAATATCATCTC<br>GACATCTCGCCGACGATCAACAATGCCAAATGCGCCAACGGCGGCGAATTGGTTCCCGAC<br>AAGAAGCTGCGGGAATTCAAACCGACGAATCCGAAAGGCTACAAGGCGCTCTTTGAACGC<br>AGGGCAGCCCTAATCCCCACCTTGCGGATGCAAAAGGCTCTCGCTGCCGAGGACCGTGCG<br>GCCGTCGAGCCCTTCCCTGTGCATGGCACCGCCAAAGGCATCCTGCGGCGGACGGTGCAG<br>ATCCTCAAGCGGCATCGTGATGTGCATTTCCTGGAAGTCGTCGAGGAGATCGCACCGATC<br>TCCATCATCATCACCACGCTCGCGGCACAGTCGTATGAGTATTGCGTCAAGAGCTTTGTT<br>TTCGATTCCGAACTTGACGTTCTGATCGCGACCATTCGGTTGATGCCACACTTCATCGAT<br>AAGCCGGTCGTCAATGGTCGGCGGATCTATGTGGTGGCCAACGAAACCACGGTCGGCGAG<br>AACTTCGCCGAGCGCTGGAATACTGAGCCGGCTCGCGCCGCCGCCTTCTACGAGTGGCAT<br>GCGAAGGGACTGGCGGACTTCGAGGCCCTTCCGGATTTGCAGGGCATCGACGTTATCGGC<br>AAGAGCTTGGAAGGAAGCCTCGGGAGTTCGGTCGTTCGCAAAGTTATCGATGCTCGCACC<br>GACAGCATTTCGCAGGCACGCACGGCCAAGAAGCTCTACGTCGCGCCGACGGTCGGGCTC<br>ACGCTGTCCAGCGCGGCCAATGCGACGCCGGTTCGCTCCAACACGTTCTTCGGTGACTAG |
| NTase050 | 149 | ATGGACACCATGGAACAGATGCTGTCGATGCTGCTCAGCGGCGCCGTCGAAACCCTCGAC<br>ATACCACCGCATCTCCAGGCCCTCGCCATCGCCAGCTATGAAGAGGTCGGGAACTGGCTG |

TABLE 2-continued

| Representative CD-NTase nucleic acid sequences | | |
|---|---|---|
| | | GCCGAGCATGGCGAACACCGCTGCCGGGTATACCCGCAAGGCTCATTCCGCCTCGGCACA<br>GTCGTGCGGCCGCACAGCCTCACCGGCGACTTCGACATCGACCTGGTCTTCTTGATGCTC<br>CTCGCGAAGGAAGCCACCACCCAGGCGCGCCTCAAACAAGACGTCGGCGACCTCCTACAC<br>AGCTACCTGGACTGGAAAGAACGCAACGGGCACCCTGGCGGGCTGAAGACCTGCGAATCC<br>CGACGGCGCTGCTGGACACTCGATGACCCCGTCAACGGGTTCCACCTCGACGTCCTGCCC<br>GCAATCCCCGATCTCGAGTACCTGCCCACCGGCATCCTGCTGACCGACAAAGAGCTGTTC<br>CACTGGCAGCACAGCGACCCGATCGGCTACGCCAACTGGTTCCGGAGACGGTCACAGGAG<br>CTGCAGAACAAGGTGATCACCGCAGCAGCCCAACGCGGCGTCGACGTGGAGGACGTCCCC<br>ATCTGGGAATTCCGCACCACCTTGCAGCGCGTCGTACAGGTCCTCAAGTGGCACTGCATG<br>CTCTACTTTGCCGACGATCCCGACAACCGTCCTCCCTCGATCCTCATCACTACACTGGCC<br>GCCAAGGCCTACCGCGGGGAAACGGACCTATTCACTGCCACACGTAACGCGCTGGCCGGC<br>ATGAACCGCTACATCGAGGACCGCAACGGCGTCAACTGGGTCGCCAACCCCGCCCACGAG<br>GAAGAAAACTTCGTCGACAAATGGAAGGAGTACCCGGAACGCCGAAAGGCGTATTACGCC<br>TGGCAACGCGACCTCGCCGACACCCTGGACGACGCACTGAGCCTGCGGGGCAAGGGATTG<br>CAGACCGTCGCCTCCCAGCTCGCGCAGAGCTTCGGCGCTGAGCCCATACGGCACTCGACC<br>CTGAAATACGGCCAGCGGATGCGCGGCCACACCACAAACCGATCACTCCGCCTCGGCACC<br>ACCGGACTGCTGGCACCCAGTGCGACGGGGATCGCCGTCCCTCCCCACAACTTCTATGGC<br>CAGCACCCCGACCCGAGCCATTAA |
| NTase051 | 152 | TTGGAAAATATCATTATTGGAAAAGAAATTAAAGAATTAATTGAAGAATTAGATGTTTCT<br>GATTCTGAATATGAAGAAGCGACAAAAAGATACAACTCAATTGCTGAATATATAAAAAAT<br>TCAGAACTCGATTCAGAAAAGCCTGATATATATTTGCAAGGGTCATTTAAACTTGGAACA<br>GCAATTAGACCTCTGACGGAGGATGGCGCTTATGATATTGATATAGTTTGTAATTTTACG<br>AAATTAAAAAAAGAAGATCAATCACAATCTTCATTAAAATATGAATTAGGGAAAGTAGTA<br>AAGCAATATGCTAAATCTAAATCGATGTCCAATGATCCAAAGGAAAGTAAAAGATGTTGG<br>ACATTAAAGTATGTTGATGATAACAATTTTCATATTGATATTTTACCGTCTGTCCCATTA<br>CATAATAAGGATGATGAATATATAGCTATCACTGATAAAGCTAAAGATAATTATTTTGAA<br>ATATCTTCAAACTGGGAAACAAGCAATCCCAAAGGATATGCTGATTGGTTTAGAGAAGTA<br>TCAAAGTACACTGTATATCAAGAAAAAATTGCTAAAAGATTTTATGCATCTATTGAGAAG<br>GTACCTGAATATAAGGTTTAGAACGCCTTGCAAAGAATTGTTCAGATTTTAAAAAGGCAT<br>GCAGAGATTTGTTTTGAAGATGATATTGAATTTAAACCAGGCTCTGTTATCATCACAACA<br>CTGGCAGCAAAACAGTACCGGCTTGCAAGTTCTATTCACAATGATTTTTGGGATGTTATA<br>AGCTATATTATTAACCATTTGAAAGATGGTATAGAACTCCGTAATGGTAAACCTTGTGTT<br>TATAATCCAGTGAACTATTCAGAAGTTTTATCTGGTAAATGGGATAAAGATAAAAGATAT<br>GTTGAAGCATTTAATAATTGGTTGAAGCAATTGGAATCAGACTTTAATATTGGGAATGAT<br>GAAATAACATATCCTAATCGAATTCAATACTTGAAAAGGTCTTTATTCAAGAATGCTAGA<br>AGTCAGTTTCCGATTATTAATGTAACTTCACTGAGACATCATCAAAAGTCAAAATGGACC<br>GAATGTCTAGTAAAGGATGTATTTGTTAAGGCCATGTATTCTCAAAATGGATTTAGATGG<br>AAAACAATAAGAAGTGGGACTGCATTAAATAAGCATGGTGATTTAAAATTTGAAGTGAAA<br>GCTAATGATTTAAAGCAATACGAAATTTGGTGGCAGATTACTAATACTGGTAAAGAAGCG<br>GAAAATGCAAATTCATTGAGAGGGGATTTCTATAGCTCTGAATTGATTGAAGGAAAAAAA<br>ATAAAAAAAGAAAGCACTCTATATACTGGACGTCATTTTGTGGAAGCATATCTTGTGAAG<br>GATGGTATCTGCTTTGGGAAGAGTCAACCATTCGAGGTAAATATCGTAGATAATTTTACT<br>CTTGATTTTGCAAGGTGA |
| NTase052 | 155 | ATGCCAACAAAAAACGCCGAAGATTTTCTCACCGCACTAGCCGAGGAACTTGCAATCAGT<br>GACTCACGATACGAGCAGGCATGTCGGAGCTATACATCACTTGGAGAATGGCTTCACCGT<br>CCGGAGTCCGCCGTTGCCAAATACGATCCACAAGTTTACGTACAGGGTTCATTCCGACTG<br>GGTACAGCGATTCGTCCTTTGAATGATGCGGAGGAGTACGATGTAGATTCTGTTTGCTTA<br>CTCCAAAGCCTCGGTACCAAGGATCTTACTCAGTATAATTTAAAGACTCTGGTCGGGGAT<br>GAGATCAAAGCTTATCGTAAAGCTCAAAATATGGTTAAGCCCGTTCGTGAAGGCCGGCGC<br>TGCTGGGTTCTGGACTATGCAGACGGCGCCCAATTTCACATGGATGTCGTCCCCTCTCTC<br>CCTAACGCTACCCAGCAACGTATATTACTTGAGACTTATGGCTACGATCTCAAATGGTCC<br>GAGACAGCAATGGTCATTACTGATATCGAATCTCCTGTTTACCAGGTGCTTTCTGATAAT<br>TGGCAGCGATCAAATCCCAAGGGATATGCTGAGTGGTTCAAAATGCGGATGAGAGATGTT<br>TTTGAACAGCGGAGAAAAATGCTTGCGGAATCAATCAAAGCTAGTGTCGAGGAGATTCCT<br>GACTACAAAGTTCGGACCCCGCTCCAGTCAGCGATAATGATCTTGAAACGCCACCGTGAC<br>GGTATGTTTGAAAAGCGTTAGGACGAGCGCCCTATATCGATCATTATTACTACCCTTGCC<br>GCGCATGCTTATAATGGTGAAGTAAAGATAGCCGATGCTCTCTATTCAATCCTTTCTCGA<br>ATGGACTCGTTTATCGAACGTGATGGGGGTCGTTATATCATTCGTAACCCTTCCGACCCC<br>CTCGAAAATTTCGCGGATAAATGGCCGAATCATCCTGAGAGAAAAGATGCTTTCTACGAG<br>TGGCTCGACCAGGCTCGGCAAGATTTTGGAAATTTAGCACATCAGATTGAAAAACGCCGC<br>TTAGTTGAAAGCGTCCGACCTCATATGGGAGCGGTAGCAGACAGAGCTGCAACACGCCTT<br>AGCCCTACGCCAGGATCAATGTTGCAACCAGCAACAGGAGTTGCAGCTCTGGGTGTTGTT<br>GCAGCGAGCACACCGGCATTTCCAAATACTCGTCGGGAGCCAACTTCACCAAAGGGGTTT<br>GCATGA |
| NTase053 | 158 | ATGAGTAATACTAAAAGTAACGATGTTCTAAACACAATTCTGGAAAAAATTGAGCTACCA<br>GACAGTGCTTATGAAAAGGCTGAAAAACGCTATAAGGATCTAGGTGATTGGTTACATCGC<br>CCAGAGTCAACATGCGTGAATTTTGATCCCCACGTGTTTTCTCAAGGTTCCTTTCGTCTA<br>GGTACGGCGATTAGGCCCGATTCAGAAGAACAGTATGACCTAGACATGGGGTGCAATCTT<br>CGGCGTGGCCTGGATAAAACGTCTATCACTCAAAAGCAACTAAAGCACCTAGTCGGTCAT<br>GAATTAGAGCTTTATCGAAACGCCAGAGGAATTAAGGAAGAGCTAGCCGAGAAGAAACGC<br>TGTTGGCGCTTAGAGTATGCCGATGGGCTTAGCTTTCACATGGACATAGTTCCGTGTGTG<br>CCAGAGAGTGATACAGGAAGAGGCCTTTTGAAAAAGCTGATGGTCGAAAACTCTAAGTTT<br>GATGAAAACTTGGCTCAAAATGTGTCTCAGCTTGCAGTTTCGATTACCGACAACACAGAT<br>TTCACTTATGCAGTTGTGAATGAAAACTGGCGTATCAGCAATCCTGAAGGATATGCTCGA<br>TGGTTTGAAACGCGCATGAAGACGGCACGGTTAGTAATAAACGAACGTGAAATGCGATTT |

TABLE 2-continued

Representative CD-NTase nucleic acid sequences

| | | |
|---|---|---|
| | | AAAGCCAGTATAGATAGTCTGCCATATTATCAATGGAAGACACCCTTACAGCAGGTTATC<br>CAATTATTGAAGCGTCATCGTGACACTATGTTTAAAAACAATGAGGATAGTAAGCCAATA<br>TCGGTAATCATCACTACATTGGCGGCTAAATCATATAAAGGTGAAAGTGATTTGGCTTCA<br>GCGTTGAATACGGTGCTCTCCGAGATGGATGACCATATTTCTGCACAAGCGCCAATGATT<br>CCGAACCCAGTCAACCCAGCCGAAGATTTTGCAGACAAGTGGTATGACGAAAAATCTGCT<br>CAATACCGATTACAAGAAAACTTTTATAAATGGCTGTATCAAGCTAGAGCTGATTTTAGT<br>GCTCTTTGCTCAAGTGATGATACGCAACGAATAGTAAATGCGGCGCAAAATGGTTTGGAT<br>TTGAAGCTTGATTCAAGTTCGGTAGCACGTCTATTGGGTATTCCTGCGGTGACAGCAAAA<br>CCAACTTTCGCAATTCAATCATCTGATCCAAAGCCATGGTTTAAGCAATAG |
| NTase054 | 161 | GTGCAAGATCAAGGTTTCAAATCACTAAGACAACTAAGTGCAAGCGACAAAGAATTTTGT<br>TTCGAGATGATCTCTCATATCACATCGAACCTAGACTTGACCGAAACACAGTTGTCTCAA<br>TTGAAGACGGCTTACCGAGCTATCGGATCCTACTTGGCAAACCAAGGGGGCGAACTAGCG<br>GAATGCCACATTTATGCTCAAGGTAGTGTTGGTATTGGCACATCCGTAAAACCGATTGAT<br>GAAGACTCAGACATGGATATAGATCTCGTGCTGCACTTACCAAGTCAGCACTATCCAACA<br>ACTACTGATGAAGCCAACGAGCTACTCTTCAATTTGATACGAGTGCTGAAAGACTCTCAA<br>CGATACGGTGACAAAATAGAGAATATGCCAAAACGCAGATGTGTCACTCTGCAATATGGA<br>GGTATCGAAGGCCAGGGGTTCCACATGGACATCACCCCTAGCATGCCTGAAGATATGGAC<br>TCGCCAAACCATAAGAGCAAAGTAAGAGTTGCAGACATCAAGGATGCCAATAGTCCTTCT<br>CATCCATACGGATATAGGAAGTGGTTCCGAAGCGCGTGTAGTAAAGAGATTCGCTGGAAT<br>AGAAAAAGCAACTACAGATCTAATAATGATATATATGCGGGGACAGTAGAACCGTTACCT<br>GGTCAGGGTCGAAAGACTGTACTTCAGATTGTAGTTCAGCTTCTCAAGCGACATAGAGAC<br>ATGTGGAAACAAAATAAGCAGAACGTTTATGGCGATTGCGCTCCAATAAGCATAATTATT<br>ACGACTCTAGCAGGTCTAGCTTATGAAAAGTGCTCAAACTCTAACAAGGAATACTACAAC<br>CCATTTGATCTGATGTTAGATGTACTTGAAGAAATGCCAAACTTCATTTCCCATCAATAT<br>CAGTCTAACGGTACTGTAAAGTACACTATTCGCAACCCAGCACTTCCTACGGAGAATTTT<br>GCAGATAAATGGCATGAGAAACCGATGTTACCCCAAGCATTTAAAGCGTGGTATACGCAG<br>GTTACTGAAGACTTAGCAAAACTACTTGAATTAGATCAAGGGCTTGATAAAACCATTGAG<br>CGATCAAGAGAAATGTTTGGTTCTCAAGCAGCAAGAGGAATCCAAGCCAAACTTGCGGAC<br>ACTCTGACTGAACGACGAGCTAAAAATCGTGCGGTAGTTTCTTCTATTGGCTTAGGAGTA<br>TCCAATGCAGCCACTGCCACCCCCGTTCCTAAACACAACTTCTACGGTGATGTATAG |
| NTase055 | 164 | ATGTCCATTTCCGAAGCGCAATTGGAAACCTGGTCGCACCAGGGGGCCATCCGTGGGTCG<br>AGCCTGACCTATCAGGCGATCAAATCCACGCTGGAGAACGCGGACAGTCCCTATGCGGGC<br>AAGAACATCGAGGTATTCCTGCAGGGCTCCTACGGCAACGCCACGAATATCTACGCCGAG<br>AGCGATGTCGACGTGGTGATCCTGCTGAAGGACTGCTTCCAGCAGGACCTGAAGGCGTTG<br>AGCGAGGAGCAGAAAACCGCTTGGAGGGCGGCGTATCACGATGCGGTGTATGCGCACCGG<br>GATTTCAAGAAGGACGTGGTGTCGGTCCTGAGGGATGCCTACGGCGGTGACGTCACGGTC<br>GGCGACAAGGCGATCGCCATCGCCGCGCGCGGCGTGCGCCGCAAGGCGGATGTGATCGCG<br>GCGATTGGCTACCGGCGCTACTACCGCTTCAACGGCCTGCGCGACCAGTCCTACGACGAA<br>GGCATTTGTTTCTACGACGCGGCGGGGACGCGGATCGCCAACTATCCCAAGCAACACGCT<br>GAGAACCTTACCGCCCAGCATCAGGCCACCCAGCAGCGGCTCTAGCCGATGGTGCGGATC<br>TGGAAGAACCTGCGCAGCGCGCTGGTCGAGGCGGCCGCGATCGAGGCTGGCGCCGCGCCG<br>TCCTACTATCTCGAGGGCCTGCTGTACAACGTGCCGGTGGACAAGTTCGTCGGCAGCTAT<br>GGGGATACGTTCGTCAACGTCTACAACTGGCTGGTGACCGAGGCGGATAAGACTCAGCTG<br>GTGTGCGCCAACCGGCAGTACTACCTGTTGCGCGATAACGCGCCGACCTGCTGGGCCCCG<br>GCGCAATGCGAGGCCTTTCTCGCGGCGACCCTGGCGTATTGGGACGATTGGGGCGCATGA |
| NTase056<br>aka CdnE | 167 | ggaatacctgaatcacagctcgatacatggtcccaccaaggatctattgcacagtctgcc<br>tcgacttatagcattataaagaatgcattagagagcgcaaacactaagtatcatggaaag<br>aattttaaagtattccttcagggctcctatggaaacgatactaacatttatgctgaaagt<br>gacgttgatgtagtcatatgtcttgatgatgtctactacagtgacctcacacagttatca<br>ccagaagacaaagatgcgtatgaccgtgcatttgttcctgcaacctactcgtatactcaa<br>tttaagcaagatgtgcttgaggctcttacagagcgcttcgggtctgatgttaaggtcgga<br>gataaggccatagttgtagcggcaaatggaagtaggcgcaaagctgacgttatcgcatca<br>atgcagtttcgtcgttattggaaattcaaggggcattacgactcacaatacgatgagggc<br>atctgtttctttaatggcgctggtgaacggattgccaattaccccaagcagcattcagaa<br>aatctcaccttaaaacatcaggccagtaataaatggctaaagcccatggttcgcgtactg<br>aagaaccttcgaagtaaactcattgctgacggaaaattgaagtcaggacttgcaccttcc<br>tattaccttgaaggtctactctacaacgtgccaaatgaaaagtttggcaccagttatgct<br>gattgttttgtcaatgccatgaattggattcagacagaagcagataaagacaagctggta<br>tgcgccaatgaacagtattacttgctttgggaggggacacatacctcatgggagaaagcc<br>gatgcggaagcgtttatcgacgctgcaataaaaatgtggaatgaatgg |
| NTase057<br>aka Lp-<br>CdnE02 | 169 | ATGAGCATTGATTGGGAACAAACTTTTCGCAAATGGTCAAAGCCATCTAGCGAAACTGAG<br>TCTACAAAAGCGGAGAATGCGGAACGTATGATAAAGGCTGCTATTAATAGTAGCCAAATT<br>TTATCAACTAAAGATATTAGTGTCTTTCCTCAGGGTTCATACAGAAATAATACAAATGTT<br>AGAGAAGATAGTGATGTTGATATTTGTGTATGCCTTAATACCTTAGTGCTCTCTGATTAT<br>TCACTTGTTCCTGGCATGAATGATAAGTTAGCTGAATTACGTACAGCATCTTACACGTAT<br>AAACAATTCAAAAGCGATCTTGAAACAGCATTAAAAAATAAATTTGGCACGTTAGGCGTT<br>AGTCGGGGAGATAAGGCATTTGACGTGCATGCAAATTCCTATCGGGTTGATGCAGATGTT<br>GTTCCTGCCATTCAAGGACGACTATATTATGATAAAAACCATAATGCCTTTATACGAGGC<br>ACATGTATAAAACCTGACTCCGGTGGCACTATCTATAATTGGCCTGAGCAGAATTATAGT<br>AATGGCGTAAACAAAAATAAGAGTACAGGAAACAGATTTAAGCTCATAGTACGTGCCATA |

TABLE 2-continued

| Representative CD-NTase nucleic acid sequences | | |
|---|---|---|
| | | AAAAGATTAAGAAACCACTTGGCAGAAAAGGGTTACAATACCGCAAAACCAATACCATCA<br>TACCTTATGGAATGTTTGGTGTACATTGTTCCAGATCAATATTTCACGGGTGATTCTTAT<br>AAAACTAACGTTGAGAATTGCATTAACTATTTATATAACCAAATAGACTCAAGCGACTGG<br>ACTGAAATTAACGAAATTAAATACTTGTTTGGTTCGCACCAAATGTGGAACAAAACCCAA<br>GTGAAAGAATTTTTACTAACAGCTTGGAGTTATATACAGAAAAATTAA |
| NTase058 | 172 | TTGTTATTTACTGAAGAACAATTAAAATTATATTCTAAACCATTGTCAGAATCTGAAAAA<br>GAAAAGTGTGAAAATGCAATAAGAATTATTCAAGAATCTCTGGAGTCATTAGGATATGAA<br>ATAAAAAAGGGTATACATAGAAACAATGAAGATACGCTATCATATCAAATTAAAATGACT<br>AATTCATCGAAAGATTATGAACTAAGTATATTTGTGAAAGGTTCGTATGCAACAAATACC<br>AATGTAAGACAAAATAGTGACGTTGATATTGCAGTGGTAAAAGAAAGTGAGTTTTTTGAT<br>AAATATAGAGAAGGTAAAACTAGAGAAAATTATAAATTTATTTCTAGTAATAAGCCTCCG<br>TATTATTTTAAAGATGAAGTAGAAGAAGCTTTGATTGAAAAATTTGGAAGAAGTGAGGTA<br>AGAAGAGGTAATAAAGCAATTAGAATCAATGGCAATACTTACCGTAAAGAAACAGATTGT<br>GTACCTTGTTTTAGATATAGAGATTATAGTAATGATTATATGGATGATCCAAATAATTTC<br>ATTGGAGGAATCACAATTTATTCAGATAAAGGTGAACGAATTATAAATTATCCGGAACAG<br>CATATAAATAATAGTGTTATAAAAAATAACAATACAAATTATAAATATAAAAAGATGGTT<br>AGAATAATAAAGGAAATAAGATATCAATTAATAGATAGTAAAAATAGAAACGCGGAACAA<br>ACTTCTTCATTTGGAGTTGAAGGTTTGTTTTGGAACATACCGGATTACAAATATAGCAAT<br>GATGAAATGTTAGGTGATACATTTAATGCATTAATTGCATTTTTAATAGATAATATAGAT<br>AAATTAAGTGAATTTAAAGAACCTAATGACAGATAA |
| NTase059 | 175 | TTGTTATTTACTGAAGAACAATTAAAATTATATTCTAAACCATTGTCAGAATCTGAAAAA<br>GAAAAGTGTGAAAATGCAATAAGAATTATTCAAGAATCTCTGGAGTCATTAGGATATGAA<br>ATAAAAAAGGGTATACATAGAAACAATGAAGATACGCTATCATATCAAATTAAAATGACT<br>AATTCATCGAAAGATTATGAACTAAGTATATTTGTGAAAGGTTCGTATGCAACAAATACC<br>AATGTAAGACAAAATAGTGACGTTGATATTGCAGTGGTAAAAGAAAGTGAGTTTTTTGAT<br>AAATATAGAGAAGGTAAAACTAGAGAAAATTATAAATTTATTTCTAGTAATAAGCCTCCG<br>TATTATTTTAAAGATGAAGTAGAAGAAGCTTTGATTGAAAAATTTGGAAGAAGTGAGGTA<br>AGAAGAGGTAATAAAGCAATTAGAATCAATGGCAATACTTACCGTAAAGAAACAGATTGT<br>GTACCTTGTTTTAGATATAGAGATTATAGTAATGATTATATGGATGATCCAAATAATTTC<br>ATTGGAGGAATCACAATTTATTCAGATAAAGGTGAACGAATTATAAATTATCCGGAACAG<br>CATATAAATAATAGTGTTATAAAAAATAACAATACAAATTATAAATATAAAAAGATGGTT<br>AGAATAATAAAGGAAATAAGATATCAATTAATAGATAGTAAAAATAGAAACGCGGAACAA<br>ACTTCTTCATTTGGAGTTGAAGGTTTGTTTTGGAACATACCGGATTACAAATATAGCAAT<br>GATGAAATGTTAGGTGATACATTTAATGCATTAATTGCATTTTTAATAGATAATATAGAT<br>AAATTAAGTGAATTTAAAGAACCTAATGACAGATAA |
| NTase060 | 178 | ATGTACGAGACAAAAACCACCGCCAGTGATTGGGATAAAACCCTTATTACTCTTTCAAAA<br>GGACCAAGCGAATCTGAAAGTCAAAAATGTGAAAATACGGAAAATGCCATCCGAAAAGCG<br>ATCACAAGTAACGCAAAACTATCTCAGATGGATATCTCTATTTTTGCTCAAGGCTCTTAC<br>AAAGCCAGAACAAATGTAAGAGCAGAAAGTGATGTTGATATTGCAGTACTCCTCAACACG<br>GTGGCTTATAATGATTACCCGGTTGGGCTTACAGCCGAAAACTTTGGATTCACTCCTGCT<br>AAAATCGAGTTTATAGATTTTAAAAATTTAGTAAAACAAGCAATGGAAGAGTATTTTGGA<br>TATTTTAATATTGACCGATCCGGAAAGAAATCAATCAAGGTCCACTCAAATACTTATAGG<br>GTTGATGCCGATGTAGTACCTATGTTTTGTCATAATCATTTTCTGAGTGCAAATCCAGAT<br>GATTGTTTACGAGGTGTGGCATTTTCCACTAATGAAGGTATGATCATCAAAAACTGGCCT<br>CAGCAAAATTATGAGAATGGAATACAGAAAAACACTGCAACTAAAAGAAAATATAAGCGT<br>TTAATCAGAATACTGAAACGACTAAAAGCTTATATGATACAAGAAGGCATACAAGAGGCT<br>AACATACCTTCATATTTGATCGAGTGCTTAGTATGGAATGTACCAAATGTAGAGTTTTTC<br>CATGACTCACTTTATCAAAATCTACGACAAATACTATTTTATTTATGGGATAAAACCCGA<br>ACGAATGAAACATGTAGTAATTGGGGTGAAGTAAACGAGTTAAAATATCTTTTTAGCACT<br>AGTCAGCCTTGGACTTTTCAACAGGCACACAATTTTATACTCGCCACATGGAAATATATT<br>GGATATAAATAA |
| NTase061 | 181 | GTGAGTAGGGATTGGGAGTCGGTATTTGCAACTTGGTCACAAGGACCAAGCGCAACGGAG<br>CAAGAGAGAGCGCAAAATGCCGAGAGGCAAATAAGGCAAGCAATTCAGGCGAGTGATAAG<br>TTAAAAAATCGAAATATCAAAGTATTTACGCAAGGCTCTTACAGAAACAGGGTTAATGTA<br>AGGCGGGATAGCGATGTAGATATCGGAGTTCTCTCTTTCGATACCTATTTTCCTGAATAC<br>CCTGATGACAACGTAAAAATGGAGCTTGCAAAAAATTCCGTTCCCGCCACCTATGAATAC<br>GCGACATTCAAAAGTGAGTTAGAAGAGGCGCTTGTAGCTAGGTTCGGAAGAGATGCTGTT<br>ACACGTGGTAGCAAAGCCTTTGATATAAAAGCGAATACATATCGCGTAGAGTCAGATGTG<br>GCTGCGTTTTTTGAGCATCGTAGATATGTTACCGCCACTTATTATCATTCTGGAGTCGAG<br>ATGATACCAGATGATTACGACCCTCCTAGAGTCAAAAATTGGCCTGAGCAACATTACGAA<br>AATGGCGTTTCAAAAAACACTTATTCATTAAGAAGATATAAAAGGGTCGTTCGGGTATTA<br>AAAACACTATCTAACGAGATGGCGTCAAAAGGTATCCAATCAGCAAAAGACGCGCCGAGT<br>TTTCTCATTGAAAGCTTGGTGTTCAATGCATCAAATTCATGTTTTGAATATCAATCTTTC<br>AAACCCATGGTAAGGCATATACTTGCAGAGCTATTCAATAATACTATGTCACATGAAAAA<br>TGCTCTGAGTGGGGTGAAGTAAACGAACTTAAGTATCTTTTCAGAAGCTCTCAGCCGTGG<br>ACTCGTGAGAGTGCTCACCAGTTCTTAAGTGATGCTTGGGACTACATAGGTTACGAATAA |
| NTase062 | 184 | ATGTCTAATTCATTTAGTGCGCGAATTGAACGCATGAAGTCTCGTCGTAAAGGGACATTC<br>GATCAATTAAACGTAGCCAGAGAGTCAATCAGTAACCAGAGGATTGATGGACTGGAAAAC<br>TATGCTTTGCTAGAAGGTTTCCTGGATTTAAATGAAAGTTGGGAAACCAGGGGAAAACAA<br>GATTCTGCAACCCGCTATGTTATAGGTGCCATGCAACCGGTTGATAACCGCTATACCGAA<br>ATTTCTTTTGAAACTGCCAAGCGTATTGAGAACCAACTGGTAAAGAAATTAGATCTTAAT<br>CTGGAGTTTCGTGTCCAAGGCTCTGTACCACTGGATATTCATATTAAAAGTTTCAGTGAT<br>GTGGATCTGCTGATTATAGACACTCAGATGCTTATTTATGATAGCGACGGTATTGGCCGC |

TABLE 2-continued

| Representative CD-NTase nucleic acid sequences | | |
|---|---|---|
| | | TACACCCCTACGAACAAAAATGATGGGGATGTCATCCTTGAACTCAGGGATGCCGCTAGG<br>GATGCCCTGAAAGCAACTTTCCCTGCGGCAGATGTTGATGACAACAACGCCAAATCTTTG<br>AGAATAACGGGAGGGTCTTTGGAGAGAGAAGTGGATGTGGTGCCAAGCATCTGGTGGGAT<br>ACCAAAGAGTACCAACATACTAAAGATGTAGATCAACGTGGGGTCACTATTATAGATAAA<br>AACACACGTCAACGTATCTACAACCTACCTTTCCTCCACATCAAACGAATTAAAGACAAA<br>TGCGATCAATGTAATGGAGGATTGCGTAAGTCTATTCGTTTTCTTAAGACACTAAAAGCG<br>GATAGTGAAGCTGAGGGTACTAAAATTGAACTCAGTAGTTATGATATTGCCTCGCTGATG<br>TACCACGCAGATGGTAACAATCTCCGACATAGCCAATACTACGAGCTGGCTGTCCTTGTA<br>GAGACTCACAGATGGCTAAATTATCTTGCACAGAACCCTAATGCTGCAATGCTGCTCTAC<br>GTTCCAAATGGCACCAGAAAGATAATTGACAAGAATGAAACTTTTGCCGAATTGCTTAAA<br>CTGACGGGAATGGTCAATAGTATTGTCACTGAGGTGCTGCGTGAAATAACCGGCCAGCCT<br>ACTGAATATTACACACCCGCCAAAGGAATTTTACTTATAAAACAAGCGGTTTACTAA |
| NTase063 | 187 | ATGAACACACCAATTAACGAACGAATCAATCGTCTGCGCTCCAGACGCTCGGGCCTTGAT<br>AGATCCTCTGTAATCGCGATGGATGCGAAGGACTTCATCGTGAACCGAAGCCTTACAAAA<br>GAGGCGTGGGAACATAGGGTTAAAGACAAGCCGAATACAACATTTGCTTTAGGCGCTATG<br>CAGGAGGTAGATCCTACCTACACCCGCATCAGCATCGAAACCGCAGAACGGGTTAGCAAC<br>CAGTTGTCTAAGAGGACAAGCGGCAATCTTGAATTCGAGCTACAGGGATCAGTACCACTG<br>AATGTCCATATTCGAGGGGTCAGTGATGTTGATCTTTTAGCAATAGAAGCTGACTTTCAT<br>ACCTATGATGCGCGTGGGTACATGAGTACATCGGGTCAGTACCGCTCACCGACCTCACGC<br>ACCTCAGTTGGGGTATTAACCGCTCGCAGGGGCGAAATTGGTAGAGCTCTTCGTGATGCG<br>TTTCCCGCTGCGACGATTGACACTTCTGGCTCTAAGGCCATCAAATTGCAAGGAGGGTCA<br>TTAGCACGTCCAGTAGACGTCGTGCCTTCCCACTGGCATGACACTATCACTTACCAAGCC<br>TCTGGCCAGAAACATGACCGCGCTGTCACTATCCTAGATTCGCATAAAAGTACCACGATT<br>GAAAACTGGCCTTTCCTGCACATCAAAAAGGTACGAGAACGATGTGAAACTACGGGTGGT<br>GGACTCCGCAAATCAATAAGGTTATGTAAAAACATAAAGGCAGAGCTCGAGGCAGAGGGA<br>AAACCTGTAACGATCTCAAGCTTTGATATTGCCTCAATAATGTACCATGCCAACATGCAT<br>AGCCTCTCCGCTGGTGCCTACTACGAATTAGCGATATTGGCCGAGACCCAAAGATATCTG<br>GATTATTTGTGGAACAACAAGGAAGAAGCGAGGAGATTAGTAGTACCTGATGGCTCCCGT<br>TTTATCTTTAATACCGAGGACAAGTTCAATGGCTTGGTGCATCTATCCGTAGCAATGGAT<br>AGTCTCCTCCGAGAGGCAGCCAAAGAGCAAAACTACCTTCTAAGCTTATCCGATAAACCT<br>TTGCTGGATGCCAGCAGGATAGCTGTGACCAACGCGATCATTTTTTAA |
| NTase064 | 190 | ATGAGTATTTTAGTAACAAATTCGTATGTTACACCATTAGAAGCAAGACAAACCATAGCT<br>AGAAGATATCGTATTGTGACTAAAGCGATTAATGTAGAGTTTTGGAATTCAATTAGTGAA<br>ACAGCTCATAGTTTTTACGTAGGATCTTACGGACGTGGAACTGCAATAAGTACAAGTGAT<br>ATTGATATTTTGGTAGAAATTCCTAATTCAGAGTATGATAAATTCAATTCGTCTACTGGT<br>AATGGCCAATCACGATTATTACAGTCAATTAGAAAATCACTTCAAGTAGCATACCCTCAA<br>AGTGATATAAGAGCAGATGGACAGGTGGTTAAAATTAATTTTCATGATGGAATAAAATTT<br>GAAATTTTACCTGCTTTTCAGAATATAGATTATTGGGGTAAAAATCAGGGGTATATCTAT<br>CCCGACTCAAATATGGGAGGGAATTGGAAAGCGACTAATCCAAAAAATGAACAAGAAGCT<br>ATGAAGATAAAGAATGGTCCAACATATAGTAATGGGCTGCTTTATGCAACGTGTAGACAT<br>TTTCGTTATGTTCGTGATACTTACTTCAGTAGTTATCATCTTTCCGGCATAGTAATAGAT<br>AGTTTTGTTTACAATGCGATGGGAAACTGGAGATATACTGAATCTGGAAGTAGTTCTAAT<br>GCAAGTATGGGAGCTTATGAGAACATCTTATTAGAGTATTTTAATAATAATACAATTTGG<br>GGATTAAGTTTGAATTCGCCAGGTAGTAATCAAACTGTAAGCACTACTAATAGTATTACA<br>TGTCTAGAAAAAGTGATAAAGAAGATTGCAACTTAA |
| NTase065 | 193 | ATGAGCACCGCAACTGACTTTAAGACACTCCTCGACAATATAAAAATAGATAATGCAGGC<br>CAGATTAGTAAAAGGTATGGTCGTATAACTAAGGCTTTGAACCAATACTTTTATAACTTA<br>GATTCTAAGACAGCCAATTCACTACAGGTTGGTTCCTATGGGCGCTTCACAGGGATTCGA<br>GGGATCTCTGATCTTGATATGCTTTACTTTCTACCTGCAACTGCATGGCCAAGATTCCGA<br>GATCGACAATCGTATTTATTACAGGTTGTGAAAACAGAAATCAAGAAAACTTTCAAAAAT<br>ACAGATATTCGCGGTGATGGGCAAGTTGTTGTTGTTAAATTTAAGAATCAAGAGGTTGAG<br>GTAGTTCCTGTATTCAGTAATGAAGATGGCACTTTTACATACCCGGATACACATGATGGT<br>GGATCGTGGAAGGTATGTAACCCTAGGGCCGAAATGTCGTCTTTTAGGGCACTGAATGAT<br>GATAGGAAGGGACATCTCAGACGTCTATCTAAAATGATTCGAGCATGGAAAGCTCGTCAT<br>GAAGTTGAGATAAGTGGATTCTTAATTGATACACTGTGTTATAATTTTTTCTCTAATCTA<br>ACTGAATATGATGATAAGAGTTTCAAAAGTTATGATCAACTTTCGCTTGATTTTTTCACT<br>TTCTTAGAGAATGAAGGTGACCGAGTATTTTATTATGCTCCCGGTAGTCGCTCAAAAGTG<br>AGCGTAAAAAAATCATTTAATAAAGTAGCAAAATTAACAAAAGAATATTGTGAAGAAGCT<br>TTATCTGCTACAAGTGAAAACTCAAGAAACTTAGCTTGGAAAAAAGTTTTTGGCAGGCCT<br>TTTCCAAATTATACGACAAAAGCACTCAGTAATGTCAATGTATCTGAACAGTTTATTGAA<br>GATCAATATGAGATGAATTTATATGGTCATGTTTCGATAGAATGTGAGATTAGAAAGAAT<br>AATTTACTGGAAGCTCTTCTTTCAAATCTTCTTGGCGAAGGGCATGATATTAGCACGAAT<br>CGCAAGTTAAGATTCTATGTTGATGAGATAAATAATATATCTCACCCATATAAGATTAAA<br>TGGAAAATAAAAAATGTAGGTGATGAAGCTGAGCGCCGAGGAAATGTTAGAGGTGAAATT<br>TTAGACGATGAAGGCGGTTCTGAGCGTTTCGAGACCGCAGATTTCTCAGGACCTCATTTT<br>GTTGAATGTTATGTTATTTATGGTAATCAAGTTGTAGCAAGAGATAGAATCGACGTACCT<br>ATACATAATTAG |
| NTase066 | 196 | ATGGGGTTACTGGTTCCGAGAGCTAATACTTATACTATACCTTTAACGAAACGCCAATTA<br>ATTGCTAAAAGATATCAAAGGATTACTAGAGCCATCAATAGAGAGTTTTGGAATTCTGAA<br>AGTGATACTGCTCACAGTTTATACGTAGGTTCTTATGGGAGAGGAACGGCAATTAGTACT<br>AGTGATATAGATATAATAGTTGAATTACCGATGGCAGAATTTGACAGATTCAAAAATTAT<br>TTATCAAATGGCCCGTCTAAGTTATTACAAGTTATATAAAACGCATTTCAGGAAATACTA<br>CCAAATAGTGATATTAGAGCTGATGGACAAGTTGTTAAAATAAATTTCCATGATGGAATC<br>AAATTTGAAATAGTTCGAGCTTTTAATGAAAAAGATTATTGGGGTGAGTCAAAAGGGTTT |

TABLE 2-continued

| Representative CD-NTase nucleic acid sequences | | |
|---|---|---|
| | | ATTTATCCAGATTCAAACATGGGAGGGAACTGGAAAGCTACAAATCCCAAAAAAGAGCAA<br>GAAGCCATGAAATTAAAGAATACAAAAAGTAATAATTTATTATATGCTACGTGTAAACAT<br>TTTCGACATGTACGAGATACAGAATTTACGAGTTATCATCTTTCAGGAATAGTAATTGAC<br>AGTTTCGTATATGAGGCTATGGGAAATTGGAAATTCGTTGAAAATAACAGTGGGGGTCAA<br>AACATTAGTTCTGTATCTTATGAGACAGCTTTATTAGAATACTATAACTCACATAAAGTT<br>ATGGGCGGTTTAAATTTATACTCTCCTGGAAGCAATCAATTTGTTAATTCTGATAGTAGT<br>ATCATATGTTTAGAAAAAGTATTAAAAAAATAGCTTTATAA |
| Rm-CdnE | 199 | ATGCCGGTACCTGAAAGTCAACTTGAGCGATGGTCCCACCAGGGAGCAACCACTACGGCC<br>AAGAAAACACATGAATCTATCAGGGCAGCGCTAGATCGCTACAAATGGCCTAAGGGCAAA<br>CCAGAGGTGTACCTTCAGGGCTCCTATAAGAACAGCACAAACATTCGTGGCGATAGCGAC<br>GTAGATGTTGTGGTTCAGCTCAATTCCGTGTTCATGAACAATTTGACTGCAGAACAAAAG<br>CGTAGATTCGGCTTTGTTAAATCAGACTACACCTGGAATGACTTCTACAGCGATGTGGAA<br>CGAGCTCTTACGGACTACTACGGAGCTTCAAAAGTTAGACGAGGAAGAAAAACGCTAAAG<br>GTTGAAACAACATACCTTCCGGCAGATGTAGTGGTTTSCATCCAGTACAGAAAATACCCG<br>CCCAATCGAAAATCCGAAGATGATTACATAGAAGGCATGACCTTCTATGTGCCGTCTGAA<br>GACCGTTGGGTAGTGAACTACCCCAAACTCCATTACGAGAATGGCGCAGCCAAAAATCAA<br>CAAACCAACGAATGGTATAAGCCAACAATTCGTATGTTCAAGAATGCACGGACATACCTT<br>ATTGAGCAGGGGGCGCCGCAAGACCTTGCTCCCTCTTATTTCCTTGAGTGTCTTCTCTAC<br>AACGTTCCTGATAGCAAATTTGGCGGAACCTTCAAAGATACTTTCTGCAGCGTTATAAAC<br>TGGTTGAAACGAGCTGACTTGAGCAAGTTCCGTTGTCAAAACGGACAGGATGATTTGTTT<br>GGAGAATTCCGAGAACAGTGGAGTGAAGAAAAGGCCAGGCGCTTCTTGAGATATATGGAG<br>GATCTCTGGACAGGTTGGGGACAATAG |
| Em-CdnE | 202 | ATGAATTTTAGTGAGCAACAATTAATAAATTGGTCGAGACCGGTTAGTACAACTGAAGAT<br>CTTAAATGCCAAAACGCAATTACTCAAATTACCGCAGCTTTGAGAGCTAAATTTGGCAAT<br>AGGGTTACAATTTTTCTTCAAGGTTCTTATAGAAATAATACTAACGTGAGGCAAAATAGT<br>GATGTCGACATTGTTATGAGATATGACGATGCTTTTTATCCAGATTTACAAAGGTTATCC<br>GAAAGTGATAAAGCAATATACAATGCACAAAGAACATATTCAGGATATAACTTTGATGAA<br>TTGAAAGCAGATACAGAGGAGGCATTACGAAATGTTTTTACCACTAGTGTGGAAAGAAAA<br>AACAAATGTATTCAGGTAAATGGAAATAGTAACCGTATTACTGCTGATGTTATCCCCTGC<br>TTTGTTCTAAAAAGATTTAGTACATTACAGTCTGTCGAAGCAGAGGGAATAAAATTTTAT<br>TCAGATGATAATAAAGAAATTATAAGTTTCCCTGAACAACATTATTCAAATGGAACGGAG<br>AAAACAAACCAAACGTATCGTTTATACAAGCGTATGGTACGTATTTTAAAAGTAGTAAAT<br>TATCGATTAATTGATGATGGTGAAATTGCTGATAATTTAGTATCTTCTTTTTTCATTGAA<br>TGCTTAGTGTACAATGTTCCTAATAATCAATTTATATCAGGAAACTATACTCAGACATTA<br>AGAAATGTAATTGTAAAGATATACGAAGACATGAAAAACAATGCCGATTATACTGAGGTT<br>AATAGATTATTTTGGCTTTTTAGCAATAGATCTCCTAGAACTCGTCAAGATGCATTGGGT<br>TTTATGCAGAAATGTTGGAATTACTTAGGATATCAATAA |

b. Cloned, synthetic, codon-optimized sequences

| CD-NTase Name | SEQ ID NO: | Cloned, Synthetic Nucleotide Sequence |
|---|---|---|
| NTase002 | 10 | ATGCTTAATTTGTCACCCTTGTTTTTACCACTTTAGACGATGAGAGCTGTATGCAT-<br>GATG<br>AGTTGGATTTGACTCCTGGGCAGCGCGCCTGGATCGCGTCTGCGCGCACT-<br>GATGTACGTGA<br>TTGTCTTCGTACGGGGATTCCACGTGTTTTACGCGCAAACGGTTATACTGAA-<br>GACGTGCCG<br>CAGCCTCGCTTTTTCACCCAGGGCTCCTGGGCTTACAAGACCTT-<br>GAATGCACCTGCACAAC<br>ATCCACAACAGGCAGATGTGGATGACGGATGCTATTTGC-<br>CAATGTCTTTCGTCTCGCAAAC<br>CAAACGTCCCTCAACGGCTGCTACAGTCTTCTTCGCCGCGGCAGAGGAGGCTT-<br>TAAAGCCG<br>CTTGTTGAAGAACGTCGCTGGAAACTTGTGACCGATAAGCCCACCTGTATCCGTAT-<br>TGTGA<br>TTGCCGCCTACGCACACATCGATATTCCCCTTTATGCCATCCCGGACGAG-<br>GAGTTCGTGAC<br>ATTGGCGAAAGCATCTATGGAACGTTACGGGTATGATTCTCTTACTGAAGCAGT-<br>CAATATG<br>GCTGAGCGTGATGCTTGGACCGCACTGCCGGCGGACAAAGTTTTGCTGGCTCACCGT-<br>GAAT<br>GCAACTG-<br>GATGTCTTCGGACCCCCGTCCAGTAAAGGAGTGGTTCTTGGGCGAAGTCGAAGC<br>GAAGGGTGAGCAATTTCGTCGCGTGGTTGGCTACCTGAAAGCATTCCGCGACTG-<br>GAAGTGG<br>TCGAGCGGAGGTCCTGCTAGTATTCTTCTGATGGCCGCAGCGGCCCCGTTGTTT-<br>GAAAAAC<br>GCGACCGCCGCGATGACTTGGCTTTACTGGATGTAGTAGCCGCGTTGCCCGCCCGTT-<br>TACG<br>CGGGGGTGTTAATAACCCTGTGGAAGAATCTGAGAGCTTGACGGAACGTT-<br>TAGGTCAGGCC<br>GGAGTGGAGGACGCAGCCAAAGCGTTCGAAGAATTCGAAAAGGTCT-<br>TACGTGGTGCAACGG<br>GTGCTGGGTCACCGTCTCAGGCTTGTATCTGGATGCGCGGG-<br>GAGTTCGGGCCCCGCTTTCC |

TABLE 2-continued

| Representative CD-NTase nucleic acid sequences | | |
|---|---|---|
| | | TAACGAACCGGATCGTGTAAAGGTAGTGTCGGTGGCAGCGAC-<br>CATCGCGGCGGCTCCCGCG<br>ACCGCAGGCCCATCGGAGTTAGTTGGGCGTACAAAGGCAGGC |
| NTase003 | 13 | ATGCTTAACCTGAGCCCCTTATTTTTTACTACAGTCGACAACCGTACATGTTTACATG-<br>GAG<br>CATTGGATTTAGAGGACGCGCAGCGTA-<br>CATATATCGCCCAGGCGCGCTTGGACGTTCGCAA<br>CTGTTTGCGTGCAGGGATTCCAGCTATCCTGAAAGCACTTGGC-<br>TATCCAGGGCAGGTCCCC<br>ACGCCACGCTTTTTCACGCAGGGGTCTTGGGCTTATAAGACTCT-<br>TAATGCCCCAGCAAAAC<br>CACCGCAGCAAGCTGATGTAGATGACGGATGTTATTTGCCAATGGGCTTCGTTTCT-<br>CAAAG<br>CAATCGCCCTTCGGTTGCTGCTGGCGTTTTTTTCAAGCAGCG-<br>GAAGCCGCGTTGCAACCA<br>CTGGTGGATCAAAATAAATGGCAACTTGTTACCGATAAAGACACATGTATTCGTAT-<br>TGTTA<br>TTGCTAAGGATGCCGATATTGATATCCCCTTATACGCGAT-<br>TCCCGACGAAGAGTTCGTAAC<br>TCTTGCCAAGGCGTTTGAGAGTCGCGGTATTGCCATGGATTCAAT-<br>TACGTTCGCCGAAGAA<br>GAGGATGTGTGGACGAAGCTGCCGCGCTACAAAGTGTTGCTTGCGCACCGTCAG-<br>GAAAATT<br>GGAAAGTGAGTGATCCTCGCCCAGTCAAAGAATGGTTCTTGTCTGAGGTG-<br>GAAGCAAAAGG<br>AGAGCAATTCCGTCGCACTGTTCGCTACTTGAAAGCGTATCGTGACTGGCACTGG-<br>GAGTCC<br>GGTGGTCCTTCAAGCATCCTGCTGATGGCCGCAGCTGCTCCGCTTTTT-<br>GAGAAGCACGACT<br>CTCGTGATGATCTTGCGCTGTTGGCGGTAGTCGAAAAGTTATCAGATGCATTACGT-<br>GAGGG<br>AGTTTCTAACCCGGCAGATACGAGCGAATCACT-<br>TACCGAACGCCTTGGTGCTGTCGGGGTT<br>GAAGACGCAGCTAAGGCGTATGAGAGTTTCGCCATTATGTTACGCGGGGCTATT-<br>CATGCTT<br>CCAAGGCTTCACAAGCGTGTGCCTGGATGCGTCACGAGTTTGGCTCACGCTTTCCT-<br>GATGA<br>CCCAGAACGCGTGAAGGTGGTCTCTGTAGCATCATCAATCGCCTCCTCCTCGGCTAT-<br>TGCA<br>GGGCCGTCCGAATTGATTGGGCGCAGCAAGGCCGGG |
| NTase004 | 16 | ATGTACGATTGCTCCAAGGAATTTAGCACGTTC-<br>TATCGTAAGAAAGTTGTGTTGTCTGCCA<br>AAGAACAAGACGAACTTCGCAAGCGTCGTAAACAAAATATTCGTCGTAT-<br>TAAGGATGGACT<br>GAATGAGTATAATGAGGAAAAGAAGACGAGTTACAAAATTAGTGAA-<br>GATCGTATCCAGGGA<br>AGTATGGCCATGCATACTATCACCCAAAACGACGAAAAAGATTACGATATTGACGTTG-<br>GAA<br>TTGTGTTTGAAGCAGATTGTCTTAATAGTTTAGGGGCCCAAGCAACACGTAA-<br>CATGGTTGC<br>AAATGCTCTTGAACGCAAGACACGTCAGTTTGCTCAGCCTCCTGAAGT-<br>CAAAACTTCTTGC<br>GTACGTCTTAAATACTCCTCGTTGGGGTATCACATGGAT-<br>TTTGCCGTGTTTCAGCGCAGTA<br>AGGAGTATGAGTGGGATGATAATTATATTTACGAACACGCCGGGACCGAATGGACG-<br>GAGCG<br>TCATATTAAGGCTTTGGAAGAATGGTTTATTAATCGTGTGAAATACTCGGGTGACGAT-<br>TTG<br>CGTAAGATTGTACGTTTATCTAAAATGTTTTGCAAGAGTCGTGATTCCTG-<br>GAAGAATATGC<br>CGAGTGGACTGGTCCAAACTATCCTTTGTGACTCGAAACTTAAAAATTACTAT-<br>TCCCGCTT<br>GGACGAGAAATTCTATTATACGATGCAAGCTATCGTACAGCGTCTGGACATT-<br>CATCTGGAC<br>GTAAATGCCCCTGTGGACAATGGACGTGAATTAATCATCCGCGATGTAGAT-<br>TATAAACGTA<br>TGGAGAATTGGAAAAACCGTCTGCGCGCTTCGCTTAATAAACTTGATATTCTGTTCGA-<br>TAA<br>AGAGTGTAGTCGTGAGGATGCTTTACAGGCATGGGCTTTATTCTTTAATCATAGC-<br>TACTGG<br>GAGGAGCTTGCGGAACAGAACGAACGCAGTAACATCTCCGAATCACGCTTTT-<br>TAAGTTTTA<br>ATGACACAGAACAGTTTATTGAAGAGTTATACCCGATCTATGAGAATTACAACGTTT-<br>CAAT<br>CGATTGCGATGTCTCGGGGAATGGTTTCTCAGTGATGCCAATTGAGAAGTTCTTTGA-<br>TAAG<br>CTTTCCCCACAACTGAAGCGTTTCATTCCATACAACTTTAG-<br>CATCCGCTGCCGTCTTGGCG<br>ACACCGACTGCCCAACTTATGATAAAATTCTTTGGAAGGTACGCAACATCGGAATT-<br>GAAGC<br>CGAAAAGCGCAACTGCATTCGTGGACAGATTGTGGATAACCGCGGGACAGAAATTATT-<br>GAG |

TABLE 2-continued

| Representative CD-NTase nucleic acid sequences | | |
|---|---|---|
| | | AACAGTAACTTCGCAGGCTTACATTATATCGAGTGCTATCTTATTAAAAATGA-<br>CATCTGCG<br>TTGGAATCGGGCACGTGGACATCCCGATTGGCGGAATC |
| NTase005 | 19 | ATGTTTGATCTGGAAACGGAGTTCAACATTTTTTATCGTGACTATGTCGTTT-<br>TATCGAAGG<br>ATGAAAAACAAAACTTATACAACAAAAAAGACCTTAATCTGGACCGTTTAAAA-<br>GACGGTTT<br>ACAAGAGTATAATGAGGAAAAAAAGACGGAATATAAAATCAAAGACAACGTTGTC-<br>CAAGGA<br>TCTGTGGCGATGTCGACGGTCACCCAAAACGATAAGCACGACTACGA-<br>TATCGACGTTGCGG<br>TTATCTTCGATAAAGACAATATCCCGAGCGGGACTACCGCAGTGAAGAATATTGTCGT-<br>TAA<br>TTCACTTAAAAAAAAGTGGAAACAATTTAAGACTGAACCAGAAGCGAAAACTAAT-<br>TGTGTA<br>CGTGTAGCGTATGAAGAGGGTTACCACATTGATTTTGCGGTTTACCGTCGTTT-<br>TAAAAACG<br>ATAGCGACGAATTTGAATATGAACACTGCGGCTCTGAGTGGAGCAAACGCGACC-<br>CACGCAC<br>AATCACAAATTGGTTCATTGAAAACAATAAGGCCCAGGATTA-<br>CAAGCTGCGCAAAATCGTT<br>CGCTTATTAAAAATGTTTTGTAAAAGTCGCGAGCACTGGGTTATGCCGGGCGGCTT-<br>GATTC<br>ACACAGTACTTGTCGTTGAGTGTTTTGAACCTAATGACCGTATCGATAAGTCATTC-<br>TATAA<br>TACCATCAAAGCAACACGCGACCGCTTGAAAAATGACAAGGAAGTTAAAAACCCAGTG-<br>GAT<br>GACTCCTTATCTCTGATCATTAAGGAATCAGACAAAACCAAAGTAGAGAATTTATA-<br>CAACC<br>GTCTTTCTACCTATATCGACAAATTGGACATTCTTTTCACA-<br>GATGGCTGTACTAAAGAGCA<br>AGCCATCGAAGCCTGGAATGACTTCTTTAATCATAGTTACTGGTCCGATCTGTTAACG-<br>GAA<br>GATACACAGAAAGCAAATGAATCGGCATATTGTGCTACCGAAACTTTTCCAGAGTGT-<br>GATG<br>AAACTGAAGAATTTATTGAGCATATTTACCCAATTGATATCAAGTATGATCTGAATAT-<br>CAA<br>CTGCCGTGTTACACAGGACGGATGGCGTACTAAATTACTTCGCAGTATGCTGCGCT-<br>TAAAG<br>GAGCCGTTGCGTTTGAATAAAAATCTGGAGTTTTTTATTGAGGGAACTAATGTTCCCC-<br>CAC<br>CGTATAAAGTTTTTTGGAAAGTCCGCAATATTGGC-<br>GATGTAGCAGAACAGAAGAACTGTAT<br>TCGCGGACAAATTGTTGAAGATAAAGGCAAGAATACGAAGAAGGAAGA-<br>GACGAGTTTTCGC<br>GGGCCACACTTCGTTGAGTGCTATATTGTTCGC-<br>TATGGCGTTTGTGTCGCACGCTCCCGTA<br>TTGATGTGCCAATTAATATCCTG |
| NTase006 | 22 | ATGGCAGATATCGACTGTCACTCCGAGATGACAAACTTCCATCGCGATAAAGTGACAT-<br>TAA<br>GTAATAAACAGCAGGGGGAGATGCGCACACGTCGTGACGCAGGCCGTACCCGTCTG-<br>GAAAA<br>CGGCTTGAATGAGGCAAAGAAGCCTCAGCCCAATGAGGTGCGCTCGCAGGGATCT-<br>TACCAG<br>ATGCGTACCATGGTGCAGGATGATGCAAATGATTATGACATTGACGACGGGGCTTAT-<br>TTTG<br>CGTCTGACGATCTGAAA-<br>GACAACGCTGGCGTCGCGCTGACCCCTAAAGCCGCGCGCGAACG<br>CGTTTGTAACGCCTTGGTGTGGGACGGCCGCTTGAAACAAGAGGCTACCGT-<br>GAAACGTAAT<br>TGTGTGCGCCAGGTTTATGCCGCTGGTTACCACATCGATATTCCAGTATATCGTAT-<br>CATCA<br>CCACAAATGACGAAAATAATGATCCTGTAGAACATTATGAGTTAGCCTCAGGCGAT-<br>GAATG<br>GACTCGCTCTGACGCGCGCGCAGTGACCCGTTGGTTTAACGGTCTTGTCGGAGAAT-<br>TAAAT<br>AGCGGAGAATCGGACGGCTCACAAATGCGCCGCGTCACCAAAT-<br>TAACTAAGAAGTTCGCAC<br>GTCGCTCGAGCTGGAAGGATGAAACGACTTCTGGGATCTGTATCACCAAGT-<br>TAGTTGTGGA<br>CCACTTCCAATACTCTGCGGACCGTGATGACAAGGCCCTTCGTGAAACGTGGAAAGC-<br>TATC<br>GATAAAAAGTTGCAGAAATCGACTGAAATCGAT-<br>CACCCCGTACTGGCGACTAAACTGGCAC<br>AAGCGGGCGATGCGGCCGTAACGTTCTTCCATACGTGCTTATCAGATGCGCT-<br>GAAAACTCT<br>TGAAGTCTTAGATACAAGTGACTGCACACGTAAAAAAGGCCGTGAAGCCTGG-<br>GATGACGTG |

TABLE 2-continued

| Representative CD-NTase nucleic acid sequences | | |
|---|---|---|
| | | TTCGATATTGATTTTTTTTCAATGCAACCGGATAATAAAGACGACGGAG-<br>GAGGGGGCAAGG<br>GGAGCGCTATGTCAGTGACATCAGTT-<br>GAAACGGCTCGTCGCAACGACGGTGGCGGCCGTTT<br>TGGT |
| NTase007 | 25 | ATGGCAAACCTGGATACTCAGTTTCAAGAGTTTTATGGAGAATTACAGATCACGGT-<br>CACCA<br>AAAAACAAGCTCTGATCACGTCGCACAACAATTTGCGCACCAAAATCCAAAAGTAT-<br>TTTGC<br>TAAAAATCATCCTGAGTATGTACCCTCTTTCTACATTCAAGGCAGCTA-<br>CAAAATGGGTACC<br>ACTATCCGTACCCGTGACGATGAATGTGATCTGGATGATGGTTGCTACTT-<br>TATCCCTAAAC<br>CAGAGGTGAAGGGGATTACTCTTCAGAATTGGGT-<br>CATGGACGCCGTAAACGGTACTGTAGG<br>CGCTACCCCTGTCCATAAGAATAAATGCATCCGTGTCAACTACGCGGCCGGGTATCAT-<br>ATT<br>GACCTGCCGGTT-<br>TATCGCAAGGAGCGCTGTAATGACAACACCGAGCACCCAGAGTTGGCAG<br>TGCGTGACGGGGAATATGAGTTAAGCGATCCGCGCGAAATCGTTCAATGGTTTAACT-<br>CAAA<br>AAAGAAGGACAATCCCGTTCTTATCCGTTTGGTGAGTTACCTGAAGAGCTGGTGCGA-<br>TACC<br>GTGCGTGGGTTTATGCCACCAGGGCTGGCCATGACAATTTTAG-<br>CATCGAAATATCAGAAGA<br>AACATGAGGGGCGCGACGACATCGCATTGCGTGACACATTAAAGTC-<br>TATCCGCACCGCGTT<br>GCAGGCTAACTTCTCGTGTGTTGTCCCTGGGACACCCTACGATGACTTATTT-<br>GAATCGTAT<br>GACAGCAACCGTCAAGAGAAGTTTATGTCTGAACTTAACGGCTTCATCGAA-<br>GACGCTGACC<br>GCGCTGTTAATGAAAAGAACAAACTGAAAGCCTCTAAGCTGTG-<br>GAAAAAACACCTGGGTAA<br>TCGTTTCCACTTGGCTCCA-<br>GACGAAAACGACGCCGAAATGTCTAAACTTGACAAACTTCGT<br>GATATTGGTAACAAAGTGCTGACGGGGATTGCTACAACTGCGCACAACGGATATATT-<br>CATG<br>CTGCGGAAGGTGTGAAAAATGTTTCTCATCGTAACTATGGAAACGAA |
| NTase008 | 28 | ATGGCAAACAACCATGAGCAATTCATCGCATTTAACAAAACGAT-<br>TAACTCGAACAAACGTG<br>CCACGTTGAAGAAGAACCGCGATGCTCTTCGTGAACGTATCAAGAAT-<br>TACTTCTCTCGTGA<br>ATACCCCGACGAGATCCAGCCAAAATTTCATTGGCAAGGTTCTTACGC-<br>TATGCACACAATT<br>TTGAATCCGCTTAAGGATGAAAACAATTTGGGAGTCTATGATTTGGATGACGGAGTGT-<br>ATT<br>TCATCGGGAAATCCGAGGATGAACGCCACAGCGTACAATGGTACCATGACCGTATT-<br>TATGA<br>GGCCGTAGACGGGCATACGAGCTTTAAACCTGACGACAACAAGCCGTGTATCACAGT-<br>CAAT<br>TATGGCGATGGTCACCACATCGACTTGCCAATCTATTTCATGGTG-<br>GAGGGTGACAAGCACC<br>CTCTTCTGGCGCACAAGACGAAATCTTGGCTGGACACTGACCCGCGCGAGCTGCT-<br>TAATTG<br>GTTTAATGGTCGTGATGAACACCCACAGTTGCGCCGCATTGTTCGTTACCT-<br>TAAGGCTTGG<br>TGCGAGTATATCCGTTTCAAAAAGGAAATTAAAATGCCGACCGGCTGCTCTTTGAC-<br>GATGC<br>TTGCTGTCAAGAATTTCAAGAGCAATGAACGCGATGATATCGCGAT-<br>GAAAAATATCTTGGT<br>AGCGATCCATAACAGTCTGTCCTCAAAATTTGAATGTCTTCGCCCAACGTTCCC-<br>CAAAAAT<br>GAAGATTTGTTTGAAGAGTACAGCGAGACCCGTAAGAATAACTTCATGCAGGAAT-<br>TAAAGT<br>CCTTCCGCGAAGACGCAGAACGCGCAATCGAATCCAAGAATCCACATGAGGCGTGCAT-<br>GAA<br>GTGGCAAAAACATCTGGGGGACCGTTTTTCCTGTAGTACTGCGAAGGACGAGGATGAA-<br>GAC<br>GCCCAAACTAAGAGCTTTAGCGGTACTATTAACACCAACTCCCGCTTCGCT |
| NTase009 | 31 | ATGGCCAACGTACAGAAATACTTTGAGGAGTTTCATGAAGCGATCCGCTT-<br>GAGCGACACCG<br>ACGAAAACGAAGAACTGCGTGAAAAGCGCGATATTATTCTGAACCGCT-<br>TAAACGAAAAGAA<br>GGCTGACAACGTGCCTAAGTACACTCCGTTTAATCAGGGTAGTTACGC-<br>GATGGGGACGGGT<br>GTTAAGCCTATTGATGGGGAGTACGATATCGACGTAGGTATTCGCTTTGACAT-<br>TTCTAAAG<br>ACGACTACCCCGACCCAGTAGAGGTCAAAAAATGGGTATATGATGCGCTGCAGGAC-<br>CACAC<br>ATCCGAGGTTAAGATGCGCCGTAGTTGCGTGACTGTGACCTACTTCAAAGACGGT-<br>GAGCCC |

TABLE 2-continued

| Representative CD-NTase nucleic acid sequences | | |
|---|---|---|
| | | GAATTTCACGTTGATCTGGCGATTTACGCCGCTAACAACGATGACGGCAAACTTTAT-<br>TTGG<br>CGAAGGGAAAATTGTATTCTGACGATCAAAACAAGTATTGGGAAGTATC-<br>CAACCCCTTGGA<br>ATTGATCACAAAAATTCGTAACAAGTACGAGGACGCG-<br>GATGACCGTAATCAGTTCCGTCGC<br>GTCATCCGTTACCTGAAACGTTGGAAGGATGTGAACTTCACTACGGATG-<br>GAAGCGCCGCCC<br>CAACAGGAATTGGATTGACCGTCGCTGCCTACAATTTCCTGAC-<br>GATCAGCAAGCAGTATGA<br>TTTTGCTACTGGGAAGTATAAGTACAACGACCTGTCGGCATTGAAGAACTTAGTT-<br>CAATCC<br>ATCCTTTCAAGTTTCCGCTTGGAATACAACCAAGAAGAAGGGAAAGGGGTG-<br>GAGCGTCTGC<br>GTATTAGTTTGCCAACGGAACCATACAATGACTTGTTTGAAAAAATGTCAGAT-<br>TCGCAAAT<br>GGCCGACTTTAAAGTGAAATTGGAAGAGCTGAAGACGACTCTGAATAACGCTGAGGTG-<br>GAG<br>CCCGACCCGCATGAAGCATGTAAAATCTTAAAAAAAGTGTTTGGCAAAGAT-<br>TTCCCAGTGC<br>CCCCAAAGGAAGAGACCGGGCAGCGTAAAAATCTGGCGTTTTTTGG-<br>GAGATCTGCTTCAGC<br>G |
| NTase010 | 34 | atgtctcttcagaacaaatttaagaacttcCATGATGCTATCAAATTGGGTCGTAAA-<br>GATC<br>TTGAATATACTACTGCACGCCTGAAGGACCACTCCATCACCGCGGACAT-<br>TGTAGAACGCTT<br>CAAAGAAGACGGTTACCCTGTTGTTGAAGACTTCATTCAAGGGTCTTTGGCCACGTT-<br>CACC<br>GGGATTCGTGAAAAAGGTCAAGACTTTGATATTGACCGCGCCATCGTGATTGAAGCT-<br>GAAT<br>TGGCTCCTGAGAACCCAATTACCCCTAAACTTGCCGTGCTTGAAGTGT-<br>TAGAGGGCCGTGG<br>ATTCAAGAATGCCAAAATTAAAAAACCATGCGTGACTGCTGATTACAAGGCGGAC-<br>GATCTG<br>CATATTGATATTCCCATTTATCGCAAGTACAATAATGGTGAATACGAATTAGCCGTGG-<br>GAA<br>AGCGTCACTCCACAGAGGATAACCGCGAATGGGCACGTGCCGCCCCACGTGAGT-<br>TAATCGA<br>CTGGGTCAACAACTATGATGCCGATGAGACGTACGGGTCCAATAAACATGATCAAT-<br>TTCGT<br>CGCATTGTTCGCTATCTGAAGCGCTGGCGCAATTTTACGTTCGGG-<br>GATGACGTCCGTCGCA<br>AAGTATATTCCATCGGGATCGCTGTAATGGTTAAGGAATCCTTCGACTCATCCAT-<br>TAATGA<br>TGAAGGCTTTCCAGATGATCTGACAGCGTTGCGTAAGACTATCAACCACATGTTAAAC-<br>TAT<br>CGCTCGTATTTTACACAAGTTGGCGTGGACAAGTATTCTGTAAATGTCACCT-<br>TACCTGTTA<br>GTCCGTACCGTGACATTTTTCATTCATCCTC-<br>CATCGTGACTGGCACACAGTTTCGTAATAA<br>GCTGTCTGCCCTTTTAAAAACACTTAACAAGGTGGCTGACGAG-<br>GAACAAGAAAGTAAGCAG<br>TGCGAGCTGCTTCGCAGCGTGTTCGGGGAGGAT-<br>TTCCCCGAATGTGCCGAAACAAGCAGCG<br>CATCATCCACCGCTGTAAAAACAGTGTTTG-<br>CATCAGCTGGCGTCGTTGgtacgtctcaggg<br>ggcg |
| NTase011 | 37 | atgtcattgcaaaacaaattcaacACTTTCAACCAGCGCATCTACTTAACACGTCAT-<br>GATT<br>CTGAATACAGTAACGCCCGCGAGAAAGACGATTCGATTACCGCCGCTAT-<br>CAAGGCAAAGTT<br>TAAAGAGAAAGGTTATCCAGTAATTGATAATTTTGTGCAAGGTTCGTTGGCGACT-<br>TATACT<br>ACAATTAAAGAACCGGGGAAGGATTTCGATATTGATCGCGCGATCGTTATCGATTAT-<br>GAGG<br>AGTCGCCGAGCGACCCGTTGGTCCCGAAAAAGGTGATTCTTGAGATCCTTGAG-<br>GATCGCGG<br>GTTCCAAAATGCCAAAATCAAGAAGCCCTGTGTAACTGCAGATTACAAGTTGAAGAAT-<br>TTA<br>CATATCGACATCCCCGTCTATCGCAAGAATAGCTGGGGGGGATACGAGTTGGCAGTTG-<br>GAA<br>AGAAGGATTCGGCTGACGAGCACAAGATTTGGTCTGAATCTTCTCCCAAGGAGTT-<br>GATCGA<br>TTGGGTAAACGACTCTTCTCAATATGGCGTTTATGCCACGGAGAAATTGCATCAAT-<br>TTCGT<br>CGTTTGGTCCGTTATCTTAAACGTTGGCGTAATCTGAAGTTTAGTCCC-<br>GATGTTTGCCGTA<br>AGATTTACTCTATCGGTCTTACGGTCATGATCAAACAGAATTTTAAGCCGT-<br>CAATCGACGA<br>GGATGGTTTCCCAAACGACCTTCTTGCGTTAAAAGCAACTGTAGATAGCAT-<br>TCTGGACTGG |

TABLE 2-continued

| Representative CD-NTase nucleic acid sequences | | |
|---|---|---|
| | | TCTTGCTACTTCCAACTTCACTCCGACGACCAATGGAAAGTGAAGGTG-<br>GAACTGCCAGTCT<br>ACCCTTCACGTGATATTTTCCATGGTAGTTCGT-<br>TAAATACTGGGACACGTTTCCGTAACCA<br>GTTCACCAATTTACGTTCGACGCTGCAGGACGTAATTGATACCTCA-<br>GACGAGGCAGAACAG<br>TGTAGTTTATTAGTTAAGGTATTTGGCGATGATTTTCCGAACAATGTTAATACTAAT-<br>TCGG<br>CCAGCAACGCACAGAAGGTTCAATTTGCTACCAGCGGAGCGGTTGgtacaagc-<br>caaggggc<br>c |
| NTase012 | 40 | ATGGCGAACCTGCAGTCTTATTTTAATTCGTTTCACGACGCCATCAAATTGGATTAC-<br>GATC<br>ATAATAAGGAGCTGCGCGATAAGCGTGACGAATTACTGGAAATTTT-<br>GAAGGCAAATATGCC<br>GTCCGACGCTGGAAGCTTTGAAATTTTCCACCAGGGGTCGTATGCTATGTA-<br>CACAGGTGTT<br>AAGCCTCTGGATGACGGTGACTATGACATCGATGTCGGTCTTTTGTTTAA-<br>CATCAGCAAGG<br>ATGATTATCCGAACCCTGTAACCGTCAAAAAGTGGGTGTACGACGCCCT-<br>TACTAAGAATTA<br>CGAAGACGTAGAGATGAAGAAACCTTGTGTTACAGTAAAGTTTAAAGCCGAGGGCGAA-<br>GAT<br>GAACGCAATTACCACGTTGACTTTGCGGTTTATGCGGATTACGAGTCTGATGAAAAAA-<br>CAT<br>ACCTTGCTAAGGGGAAGTTAAACTCAAATGCTGAGAACCGCTATTGGGAGGAAAGC-<br>GATCC<br>CAAAACCTTAGTGAATGACATCAAGAACCATTTCACTGACTCTGAG-<br>GATCGTAAGCAATTT<br>CGCCGTGTTATCCGTTACCTTAAACGTTGGAAGGATATTAAGTTCAAGGGACAAGT-<br>GAATC<br>GTCCAAGCGGTATTGGGCTTACTGTAGCCGGCCTGACCCATTTTCAGCCCAAGTATA-<br>CATA<br>CGACGGGTTTACGAACACGAAGAACTACAAGGACTTGGACGCCATCGAGTCCTTTGTA-<br>CAG<br>TCAATGTTAAATGCTTTTGCGTGGGTGTTCAACGAGGAAAACGAGCTTGAG-<br>GAACGCTTGC<br>AGGTTTACCTTCCGACGCCGCCATACAATGACATTTATGAGAAAATGACGGGTAAGCA-<br>GAT<br>GACCGATTTTAAGGAAAAATTGCAGTGTCTGCTTGA-<br>TAAACTTCAGCAAGCAAAGAACGAG<br>GCAGACCCAGTAGTCGCCTGTAAACTTTTACAGGAAGAATTTGGC-<br>GATGACTTTCCCGTGC<br>CAGAAGAGAGTACCACCGCTCAGAAACGTGGGCCAGCCATTATCGTGGATCAT-<br>AGCTCTGC<br>A |
| NTase013 | 43 | atggcgaacatccagaccTCTTTCATCGATTTCCACAACAGCATTCGCCTG-<br>GATGTCGAGG<br>ATAATACCTTACTGAAGGACTATAAAGACCAAGTTATCGACGGGCTGAAAGACTAT-<br>TTGCC<br>TGACGACGTGAAGTTCGAGACATTCTTGCAGGGCAGCTACTCAGTCTACACAGGAAT-<br>TAAA<br>TCTTGCGACGAGAAGATTGATTTTGATATTGATATCGCTGTGGCATTCGAAATCGAC-<br>CATA<br>CAGTTTACGAGGACCCGCGTGAGCCTAAATTGTGGGTAAAAGAGGCACTGGTTGAAAT-<br>TTT<br>TCCCAACGCACAGGTTAACCTTAAGGTCCCATGCGTGACGGCAACGTTTACGGG-<br>GAAGAAG<br>ACTAAGAAGAATGTACATGTAGACGTAGCTGTCTACGCCAAGGAGGACGAAAACTAT-<br>TTTC<br>TTGCTAAGGCAAAAGAATTTTCAGCGCCGGAGAATCGCTGTTGGGAAGAGGCT-<br>GATCCTAA<br>AGTGCTTAAGGAAAAAATCAATTCTCACGTAGCGGACTCA-<br>GACGACCGTAAACAGTTCCGT<br>CGCTGCATCCGCTATCTGAAGCGCTGGAAAGATAACAACTTCAATCAAGAATACAAAC-<br>CAA<br>CTGGAATCGGCTTGACAATTAATGTCATGGATACATTCTTGGTGAATAAATCGACA-<br>GATTT<br>CTTAACCCGCAAGGTACAATACAACGATATGGAGTGCAT-<br>GAAACAAATCGTCTCCAGCCTG<br>AAGGACTCGTTTGTCTACGAGTACTCTGAGACAGACGGGTGGCAT-<br>TACCGTTTGCACGCCT<br>ATTTGCCTGTAAAACCAAATTCAGATACCTATTCAAAGATGACAGTTAAT-<br>CAAATGTCGGA<br>CTTTAAAAACAAGTTATCGAAACTTTATGATGACCTGATCTTCGCCATTGATACCGAG-<br>GAT<br>GAATATGAGGCCACTAAGCGTCTTAATAATCAATTCGGAGAGGATTTTTTAAT-<br>TATCTCAG<br>AAGAGGAAGTGACTGAAAAAAACTTGCGCAATGCTTTCGTGACagactaccccagcgca |
| NTase014 | 46 | ATGCCCACCTTGCAGTCTCAATTCATCAAATTCCATGACACTATCAAGCTGGATGCA-<br>GACG |

TABLE 2-continued

| Representative CD-NTase nucleic acid sequences | | |
|---|---|---|
| | | ATAAAAAGGTTCTTATTGACAAACGCAAGGAACTTGAAGAAGTTAT-<br>TAATAATGGGGTTTC<br>AGAGTTTGAGAAATCATTTTTTAACCAGGGTTCGTACTCGACGTATACAGG-<br>CATCCTTCCC<br>ATTGATGAAGGCGATTACGACTTAGATCGCGGTTTGAAAATTGACGTTGATCGC-<br>CACTCTA<br>ATAGCCCGAAAGAGGTAAAAAAGTTCATCTTC-<br>GATGCTTTGGTGTCAGAGTTTGGCGAGAA<br>TGGTGTGAAAGTGAAGAATCCCTGCGTGACTGTCAGCTTTCCTGAAGATAATGTGCAT-<br>ATT<br>GACATCGCTGTGTATTGTACTGAAAATGATAATTATTTCCTTGCACGTGGGAAAT-<br>TAAACT<br>CGATTTACGAGAACATCAAGTGGGAAGAAGCCGATCCCGTTGAATTAACGAAAAAGAT-<br>CAA<br>TAATGCTATGGAGAACTCAGAAGACCGCAACCAATTCCGTCGCGTGATTCGTTACCT-<br>GAAG<br>CGCTGGAAAGATTTGAAATTTAAGAACCAAGACAACCGCCC-<br>TACGGGTATCGGTATCAGTG<br>TGTTCGCTGTAAGCAACTTTTCGGTGTCGAAAAAAGTAGATTACCTTAGTGGAAACAC-<br>CAC<br>CTACGATGATATCTCTGCATTGCGTAATTTAGTCAATACTATGATCAACTCATTTAGC-<br>GAT<br>ACCTATGATGTTGATCGCAACCTTTTTTACCCGCGCCTTGAAGTTTATTTACCTGT-<br>TAAGC<br>CTTATACGGACGTATACGAACGCGTCTCTAACATTCAGATGGAAGCCTT-<br>TAAAAACAAGTT<br>AGAGAAACTTCGCGACTCCTTAGATGAGGCTATTAATAGCACTGACCTGTCGGAATC-<br>TACC<br>AAAGTGTTGAGTAAGCAATTCGGTGACGACTTTCCTAT-<br>CATCGAGCAAAAAGAAACGGCTG<br>AGAATTTCGGGACCCGTGCGATTATTTCGGATTACCCTTCAGCC |
| NTase015 | 49 | ATGAATTGCAGTGATCTTTTT-<br>TACGCTGACACTAACACCGAAAACACGCTGCACCAGCGTA<br>CACAATTATCTGAAGTCATCCTTTCAAAGGGCATTGCGAAGAAAAATGAACTTATT-<br>GAGTT<br>CTTGCGCCAAGAATTAAAAGAAGCGTTTGACTGCGATGTCCGTTTCTGGTTACAGG-<br>GAAGC<br>TATAAATCACACACCCTTATTAAACCCGTGGATAAATTTTCTAGCTACGACATCGA-<br>CATTG<br>GTGTATATTTGTTTTTTGACGCAGAGAATGAAGGTGTCGACAGTAAAGACGT-<br>GAAAGAAAC<br>TTTACGCGATGCATTGCTGTCTTACTGCTCGATCAATAACGAGGCCAAGCTTCAG-<br>GAATCG<br>AAGAACGCCTGTGAAGGGTTAAAATTCTCCACTTTCTTAACAGTAGATACGCCCATT-<br>TACT<br>ACAAGACTGATACGAAGATTAAACTGGCAACAGACAAGGGCTGGTCGGATAGCGACC-<br>CAAA<br>GGCAATTCAGGACTGGATTACGAATTACTACAAGGACAAAAGTGACCGCGCGTTGAT-<br>GAAA<br>CGCCTGCTGCGCTATTTCAAAGCTTGGGTTAACGTTAAGTGGCAGAATACTGGATT-<br>TAAAA<br>AAATTCCGAGCCTTGCAATCAATGTACTTGTAGCCCAGCACAT-<br>GAAACAGCACGTTCGCGA<br>AGATGATTGTTTTATCTATACCGCCTTATCTATTTGCGAGGAACTTGAAAGCACCT-<br>TAATT<br>GTCCGCAATCCTTTGAACAATTCAAATTTGATCTCGATGCCGCAA-<br>GATGCAGAGTGCTTTG<br>CCCATCAAAAGTTGGATGAACTTAAGCAGGTGTGTCTGTCGTGTATTAAAAGCGACGA-<br>CAT<br>CAAGCGCGGGGCGCATTTCTCTAATTTGTTTCAGCACTATTTCCCG-<br>GAAATCTCCTTGGAC<br>AGTGCAACTGGCTCCACCGGTTTGCCTACTGTCGTAAATGTCCCT-<br>GAGATCTCTGTCTGCC<br>GTTATGATAAGAATGGGAACCACGTTGAGACTATTATTACAGATCGCCTTACGGT-<br>TAATAA<br>AGGCGATTCCCTTACTTTTACGATTCGCAATCATTATGATTTTAACATT-<br>TACTCCTCCGCG<br>CAATGGACTGTGCGCAATATCGGATCGCAGGCAAATGACGCGAATGATATTGGGCAT-<br>TCCG<br>TCACCGGCAAACCATCCGAGTCCCACAAGCGCGGTACGAGTTATACAGGTTCTCATAC-<br>TAT<br>GGAGTGCATGATTTTACACAACGGTGCTATTATCGGGTTCAAGACTATTCACGT-<br>CATCGTG<br>AAGCCAGCCCGTACCGTGCGCCGTAAGACATTAAAGTTTTGGCGTGCG |
| NTase016 | 52 | ATGTCTTTCGATAAGAATAAACACCTGCGTGAGGTGCTTGATACGCATAAGATGTGT-<br>CACG<br>TCCAAGACTTTGTTAACAAAGTAAAAAAGCGTCGTGAAGAAATTAAGGCAAAGATG-<br>CATGA<br>CCATTACGGATGCGACAAGTACTCTTCCTTCGGGTCAGGCTCCTTTGCGAAGCAT-<br>ACTGCT<br>ACGAACGTTAAGTTCGACTTAGATCTTGTCGAACCGTTCAAACGCAATTCCTTTG-<br>GAACGT |

TABLE 2-continued

| Representative CD-NTase nucleic acid sequences | | |
|---|---|---|
| | | TACAAGAAATGTTCGATAGCGTCCACGATTTCTTGGCG- GAAGAATATAAAAATACCGGGGT TACGATTCGCCGTCAAAAGGTATCTATTGGCGTTAGTTTTCCAATT- GAAGAAGGGGACGAG AAGCCAGTTGAGTTAGACGTGGTGCCGGGACGCGAGTTGTCTGACGACAACTACCTG- GATT CGCACGATCTGAACCTGTGTTTCAATGAGGATCACTGGGGGTTCCAAAAGG- GAAGCTCTCA AAAGACGAATATTCAAAAGCAGATCAGTCATATCGAGGGGAAGTCCTCGGAACGCCA- GATC ATTCGCTTATTAAAAATCTGGAAAAAACAGAAAGACAAAAAATACAAATCAT- TTGTAATTG AACTGGCCGTAATCCGCGCCTTAGACGGATATAATGGAGA- CATGGGTCTGTGGCCCCGTCT GAAATACACGATGGAATATTTACGTGACCACATTGCGGAATCATCGTTCCATCTTTTC- GAT CCGGGTAACACAAATAATGACGTAGTTGGCACAATGCAGGACTATGACCGCCAGTCAT- TCA AAAGTGATATGGAATCAATGTTAAACAACATCGACTC- CAAGGGGGACCTGTACCTTCCGTA CTATTTCAAAGTAAATGAGAAATATTGTGGGTATAAAGAAAAAGACACCGGAGCCGCC- TAT CCGACTTCCACGAAACGCTTCGGG |
| NTase017 | 55 | ATGTCAAGCGCCTATCTGAACGCGATCTTGGCACGCGAGGCGGTTGA- TACCTCAGCCTTTA GTCCTGTTCGCCAAGTACAGACGATTATCGCTCCGGTCCTGCAGCAATGGGC- CAACCGCTT TTTGTTATCTATCTCTCCGTCGGGGTCTTTCGC- CAAGGGCACTGCTAACCGTTCAGGTACA GACATTGATTTGTTCATTTCCCTGCACGAGGACACACCGGAGACACTGAAGGATATT- TACG GGTCGTTATTTAATGCGATCGCCGGCGCAGGGTATGTGCCGAAACGTCAGAACGCCT- CAAT TAACGCGACAATCGGTGGGTTTGACGTAGATT- TAGTGCCAGGCAAGCGTCAGAGCGCCTGG ACTACCGATCACTCTCTT- TACCGCCGCACAGCCGACACTTGGACAAAAACGAACGTGACGA CCCACATTAACACGGTAGTTATGGCTGGGCACCAGCGCGAGAGTCGCCTGCTGAAAT- TATG GCGCAACCAAAAACGCTTAGAATTTCCATCGTTCTACCTTGAGCTTACAGTAAT- TGCTGCA CTTTCAGGACGTACCTCTCCCGACTTGGCTGAAAACGTAGTCACCGTTCTGGAATATT- TAC GCGACAAATTCACCGCCGCCCGCGTCATTGATCCAGCCAATGGCAATAATGTAATT- AGTGA CGATTTGACAGGGACAGAAAAACAGGCAGTCCGTCGCTTGGCAGAGGCCGCGCTTG- GAGGA AATTGGTCAGGTTTCGTACAG |
| NTase018 | 58 | ATGTCCTCGGGACTGGATCGCGTAAAAACCTCATCGGAAGACGAAATGAGCACGGAA- CATG TTGACCATAAGACGATCGCTCGCTTCGCAGAGGACAAGGTAAACTTACCTAAGGT- CAAAGC AGATGATTTTCGTGAGCAGGCAAAGCGTTTGCAAAACAAGTTAGAGGGGTATCTGTCT- GAT CACCCCGACTTTAGTTTGAAACGCATGAT- TCCGTCTGGCTCCCTGGCAAAGGGGACTGCGT TACGTAGCCTTAACGATATCGATGTAGCCGTATACATCAGCGGGTCG- GATGCTCCGCAGGA TCTGCGTGGATTGCTTGATTACCTGGCGGATCGTTTGCGTAAGGCATTCCC- CAACTTTTCC CCCGACCAAGTTAAACCCCAGACATA- CAGCGTGACTGTCAGCTTTCGCGGTTCGGGCCTTG ACGTGGACATTGTGCCGGTTCTGTATTCAGGATTGCCCGATTGGCGTGGGCATCT- GATCAG CCAGGAAGACGGGAGCTTCTTAGAGACGAGTATTCCGTTACATTTGGACTTTAT- TAAAGCA CGCAAGCGCGCAGCCCCAAAGCACTTCGCCCAGGTTGTGCGTTTGGCTAAGTAT- TGGGCGC GTTTAATGAAGCAGGAGCGCCCCAATTTCCGTTTCAAGTCGTTTATGATCGAATTGAT- TTT AGCAAAACTTTTAGATAATGGAGTCGACTTCTCTAACTATCCCGAGGCAT- TGCAGGCTTTT TTCAGCTACCTTGTTAGTACAGAGTTACGTGAACGTATCGTCTTTGAAGATAAC- TACCCAG CTTCGAAGATCGGGACATTAAGTGATTTGGTTCAAATCATTGACCCTGTTAATCCCGT- CAA TAATGTGGCTCGCCTTTATACTCAGAGTAATGTGGATGCCATTATCGATGCTGCTATG- GAT GCCGGAGACGCCATCGATGCTGCGTTCTACGCGCCAACGAAGCAGCTGACAGTTACAT- ATT GGCAGAAGGTGTTTGGATCGAGTTTTCAGGGT |

TABLE 2-continued

| Representative CD-NTase nucleic acid sequences | | |
|---|---|---|
| NTase019 | 61 | ATGCCTTTAACTAACACGCAGATCCGTTATTATGACTCCAACGTCCTGCGTCTGC-<br>CAAAAG<br>ACAAGCGCGAAACGTACAATGCCCAAGTAGATCGTTTGAT-<br>TACCGCCCTGCGCAAGAAGTT<br>GAAAGATCAGGATAAAATCACAATCAAACGTGTTGT-<br>CAAAGCTGGTAGCTTTGCGAAACAC<br>ACCATCCTTCGCAAGACATCTGATTCGCAGGTTGATGTAGACGTTGTCTTT-<br>TACGTATCCG<br>GGGAGAAGGTGGCTGAAGAGACGTTCGCGTCCCTGAGTGAAAAAATTTACGAGGCTT-<br>TACT<br>GAAGATGTATCCTAACAAGGCCGTCGAGGACTTTGAAATTCAACGCAAAGCAGC-<br>CACCGTT<br>TCATTTGTGGGCACCGGACTTGATGTAGATATTGTACCTGTAATTGAGAACCCA-<br>GACAAGG<br>AAGGGTATGGCTGGCAATTTGATCGCATCGACGGTTCTAAAACT-<br>GAAACCTGCGCCCCTTG<br>TCAGATCAAGTTCGTTAAGGAGCGCAAGGATCAAGACCCAGATTTCCGCACATT-<br>AGTTCGC<br>TTAGCGAAGCGCTGGCGCACGAACATGGAATGTCCTCTGAAGTCCTTT-<br>CATATCGAACTGA<br>TCATGGCGCACGTACTTGAAGTAAACGGAAAAGATGGGTCCT-<br>TAGAGAAGCGTTTCCGCGA<br>TTTTCTTTTATATATCGCCGAGTCAGGTCTGAAAGAGGTGATCACGTTTCCG-<br>GAAAACTCC<br>ACTATTCCAGCGTTCTCACATCCTGTAGTTATCCTT-<br>GATCCCGTTTGCGACACGAACAACG<br>TTACGAGTCGTATCACCGAGGATGAACGTAAGGAAATCGTTCGTAT-<br>TGCCGAAAAGAGCTG<br>GGCAACGGCGAACTTCGCTTCAGTCGAAGGTGACTACGACATCTGGAAGGAATTAT-<br>TCGGA<br>CGCTCGTTTAAGGTGGAAGACGCTGCG |
| NTase020 | 64 | ATGTCCTTGAGCAACACAGCCTTAGAATACTTCGATCAT-<br>AATGTGTTGCGCCTTCCCGGCG<br>AGAAACGTAAAGAGTATCATGCCCAGGTAGATAATTTAGTATCTGAGTTGAAAAAACG-<br>CAT<br>TACGGATAAAAGCAAATTGAAAGTGAAGAAGGTAGTAAAGGCTGGAAGCTTTGC-<br>CAAGTAC<br>ACCATTTTACGTAAGATCGACGACTATCCGACGGACGTAGATGTGGTCTTCTATAT-<br>CACTG<br>GGGTGGAAGAGAACTCTAAATCCTATGAGGTTCTTTGCAACCGTATTTACGACCTGT-<br>TAAT<br>TGAAATTTACCCAACCAAAAAGGTCGAGGACTTCGAGATT-<br>CAACGTCGCGCAGCAAAGGTG<br>ACTTTCGTTAAGAGTGGTTTAGAAGTGGACGTAGTGCCTGTCTTGCAGCATTCGACAT-<br>TGG<br>CAGATCATGGTTGGCAGTATGATATTCAGTCAGGCGCCCGCAACTTGA-<br>CATGCGCGCCCTG<br>TCACATTCAGTTCATCCGCACTCGCAAGGACAAAGACAAACACTTTCGTACATT-<br>AGTTCGC<br>CTTGCGAAACGCTGGAAGCATTTTCACGATATTCCTGGCTTGAAGAGCTTCCACATT-<br>GAAT<br>TGATTCTGGCCCATTTAGTAGA-<br>TACCGACGGGGCAGCAGAGAATATCGAAAAGCGTTTTCG<br>TGAATTTTTGGTTTACATCGCACGTACCAAGCTGGGCGAACGCATCGACTTCCCG-<br>GAAAAT<br>GAGGGCAAAACGTCTGTCTCGTTCAGCGACCCCGTGGTTATTAT-<br>TGACCCAGCGTCGCCCG<br>AAAATAATGTGGCTAGTCGCATTACCAAGGACGAGCAGGAACAGATTGC-<br>CAAAGCAGCCGA<br>AGCTGCTTGGGAGGCTGCAACCTATGCGTCGACGAAGAATGACGATGATCTTTG-<br>GAAAGAA<br>ATCTTCGGCGGACGCTTTAAAACCAAAGAT |
| NTase021 | 67 | ATGCAGTTGGCCGATCACTTCAATGTATTACTTAAAGACACAGTGAATTTAAGTCAAT-<br>TCA<br>AATTGGATTTATTGAATCAGCGCGTTGAGGCAATTTACAAAGCATTGAAAGCT-<br>GATGTTGA<br>GATTGGAGCTTTAATTACTGGCAAAACCCCCCAAGGTTCTTGGGCTCACCGCACAAT-<br>TATC<br>AATCCTGTTGGAGACAATGAGTTTGACGCGGACTTTATGCTTGA-<br>TATGTCGCAAAACCCTG<br>ATTGGGCGGACAATCCCAAAACATACATCGATGAAGTCTACGCTGCTTTACATCGT-<br>CACTC<br>TACATACGGCACGATGCCCCACTCGCGTAAGTGCCGCTGCGCCCGCTTAGTT-<br>TACGCAAAC<br>TCTATGCACGTAGATATCGTCCCGCATTTGAACCTTGCTGACGGTCGTGAAGT-<br>CATCGTAA<br>ACCGTGACGACAATGAGTGGGAGTTGACGAATCCTCAGGGCTTTACGGACTGGAT-<br>GAAGAA<br>ACAAGACTCGATCGCATCAGGTAATTTGCGCAAGGTGATCCGCCTTAT-<br>GAAATATCTTCGC<br>GACCACAAGAATAGTTTCACAGGAACCCGTTCCGTACTGTTAACAACAATGT-<br>TAGGCGAAC |

TABLE 2-continued

| Representative CD-NTase nucleic acid sequences | | |
|---|---|---|
| | | AGGTCACAGATCTGCGCAAACTGCTGGACCCCTCTTATTACAGTAATGTGCCAACCA-<br>CATT<br>ACTTCACGTAGTTCAGGATTTAGATACCTGGTTGCAGGCCAATCCTATCAAGCCAT-<br>CAATT<br>GCTGATCCGTCTGGCTCTGGAGTAACATTCGACCATCGCTGGGGTCCA-<br>GATCCCGAAAGCG<br>CTCAAGCGACATATAGTTACTTCCGCGATCGCATTCACGTCCACGCAGCAGATATT-<br>GAAGC<br>AGCATACGAAGAAAAAGACAAGGATCGTAGTGTACAGTTATGGCAGAACATTTTCG-<br>GAGAT<br>GGATTCAAAGCACCCGCAACTACCACTGCTAGCGCTAAGTTTCCTGCGGC-<br>TACTTCCGCTG<br>CTGATAGTACAGTCGGACGCAGCGGTCGCGCCGGA |
| NTase022 | 70 | atgccgatgcttacggtcGCACAGGCATTCGAAACCTTCAT-<br>GAACTCTCTGCGCTTGCACG<br>ACGGGGAGGCGCGCGACGCTACACGTCAAGAACAGTATGTGTTTAATGC-<br>CATGCGCCGCCA<br>GTTACGTCCAACGGAATCATTTATCTCAGGTTCATACGGACGTAACACTGC-<br>GATCCGTCCA<br>TTGCACGACATTGATCTGTTCCTGGTCTTAGCGGAC-<br>GATGGACGCAACCCGCCCGAGCCTG<br>AGGATGCGTTAGCGCGTGTCCAGTGGGCTTTACGCGCAGAGTTCCATGA-<br>TAAAGAAACCCG<br>TCTTCAGAATCGCTCAGTGAACATTAACTTTACCGGGACGGAGATCGGGTTT-<br>GATGTTGTT<br>CCGGCGTTGTATGATCCTTGGGAGCAAGGCGGGTATTTGAT-<br>TCCGGACCGCCGCGCTGGTC<br>AATGGATCCGTAGCAACCCGCGTAAGCACCAAGAGGCTTGTGACGACGCCAAT-<br>GATGTAGC<br>CAAAAAGAAATTGAAGCCGTGGATCAAGGCAATTAAACGCTGGAACTTTCGC-<br>CACGACAAA<br>CCCGTACCGTCATTCTTGCTGGAGGTTTTAGCCTGCCGTGGGGTTACTCACTCCT-<br>TAGGCG<br>ATAAATCGTATGCCGAAGGGCTTGCTCAATTATTCGATTACATGTGCGCCAATATCCT-<br>GAA<br>CCAGTGCCCGGTGCCGGGAAGCAGTGGTCCGACCATCACATCCTGGATCCCC-<br>CAAGGTCGT<br>TTAGTACAAGCGCACCAACGCTTAACCCAGGCCGTGCGCGTAAGCAAGCGCGCTT-<br>TAGAGT<br>TGGAATATTCAGGCTATACGGTCGAGGCATTGGACTTATGGCGTGAGTTACTGG-<br>gaacgga<br>tttccctgttcgt |
| NTase023 | 73 | ATGCTGTCCATTGATGAGGCATTCCGTAAATTTAAGTCCCGCTTAGAATT-<br>GAACGAACGCG<br>AACAAAAGAATGCATCCCAGCGTCAGAATGAGGTGCGTGACTACCTGCAAACAAAAT-<br>TCGG<br>CATCGCGCGTTCATTTTTGACCGGTTCGTATGCTCGTTATACGAAGACCAAGCCACT-<br>GAAG<br>GACATTGATATTTTTTTTGTGTTGAAAGACAGTGAAAAACATTAC-<br>CACGGCAAAGCCGCCA<br>GCGTCGTGTTGGATGACTTCCATAGCGCTTTGGTT-<br>GAGAAATATGGCAGCGCAGCCGTTCG<br>TAAACAGGCACGTTCTATTAACGTCGATTTTGGAGTGCACATCGATGCCGAGGA-<br>TAACACT<br>GACTACCGCGTAGTTAGCGTGGACGCAGTTCCTGCTTTCGACACTGGTGATCAATAT-<br>GAAA<br>TTCCAGATACAGCGTCGGGCAAGTGGATCAAAACTGACCCCGAGATCCACAAGGA-<br>TAAGGC<br>GACGGCGGCACACCAAGCGTACGCTAATGAGTGGAAGGGCCTGGTGCGTATGGT-<br>CAAATAC<br>TGGAATAATAACCCCAAACATGGCGACTTGAAACCAGTCAAACCCAGTTTTCT-<br>GATCGAGG<br>TTATGGCCCTTGAGTGTCTTTACG-<br>GAGGTTGGGGTGGCAGTTTCGACCGCGAGATCCAGAG<br>CTTCTTTGCGACGCTTGCTGATCGCGTCCATGATGAGTGGCCA-<br>GACCCGGCTGGCCTTGGT<br>CCAGCCATCAGCAACGATATGGACGCGGCCCGTAAACAGCGTGCCCAACAGT-<br>TACTTTTCC<br>AAGCAAGCCAGGATGCCAGCATCGCTATCGATCATGCGCGCCGTGGTCGCAACATT-<br>GAAGC<br>TTTACGTGCGTGGCGCGCATTATTTGGCCCCAAATTTCCCTTGTCC |
| NTase026 | 80 | ATGGCCACTACGGTAAATAATGCGTTTAAGGAGTTTATGCGCGATAAAGT-<br>CAACCTGGACC<br>CGGACAAAACTAAGACGGCCCGCAAGTCGCGTGATAATTTGATCGACAATATCCAT-<br>TCGTT<br>GGGGTCGAACGAGGATTTTTTTAATTTGTATCACGACATCGATATCGCGTTTG-<br>GAAGTTTT<br>GCCCGCAAAACCAAAATTCGCCCCTTGGATGACATCGACATTATGATTGGCAT-<br>TAACGGTG<br>ACGGTTCAACATACTACGATTCGGGGTACGAGGTAAAGATCTATGTTAACGATGA-<br>TAATTC |

TABLE 2-continued

| Representative CD-NTase nucleic acid sequences | | |
|---|---|---|
| | | CCCACAGAAAAGTTGCTGCAACGACAACACCAACATTTTAAATTCCACAAAAGTTAT-<br>TAAC<br>AAGTTCATTAAGGAGCTGAAGAACCTTAACGACTACAAGAAAGCGGAAACGCAT-<br>AAGAATG<br>GGGCCGCCGCAACTCTTCAGTTAAAAAGTTATGAGTGGAATTTCGACATTGTTC-<br>CATGTTT<br>TCGCACCACGAAAGAGTCTGACGGTCGTGACTATTACCTTATTCCA-<br>GATGGTAAGGGCAAT<br>TGGCAAAAAACCGATCCACGTAAAGATCGCGACAAGGTCACGACACTGAACCAAAAA-<br>CATA<br>ATGGGTTGATGCTTGAGACCATTCGCTTAGTCAAATACTGGAATCGCCGTCCTAC-<br>TATGCC<br>CTTAATGCCTTCTTACGCCTTAGAATGCTTACTTCTTCAGTATTTCGAT-<br>TCAGTGGACTCG<br>GTTTCCGACTATATTGACTTACGTTTTCGCGACGTACTGTATTATATCAAAGACAA-<br>CATTT<br>GGTACAGCATTAATGACCCAAAAGAAATTCAGGGCGACTTGAACACGTTAACC-<br>TATGACGA<br>AAAGCTGAAAATTAGCAATAAGGCGGAGTCTGACTACGAAAAGGC-<br>CAAGGAGGCAATCTCA<br>GCGGAGATCGACGACAAGGATCACGAGAAAGCGATCAAGAAATGGGCTGAAATCTTCG-<br>GAT<br>CTGAATTTCCAGAGTATAGTGAAGAC |
| NTase027 | 83 | ATGGCAACAACTGTCATTGCCGCTTTCAATGAGTTCATGAAGGATACGGTCAACTT-<br>GAAGA<br>AGGCAGATACTGACGATGCCCGCGCTTCTCGTGACTGGTTAATCGGTAAGAT-<br>GAATGACTT<br>CGAAAAGGATGATAAGTTCCCTGTTTCGTTTCCCGCCATCCATATCGCGTTTGGGT-<br>CATTC<br>GCGCGCCGCACCAAGATTCGCCCCCTTGACGACATCGACCTTATGTTCGGCT-<br>TAACAGGAC<br>AAGGGGCAACTTACACGATCCTTTCGGATCGTATCACCGTAACATCCAGTGGG-<br>GAAGGCTC<br>ACGTTTACACTCATATCGCCACAGTGGGGCTGACACCGTATGTAGCGTCCGCATTTT-<br>GAAT<br>GAGTTTAAGAACCGTTTGCAGGACATCGCCCAGTATGCACAGGCCGA-<br>TATCCGCCGTAATC<br>AAGAAGCAGTGACTCTTAAACTTGTATCAAAAGACTGGAATTTTGATATCGTCC-<br>CATGTTT<br>TATCACTTCAGAGGACGCCTTCGGACGTACTTATTACCTTATCCCAGACGGAAACGGC-<br>CAT<br>TGGAAATTTACCGACCCACGCAAGGATCGTGATCGTGTAACTACCAT-<br>CAACGTTCAGAACA<br>ATGGTAACGTCCTGAATGTAATCCGTGCGGTTAAATATTGGCAGCGTCGCCCTAC-<br>CATGCC<br>TTCCATGTCCTCATATCTGCTGGAGACCCTTATTCTGGACTAT-<br>TACGCTGGACGCACCTCC<br>TGCAGCTCGTTTGTAGATATGGAGTTAGAAGCTTTATTTCGT-<br>CACCTGGGTCAGTCTGTCC<br>GTTATAGTGTTAACGATCCCAAAGGCATCCAAGGCGACAT-<br>TAACTCTCTTTCAGCAGAGGC<br>ACGCAAAGCAATTAGTGATCGTTGCTACTTGGATGCCCAGAAAGTGAGT-<br>GAGGCGCGTTGG<br>TTTGAGAATAATAAGGAGTATGAGAAATCGATCAATAAGTGGCGCGACGTAT-<br>TTGGACCGT<br>TTTTCCCTGTGTATGGA |
| NTase028 | 86 | ATGACGATGACTGTAAACGCCGCCTTCAATGAGTTTATGCGCGACACTGT-<br>CAACCTTCTGA<br>AAGCGGATACTGATGATGCGCGCGCCTCCCGTGACTGGTTGATCGGGAAGGT-<br>CAACGACTT<br>CGAGAAGGATGGGACGTTCCCAGTGAACCACCCCGGTATTCA-<br>CATCGCGTTTGGTAGTTTT<br>GCGCGTCGTACCAAGATTCGTCCTTTGGACGACATTGATTTGATGTTCGGTTT-<br>GAGCGCCG<br>AAAGCGCCACCCACACGATTTATAGTGGGCACATTACGTTAAAT-<br>TCCTCCGGCGAAAACAG<br>CCGCTTACATCAATACCGCCACCCGGGTGAGAATACCATTTGTAGCGTCCGTATTTT-<br>GAAC<br>GCTTTCAAGAATCGTCTTCAAGGGATCTCTCAGTATGCTCAGGCGGAGAT-<br>TCGCCGCAACC<br>AGGAAGCCGTGACGCTGAATTTGTCATCGAAAGACTGGAACTTTGA-<br>CATCGTCCCTTGTTT<br>TATCTCGACTGCAGATGCCTTTGGGAAGAATTACTACTTAATCCCCGATGG-<br>GAAAGGACAC<br>TGGAAGAAGACTGATCCCCGTATCGACCGTAACCGTGTCACAGACATCAATGT-<br>CAAAAATG<br>ACGGAAATGTCTTAAATGTGATTCGCGCGGTAAAATACTGGCAACGCCGTCCGAC-<br>CATGCC<br>CGCCATGAGTAGCTATTTATTGGAAACAATGATTCTGGATTAT-<br>TACGCAAATAAAACTGAC<br>TGCTCAGAATTTATTGATATCGAGTTGCGCGCATTATTTAATCAT-<br>TTGGGTTTGTTTGTTC |

TABLE 2-continued

| Representative CD-NTase nucleic acid sequences | | |
|---|---|---|
| | | GTTATTCAGTTAATGACCCAAAGGGTATCCAAGGGGATATTAATACACTTTCAATG-<br>GAGGA<br>TCGTCAAAAGATTTCCGATCGCTGTTATTTAGATGCTCAGCGCGCTGCGGAAGCACGC-<br>CAA<br>TTTGAGCGTGATAATGATCACGAGAAGTCTAT-<br>CAATCGCTGGCGTGACGTCTTTGGACCCC<br>AGTTCCCTGCGTACGGG |
| NTase029 | 89 | ATGAATGTATCTAATACTTTTCAAGAATTTCTTCAGAATTTAGC-<br>CATCGACAACAAAGAGG<br>AAATCTCCAACCGTTATAAGGAAATCACTAAAGTACTGAATAT-<br>TAAGTACCGTAACACCGA<br>ATCAAAGATCAGTAACTCATTGCAGGTCGGCAGTTATGGACGTTTCACTGCAAT-<br>TAAGGGC<br>ATCTCCGACCTTGATATGATCTACATCCTTCCCCGCACGGAATACAAACGTTT-<br>CAAGGACC<br>ATGGTCAGTCGGCTTTGTTGCAGGAGGTAAAAAAGACTATCCAATCACGC-<br>TATCCTAAAAC<br>TGACATGCGTCGCGATGGGCAGGTCGTCGTCATCAGTTTCACCAACTACCAAATT-<br>GAAGTT<br>CTTCCTGCTTTTGAATGTAAAAATGGAAGCTTCTTATATCCTGATAC-<br>CAACGACGGTGGGT<br>CATGGAAGAACACTAACCCCCGTCTGGAGATTAAAGCTATCTCCGATTTACAT-<br>GAAAAGAA<br>CAAAAACTTGCGTAACCTGTGCAAGATGATTCGTAGTTGGAAGAACTAT-<br>CACAGTGTGGCT<br>ATGGGAGGGTTGCTTATCGACTCACTGGCATACAATTTCTTAAATTCGACCACGTAC-<br>TACA<br>ACGATAAGTCGTTCGCCCATTACGATCAATTGATCAAAGACTTTTTCAAATATCT-<br>GAGTGA<br>TCTTCAGAATACGAACTATGTGTTTGCGCCGGGAAGCTATCAGAAAGTCTACAT-<br>CAAATCG<br>AAGTTCCAGACCAAAGCCAAGAAAGCTCATAAACTGGTATTGGAAGCTATT-<br>GAGGCACAGA<br>AAAATAAAAATGCGAATCAGAAGTGGAAAAAGATTTTCGGTCGTGGGTTCC-<br>CATCGGCTGT<br>TCAACTGGCGACCGAAGCGATGAATGAATCAATCTCAGCGTGGACAAATA-<br>CAGAAGAATTT<br>ATTGAGGACAAATATAATGTTGACATTCGTTACGACTTGTC-<br>CATCGACTGCGAGGTAACTC<br>AAATCGGATTCCGTACTGACAAGTTGTCGAACATCCTTGCTAAAAA-<br>CATCCGTCTTTTGCC<br>CAATAAGGAATTGAAATTCCAGATTATTCACAACGATACAAAAGGTGACTTCGAGATT-<br>TAC<br>TGGAAAGTTCTTAACCGTGGGGATGAGGCGCAGAAGCGCAATATGATTCGCGGT-<br>CAAATTG<br>TCAAGGGTACGAAGATTAAGAAAGAAACGACAAACTTCCGTGGCGACCATATTGTT-<br>GAATG<br>TTACATTGTTCAGAATAACACCGTCGTTGCCAAAGACCGCATTCATGTACCCATTTCT-<br>GAG<br>GGAATTTATAGC |
| NTase030 | 92 | ATGAGTATTTCAGATAAGTTTTCAACTCTGATTGACAACCTGAAAATCACCAATGGA-<br>GACA<br>CCATTTCATCTCGCTATAAGGCTATTACTAAACGCTTGAACACCGATTTTTG-<br>GAACTCCTC<br>CAGCGAAATTTCCCATAGCCGCTATGTCGGTTCGGTGGGTCGTGGCACCGCAAT-<br>TCGCGGC<br>GTTAGCGACGTAGACATGGTCATGGAATTACCTTCAGACGTCTACTGGCAGCAC-<br>GATGCTT<br>ATAAATCCAACGGCCAGTCGGCTCTTCTGCAAGCCGTAAAGGAGTCCATTAAAAA-<br>GACCTA<br>CCCTAACACCCACAATGTCGGAGACGGGCAAGTAGTGGTTGTATCCTTTACTGACGG-<br>GATC<br>AAGTTTGAAGTAATCCCAGTATTTCTGAACCGTGAGGGGACGTATACCTACCCA-<br>GATGCAA<br>ATAACGGCGGCGGGTGGAAAGTAACTGACCCAGTCGCGGAAATCAACGCCATTAAT-<br>GATGC<br>TAATAATACATATAATCAGAAAGTAAAGCATCTGGCCAAAATGGCCCGCGCTTG-<br>GAAGGAA<br>AAGTGCAACGTTCCTGTACCTGGTATCCTTATCGACACCTTGGTGTTCAACTTTAT-<br>GAAGA<br>AATGGGAGTATAATGATAAGTCATTTCTGTATTACGATTTTATGACCCGCGATTTCCT-<br>GAA<br>GTACCTGTCTGAGCAAAACCCATCCCAAGGGTACTGGTTGGCACCCGGTTC-<br>CAATCGCCGC<br>GTGTACGGAAAAGGGAAATTCGAGTCCAAAGCAAAATCTAGCTACAAT-<br>GATGCACTGCGTG<br>CGATCGAGTATGAGAATGCAAAGAAGGAGTATTCTGCAAACCAAGAGTGGCGCAAGAT-<br>TTT<br>TGGGAACTACTTTCCTAGT |

TABLE 2-continued

| Representative CD-NTase nucleic acid sequences | | |
|---|---|---|
| NTase031 | 95 | ATGAGCACGTCGGACCTTTTTTCATCATTTATTGAGAATTTAGCCATTTCCAACATG-<br>GAGA<br>GCATTAGTTCGCGCTATGGCGAGATCACAGCAGCTTTAAACAAGGAAT-<br>TTCGCAACACGGA<br>TAGTAAGATCGCAAACACGTTACAAGTCGGTAGTTTTGGACGCAAAACGGGCAT-<br>TAACGGA<br>ATCTCTGACCTTGATATTTTGTACTTTATGCCTAAGGGGAAATGGACACATACAAA-<br>GACT<br>CCAAACAATTGTCCCTTTTGCAAGATGTAAAATCGGCTATCTTGAAGCGCTACCCGAA-<br>GAC<br>AGAGGTTCGTGTAGACCGCTTAGTCGTTACTATTACATACACAGATTTCCA-<br>CATCGAGGTC<br>CAACCGGTGTTTGAACAAGATGACGGCTCCTTCAAATATCCAGATACTAAA-<br>GACGGTGGGA<br>ACTGGAAAATTACAAAACCGCGCGAAGAGATGGAAGCAGTTTGAAAATTAGATGCA-<br>GACAA<br>AAACTCCAACCTTAAGCGTCTGTGCAAGATGGCCCGTGCTTG-<br>GAAAAACAAGCACGGGGTA<br>GAAATGGGGGGGCTTCTTATTGATACATTTGCATACAATTTCCTTTCGAGTACGGA-<br>TAATT<br>ACGACACCAAATCTTTTAATAGCTATGGCGAACTTAATCGTGATTTCTTTCAATTTCT-<br>GAG<br>TGAGCAGCCTGAACAGGATTATTATCGTGCACCAGGTAGCAACCAGAATGTCCGCGT-<br>TAAG<br>AAGCAGTTCCAGAAGAAAGCAAAAAAAGCGTAC-<br>GATCTTTGCGTAAAAGCAATCGAAGCCA<br>AGGACGAATCTGGAGTTAATGACAAGTGGAAAAAAGTCTTTGGACGTCCCTTTCCAT-<br>CAAA<br>CATCGAGTCCACTTCGGACTCCGTGCAGAAGACAGCTTCCACCCTGTGGAC-<br>CAACACCGAA<br>CAATTCATTGAGGATCAATACCCAATTGATATTCGCTACGATATGAGCATTGAT-<br>TGTAATG<br>TAAATCAGGATGGATTCCGTGAATCAACACTTCGTCAGATGATT-<br>GAGAAAAAATATCCTCT<br>TCAGCCCAAAAAAACGCTTGACTTCCGCATCACATCCATTAACGTGCCTGGCAGC-<br>TACGAG<br>ATTTATTGGAAGGTTCTTAATCGTGGTGAGGAAGCGCGCAAGCGCAATCA-<br>GATCCGCGGAC<br>AGATTATTAAAGACAGCGGCAATTATGAAAAAGTAGAACAAACTCTGTT-<br>CAAAGGCGACCA<br>TGTGGTCGAATGCTACGCTATTAAGAACGGCATCCTGGTGGCTAAAGACCGTATC-<br>CATGTA<br>CCGATTTCCTTAAACGGG |
| NTase032 | 98 | ATGAGTCACCGTGAACTGTTCTCAGAGTTTCTTGAAAACTTGAATTTAGATT-<br>TAAAGCAGG<br>CCAAAAAGATCTCTTACCACTATCGCAAAATTACGAAATCTCTGAAT-<br>TTGGCTTTCCGCGG<br>AACATCTTCCCGTGTCGCCAACCGTCTGAAAGTTGGCTCGGTGGGGCGT-<br>CACACCGCAATT<br>AAGGGCATTAGCGACCTTGATATGCTGTACATTATGCCACCAAATCAATACGAGTAC-<br>TATA<br>ACCGCAAAGATAATGGCCAGAGTGCCCTTTTGACAGACGTACGTAATAT-<br>TCTTGCCGAGGA<br>ATACCCCGACCAAACAGTCAAAAAGGATCGTCTGGTGGTTCAAATTATCTTCAAAAAT-<br>TTC<br>TACGTGGAAGTGCAGCCAGTCTTCCGTCAGGATGACGATAGCTTCAAATTCCCTGAAT-<br>CAT<br>ACAATGGCGGCGCATGGCGCATTACTAAGCCTTTGCACGAAAAAGCTGC-<br>TATGACTGCGTT<br>CTCTCGTGACAAGAGTAACAACTTACGTAAATTGTGTAAAATGATCCGTGCTTG-<br>GAAGAAC<br>TTGCATGGCGTCAACATGGGGGGGTTGTTGATTGACACATT-<br>AGCGTATCGCTTTCTGTCTT<br>CGACTTCCGATTACGACAATACCGGTAATGGCTCCCTGGGCGCCTTGGCCCGCGAT-<br>TTCTT<br>TGAATACTTAAGCAATGAGGAGCGTAAGGAGCGTTATCTTGCTCTTGGTTCTAAT-<br>CAACAC<br>GTACGTGTAAAATCGCCCTGGTTTGGACGTGCTGCTAAACACGCTTATGAGT-<br>TATGCTGTG<br>ATGCGCTTGATGCCGAGGGTGCGGCATCGGAGAATGACCGCTGGCGTAAGGTAT-<br>TCGGACG<br>TGCCTTTCCCCGTCGTAAAGTGGGCATCATGGAAGCCCGTTTAGGATTGGAGTCC-<br>CACGCA<br>GCTGACGCCGTGCCTTGGACAGACACAGAAGAGTTCATCGAGGACAAGTATCCTGTA-<br>GATA<br>TTCGTTACTCATTAAACCTGGACTGTACCGTGACACAG-<br>GATGGCTTCCCGCCCCGCTCTTT<br>ACGT-<br>GAAATGCTGACACGTCGTTTCCGTTTGTCGGCGCGCAAAAGCCTTCTTTTCCGCGCT<br>GATCTTACTGAAATGGAAGCCGAGGAGCCATATACAGTGATGTGGAAGGTCT-<br>TAAATGTTG<br>GCGATGAGGCACGTCGTCGTAATATGATTCGCGGCCAGATCGTGAGTGACGGGGGC-<br>TACTG |

TABLE 2-continued

| Representative CD-NTase nucleic acid sequences | | |
|---|---|---|
| | | CACGAAGAAAGAAACCACCGATTTCCGTGGCGATCACATGGTAGAGTGCTATGTTAT-<br>TAAA<br>AATGAGGTAGTTGTGGCTCGCGCTCAGATCGAGGTGCCGATTTCC |
| NTase035 | 105 | ATGAGTGTTAATTCTTATCTTGAAAACCTTTCACACGAATTAATCATTCGTGACAAT-<br>GAAA<br>AAGAGAATATTAAGAAAAGCATCGAAGTTATCAAAAGCCGCTTGAAGAGC-<br>TACTTCGGCAA<br>CAACATCGTGGAAACCTTCTGCTTTGGCAGCTACACGCGCGGGACGATGCTTC-<br>CACGTAAA<br>GTTAATGAGAATTCAGACGTTGACTACATGGTCGTTTTTTCGAACTCCTTCT-<br>TATACGCCC<br>CCCAGACCTTACTTAATAAACTGCGCGATTTTGTGCGCACATACTATTCCAAAAGT-<br>GAGAT<br>TTACCAGAGCAACCCAACCATCGTTTTGGAATTGAATCATAT-<br>CAAGTTCGAGCTGGTACCA<br>GCGTACTCCAACAATATGTATTTATGGCAGGAGAATCATTATCG-<br>CATCCCGGCGAAAGCCT<br>CGAATTACAATGATTGGATCGATACATGCCCGGATGACAT-<br>CAACAGCCGCCTGACACGCTT<br>GAACGTAGAGTCTAATAACAAATTAAAACCAGCAATCCGTATTATTAAATATTG-<br>GAACTCA<br>CTGAATAACAATGTTTATTCATCCTACGAGCTGGAAAGCGCAATCCTTGAGAA-<br>CATGCACT<br>GTTACTGGCGCACTTCAATTCAAGACTATTTTACGGCAATTACTGAGTCTCTTATT-<br>TATAA<br>CTTTGGTACGCCATCATGGAAGGTCGATAAAATTTCCTCGTTGAAAAAGTGGTATAAT-<br>CAT<br>GCTCTTAAGGAAGAGTACATTTGGCGCAACTATATCCAGTCTAACTTATATATG-<br>GAAAATA<br>TTCTGCCTAGCATTAAG |
| NTase036 | 108 | ATGTCCGTTCAATCACATATTGACAATCTGGCTTCCAAGCTGAACTTAAAGCAAGAT-<br>GAGA<br>AGGACAAAATTGAAAAGAGTATCGCTACTTTGAGTGATCGCTTAAACCGT-<br>TACTTTGACGG<br>AGAACTGACAGATCACTTTAAATTCGGAAGCTACACTCGTGGCACTATTT-<br>TACCTCGTAAG<br>GCAGATGAGTATTCAGACGTGGACTACATGGTGATCTTCAAGAACCCAAATAAT-<br>TATAAGC<br>CTCAAACGTTGTTGAATTACCTGAAGAGCTTTGTTAACTACTATTATCATAGTTCT-<br>GAAAT<br>CTACCAATCCCACCCGACAATCGTCCTTGAGTTGAACCACATCAAGTTCGAAT-<br>TGGTCCCC<br>GCGAAGAAGGACATCTGGGGCAATATTTATATTCCCAGCCCATCTTCCTCATTCGAG-<br>GAGT<br>GGATGAAGACCGACCCTAACGCGTTTAATAAAAAGCTGACGGACGCTAATGT-<br>TAAATACTT<br>CTACAAGATCAAGCCACTTGTTCGTCTGATGAAATATTGGAATCGTTT-<br>GAATGGGTCGTAT<br>CTGTCCAGCTATGAACTTGAGAATTGGATCGTGGAAAACTATTATTG-<br>GAACTGCAACAACC<br>TGAAAGATTTTGTCTACTCGACATTTGAAAAATTAAGCTATAATTACTCAGATC-<br>CACAAGG<br>TTATAAAGATAAAGTGGACCGTGCCAAGAAAATTATCGCT-<br>CAAACAAAGGAGTACGAGCGT<br>AATAATATGCCATACTCAGCTGAAGCAGAAATTAAGAAACTTTTCCCGGACTTT |
| NTase037 | 111 | atgggctcggagcgCATTATGACGACGCAGCAACAGTTCCTGGATTTGCTGTCGGA-<br>CATTG<br>AACCGAGCACTACGACAGTGAACGACTGCTCTAGCGCACACAATACACTTCGC-<br>GATGCACT<br>GAAGGTCCATAATGAGTTCAGTAAAGTACACGTCCACACGTTTCTTAGCGGAAGTTA-<br>CAAA<br>CGCAATACCGCAGTCCGTCCCACGACCATCGGAGGCATTACACAACGCCCCGACGTA-<br>GATA<br>TTATCGCATTGACCAACCATACAATCAATGATGACCCTCAGATCGTCTTG-<br>GATGCGGTGCA<br>CACGGCGCTGAAGGATATCGGTTATACTGATTTGACTGTTAACCGCCGCTCAGT-<br>CAACGTT<br>AAATTAAAAAAAGTAGACATGGATGTAGTCCCAATCATCTCGGACGGGTACG-<br>GAGGGTACC<br>TTATCCCTGACATCCATCTTGAAGAGTGGTTAGTAACCAATCCCCCCGCT-<br>CACACCGAGTG<br>GACGGTTGAGGTCAATAAAAACGCGAACGGACGTTTCAAACCTTTGGTGAAGTTGTT-<br>CAAG<br>TGGTGGCGCCGCSAGAATCTTTCGGACCTTAAGCGTCCGAAAGGATTTATTCTG-<br>GAGTGCT<br>TGGTGGCAAAACACATGAATTATTATGAGAGCAACTATGAGAAACTGTTTGTC-<br>TACCTGCT<br>GGAGACCATTCGTGATTCTTATGGAATTTACGCAAGTTTGGGCATTATCCCGCACCTT-<br>GAA<br>GATCCCGGCGTAGCCGGTAACAACGTCTTTTCTGCCGTAACCGCTGATGAATTTAA-<br>GACGT |

TABLE 2-continued

| Representative CD-NTase nucleic acid sequences | | |
|---|---|---|
| | | TCTTCGAAAAAGTCGAGGAGCAAGCAGCCATCGCTCGTAATGCACTGAATGA-<br>GACTGACGA<br>TGA-<br>TAAAGCGCTTGCGTTGTGGCGCCAGGTCTTGGGCAATCGTTTCCCCCGTTCGGCAAGT<br>CATAAAAGCGCGAATAGTGCTGATATGGCGTCATCTCT-<br>TATCCGCTCTGCGCTGGGTGCTG<br>GCTTGACGTTCCCTAGTACGCCTGTATATCCGAACAAGccgggcggattcgct |
| NTase038<br>aka Ec-<br>CdnD02 | 114 | ATGGAGTTACAACCGCAGTTTAATGAATTTCTTGCCAACATCCGTCCCACA-<br>GACACGCAGA<br>AAGAGGATTGGAAAAGTGGAGCGCGTACACTGCGTGAACGTCTGAAAAACTTT-<br>GAACCCTT<br>GAAAGAGATCGTAGTCTCGACTTTCCTGCAAGGTAGTATTCGCCGTAGCACCGC-<br>CATCCGT<br>CCGCTTGGAGATAAACGCCCGGACGTCGATATCGTGGTCGTCACCAACTTGGAT-<br>CACACGC<br>GCATGAGTCCGACTGATGCGATGGATCTGTTTATCCCATTTTTGGAAAAATAC-<br>TACCCAGG<br>CAAGTGGGAGACACAGGGCCGTTCCTTCGGAATTACTTTATCATACGTTGAAT-<br>TGGACCTG<br>GTTATTACTGCCATTCCAGAATCCGGCGCTGAAAAATCCCATCTGGAACAAT-<br>TATATAAAT<br>CAGAGAGTGTTCTTACCGTTAATAGCTTGGAGGAACAAACTGACTGGCGCTT-<br>GAATAAGAG<br>CTGGACACCCAATACAGGATGGTTAAGCGAGTCGAACTCCGCACAGGTCGAA-<br>GATGCGCCG<br>GCGTCCGAATGGAAAGCCCATCCATTGGTGCTGCCAGACCGTGAGAAGAAT-<br>GAGTGGGGTC<br>GCACTCATCCGTTAGCACAAATCCGCTGGACGGCG-<br>GAGAAAAATCGTTTGTGCAATGGACA<br>TTATATCAACTTAGTCCGTGCTGTAAAGTGGTGGCGCCAACAAAACTCTGAAGATT-<br>TACCT<br>AAGTACCCAAAGGGCTACCCGCTGGAACATTTAATTGGTAACGCGCTGGA-<br>TAATGGGACCA<br>CCAGCATGGCGCAGGGGCTTGTCCAACTTATGGA-<br>TACCTTTTTGTCTCGCTGGGCCGCAAT<br>TTACAATCAGAAATCTAAGCCATGGTTATCTGACCATGGCGTTGCCGAGCACGACGT-<br>GATG<br>GCACGCCTGACAGCGGAAGACTTTTGCTCCTTCTATGAAGGGAT-<br>TGCCTCAGCAGCCGAGA<br>TTGCTCGCAACGCTCTTGCGAGCGAAGAGCCTCAAGAATCTGCTCAGTTATGGCGC-<br>CAACT<br>GTTTGGTTCAAAATTTCCGCTGCCTGGGCCACAGGGCGGCGACCGTAACGGCGGGTT-<br>TACC<br>ACACCGAGTAAGCCGGCGGAACCGCAAAAAACAGGTCGTTTCGCG |
| NTase039 | 117 | ATGAGCAATTTTCCCAGCCTTCGTCGTGATGATCGCCCCGACGACCCATTTGCT-<br>GATCCCT<br>TAGACGCCGTCTTAGCAGAGCTTGCTATTAACATCCAGCTTCCTCCAGGCTTG-<br>CATGCAAA<br>GGCAGTTGAGCGTTATGAAGCGGTCCGCCGCTACATCGAGCGCCCCGGAAGCCCCT-<br>TAGAA<br>GGGCGCGTCGCTTGCTTTTATCCTCAGGGTTCAATGGCTATTGACGC-<br>CACAACAAGCACTC<br>GTGGTACTGACGACGAATATGATTTGGATATTGTAGCTGAAATTGAAGGGCCC-<br>GATCTGGG<br>GCCAGAAGCTCTTCTGGATGACTTGGAAGCTGCGTTGGAGAGT-<br>TACCCAGTAAGCAAAGTC<br>GTCCGTCAAACGCGCTGTATCACCTTATACTACGCTGACGGAATGCACCTTGACAT-<br>CACAC<br>CATCCCGCCGCCGCGCGCCGAAGGAAAAGGAGGGGGAGATTCCT-<br>CACGCAAAAAAGGGTAC<br>TCGTAGCGACCCCGCGCGTTATGTCCCAATGAACTCATACGCGTTCGGGAAGTGGTAT-<br>TGT<br>GCTCGTACGCCAACCGAAGAACGCTTTGCCTTAGCGTTAAACCGTCAACTGTAT-<br>GAGCAGG<br>CAGGGATCGCCTTCGCCGCGGCCGACGTAGAGGATGTTCCACCACAGACTCCTCTTAT-<br>CAT<br>TAAATCAGTTACGACAGTAGCGTTACAATTGATTAAACGTCATCGTAATATTGCAT-<br>ACGCC<br>ACCGAAACGGGACGCATCCCCCCCTCTGTTATGTTATCGTGCCATGCAGGT-<br>CACGCGGCCC<br>GTCCGGGCATGCGTCTTGCCGAGATGTTAATTCGTCAGGCCCGCTGGACCGCTCGCGC-<br>TAT<br>TGATGACGCCGCAAAGCGCGGGCAATTATTAGTGGTCCCGAACCCGGAATTTCCGGTT-<br>GAG<br>CGCTTTACGGATCGCTGGCCCGAGAGTCAATTGCAACAGACGACTTATTCTCGT-<br>CACCTTC<br>ACACACTGGCTAACGGGCTGGAGGCGGCACGTACAGGGGATGTACAATTAGAAGAT-<br>TTGCA<br>GGAGTGGCTTCGTGGTCAATTCGGAGACCGCGTCGTTACGCGTTCGGTGAAAGCTTT-<br>TAAC<br>CAACGTCTTGGACGTCAGGTACAGTCTCGCCAACATGGCTACACTGCTTCGGGCGGGT-<br>TAT |

TABLE 2-continued

| Representative CD-NTase nucleic acid sequences | | |
|---|---|---|
| | | TTGTTCCAGCGGCCCCTGCCATTATCGGGGCTGC-<br>CACCAGTCTGGCGCCGGTGGCTGCGCG<br>TGCCCACACGAATATGGGCGAGCGCCGC |
| NTase040 | 120 | ATGACCACGTTCGCGTATCAAGGTAAAAATCCCTTCGAAGATCCCTTAGACCGTAT-<br>TTTGG<br>CGGAAATCGCTTTCTCCGTACAGCTGCCGCCAT-<br>TCTTGCACGGCAAAGCTTGTCAGCGCTA<br>CAAAGCGGTTCGCGAGTATCTTGAAGGTACTACTTCATTCCATGACCAGATCGAGCAT-<br>TTT<br>TATGTTCAAGGGAGCATGGCTATCGACGCCACAATTTCGACTCGTGGGACGGATGAT-<br>GAAT<br>ACGACATCGATATTGTTGCACAACTGGGGTCGCAGTATCGCCACATGACCCCATTAG-<br>GAAT<br>TCTGAAAGCGTTGGCAGCGGCCTTAAAGGATTATCCCGTACAGAAGATCGTT-<br>CAACAAACT<br>CGCTGTATCACCCTTTTTTATGCGGACAATATGCACTTAGATGTAACTCCTGCAT-<br>TACGCG<br>ATTATGGTACTACAGATCGCCAATCCGCCATCACTCACGCGAAAGGTCCACTTCCCT-<br>CAAA<br>CGATGACTGCATGGTTCCTATGAACGCTTATGGGCATGCCGAATGGTATATGGCCT-<br>CAACA<br>CCTAACGAAGAACGCGTGATTGAGGCATTCAAGGACCGTTGGTCCGGTGAT-<br>GATCGTATGC<br>GCATCCGTGCGGACGCCGACGTCGATGAGGTTCCAGATCAGACACAGTTTGTAGT-<br>TAAAAA<br>CATGGCTACCGTCGCTTTACAGTTATTGAAACGTTACCGCAATGTCCGCTATGCCAAT-<br>TAC<br>TCTGGACGTATCCCCCCTTCAGTTATGCTTTCAT-<br>ACTTTGCTGGCGCTGCTGCACTTCCCG<br>ATATGAATCTTAGTGACATCTTGATTCGTATTTGCCGTTGGATTAT-<br>TGGCGAAATCGAACG<br>TGCAACTATCAATCGTCAGAAGTTGCACGTTGTCAACCCCACCTACTCGGCTGACGT-<br>ATTT<br>ACAGATCGCTGGCCGGAAAATTTGGACCAACAAAATCAGTTCGCACGT-<br>TACCTGCACGACT<br>TAGTGGCGGGAATCGAGCGTGCCAAGCGCGGTGAGCTTGATCCGGT-<br>TAAACTTCGTAATTG<br>GCTTCGTGAAATGTTCGGGGACCGTGTAGTTACACGCGCCGCGGACCGCATGGCG-<br>GATGCC<br>ACGGGGGCTGGTATTGTAGCCGGATCACAGGTATATAGCAAGAAAGGCTC-<br>TATCTTGCTTC<br>CGGCTGCTGCAACTATTGTTACCTCAGTGGCTCCCGTCGTTGCGAAACCGCATACAT-<br>TTTT<br>CGGCGATCCAGTTGATGAA |
| NTase041 | 123 | ATGAACAGTAAGCGCACCCTGGCTAAGGCATTCATGGAGAAGGTCGCGGCAGAT-<br>CAAGAGG<br>CACGTCAGTGGGAGGAATTAATGGTGCAGCTTCTTTCTAAGTTAGAGCT-<br>TAGCGAAGAAGA<br>ACGTGGCCGCGCCTCCGGACACTACGACACAT-<br>TGGCGAAGCAGGTTGCGCGTAAACTGGGA<br>GTTGGGGAGACTGACGTGCACATTGTAGTTCAGGGGTCCATGCGCACTCAAAC-<br>TACCGTTG<br>CTCCCCGTGGACGCGAGAAATTCGACTTGGATATTGTGGTTAAGATGGATGGA-<br>GACCGTTT<br>CATTGGCATTGATCCCGATGAATTCTTCAAAGAGTTTGGAGACAGTCTGCGTGGTCT-<br>TAAT<br>AATGCAGCGGGCGATCCAAAAC-<br>CAAAACCGCGCTGCTGGCGCTTGCAATATCCTAACGAAC<br>CCTTTTATTTTGATGTGACTCCAGCGTTGCCTGGCAGTTTCGATATCACAGGCACA-<br>GATCT<br>TCGTGTTCGTGATCCCGACACCGGCTGGTCCCCATCGAATCCGGAGGACTTCGCTGAT-<br>TGG<br>TTCTGTGAGGCAGCGGAACAGAAATTTCAATTTCAAATGTTGTTAAAGGTTGCCATG-<br>GATG<br>CCCGCCATCAAATCGAGGATGTCCCTAGCGATCCTGTTGCGATTGACGACAT-<br>TCTTCGTCG<br>CACAGTACAACTTATTAAACTGCACCGCGATTTAATGTAT-<br>CACGGTGCGTCGGACGGCGTT<br>AAGGAGGGCAAGCCAATTTCCGTTATTCTTGTGACTCTTGCAACGTGGGCCTA-<br>CAATGACG<br>TGTACCAGGACCGTCATCTGTATAGTAATGCCATCGAGGTGCTTCTTGACGTGGTT-<br>GAACG<br>CATGCCTGAATATATCGAGTTCGATGATGGGGTCTA-<br>CACGGTTCGTAATCCTAAACACCCC<br>GACGAGAATTTCGCAGAGCGTTGGAACGGAGATGATGGAGTACGCGCCAGCGCATTC-<br>TATC<br>GTTGGCACGAGAAGTTGCAGTCCGATTTAACTGCGCTTTTTTCAGACTCCTA-<br>CAGTCGTAG |

TABLE 2-continued

| Representative CD-NTase nucleic acid sequences | | |
|---|---|---|
| | | CACTGAGGAACGCATTCGCAAGATCTTTGGACAACATGGCGTTGACGCGTG-<br>GAAGGCGTCA<br>ATCGCACCGGCTACCAGTGGATTATTGAATAGTCTGATGAAATCCGTGCCGGGTGGT-<br>GAAC<br>GTCGTGACCCCGTGACCCCAGTACCACCAGGCAGTCGCAAAGATACCTTGGCA |
| NTase042 | 126 | ATGAGTAACGAGCAGACCAAGCATCGCTCATGGGAATAT-<br>TTCCTGCTGCGCGCGGCCCGCA<br>AGATCAGCTTATCTGCTGCCCAATATTCTGTTATTGATGCACGCTATTCCCAACTG-<br>GAGAA<br>AATCTTGTCGGCCGCTGATGACCCTCTGTTAGCAGATGCCCATATTTTCCCC-<br>CAAGGCTCT<br>ATGCGTTTACAGACCACCAT-<br>CAATCCAGTGCCTGGGGCACCCGCTGACCTTGGGACAATCG<br>ACGCCGATGCCATCGTGTGGCTGCCGCACGCGCGCGG-<br>CATCGACGCGCGCACCGTGTTGGA<br>AGTGATCGAGCGTCGTTTTCAGGAAGGCTCTCGCGTGCAAGAAGA-<br>CATCCAGCAACTGCGC<br>CGCGGTGTACGCATTGTATACGCTGACGAGAATCCCGGCTTTCATATCGATGT-<br>CACACCAG<br>CCCGTCCGTGCCACCACAACGAGCAGAGTGATGGACTGGGTATGCTT-<br>GAGGTCCCTGACCG<br>TGAGCATGGTTGGAAAGCTTCATCTCCGATTCCTTACGCAGACTGGTTACAC-<br>GATGCCTCA<br>AAACAAGATATCATGCTTGAGCATGTCGTAGAGTTTAATAAGTCTCGTGCAGCGATG-<br>GATA<br>GCGCTACCCAAGCTCCCTTACCTGAGTATAAAGAATACCAGAAAGAC-<br>GATCCCCTTCGCGC<br>GTCGATTAAACTGATGAAGCGTCATCGTGACGAGTGGGCCATTCGCACTAAGAAT-<br>GAAGGT<br>TATCGTCCGATCTCAGCCGTTATCACAACGTTGGCGACGCATGCTTACCTT-<br>GATGTCGTAG<br>CTCAGAGTGAGTATACAGCATTTACCCCTTTACAGGCAATTTTGGCAATCGT-<br>TAATCGTAT<br>GCCCGATCACATCCACCGCTATAGTAATGAGTATTATGTTTGCAACCCGGAA-<br>GACAATGGG<br>GAAAATTTCGCGGAGAAATGGAACCGCCCCGATGAGGGATATAAGTACGTA-<br>GACGCCTTCA<br>ACAAGTGGCACGCTTCCGCCCGTTCAGCATTAACACTGGGCTTAGATAGT-<br>CATGCCTCGAC<br>AGAGACGTTCGCCAAGGCAGTACAGGAACAGTTCGGCATCGGACCAACATTTGTGCGT-<br>GAA<br>GTCAACGAGTCGATTCCTGCCAACTGGACGATGCCTGGCCGTCAG-<br>GATGGGGTGACCCGCA<br>ACTCGGTGTCAATGGGGTCGTTGTTCGGTAGTTCGGTATCGTCAAATCAATCACAGGC-<br>CAA<br>CGTCGCTCCCGTCGGTCGTCTGGGT |
| NTase043 | 129 | ATGAATATGCTTAACATCCCCAGCAAAGTTGATTCTTGG-<br>GAGTACCTGCTGCTTCGTGCCG<br>CGCAAAACATTAGTTTGTCCGAAAGTAAGTACACCCAAATTATGGAGCGCTACAAT-<br>CAATT<br>AGAGAAGATTTTAACGGCATCAAATAACCCCTTGCTTGCCGAAGCGCATATCTTTC-<br>CACAA<br>GGGTCAATGCGCTTACGTACGACAATCAAGCCAGTGCTGGGCGCCCCTGCTGACT-<br>TAGGGA<br>CTGTTGATGCAGATGCGATCATCTGGCTTCCAAACGCTCAGGGTGTTGAGGCGAGCGT-<br>TAT<br>TTTGGAGGCGATTGAAGAGCGCTTCAAGGAAGGAGCTCGTGTTCAGAAGGATAT-<br>TCAGCCT<br>TTGCGTCGCGGCATTCGCATCGTATACGCAGACGTAGACCCCGGGTTCCATAT-<br>TGACGTTA<br>CGCCGGCCCGCGCTATTGATGGGAATGACGAGGAAAAGGGCGAGGGGAAGCTG-<br>GAAGTGCC<br>GGATCGTGTGACTGGGTGGAAGGCCTCCAGTCCAATTCCCTACGCAAACTGGCT-<br>GAAGTAT<br>GTATCCTATCAAAAGATCGAGTTAGCGATGGAATCGTAC-<br>GATCTGGTGCGCAAGCATCAGA<br>CCTTCGATGCTGCGACACAAGAAGAATTACCGGCTTATTCCGATTATAGTGATAT-<br>GAATCC<br>GTTGATTGCGACGATTAAACTTCTTAAACGCCACCGCGACGAATGGGCTATTCGTA-<br>CAGGC<br>TGTAAAGACTGGCGCCCGATCTCCGCAGTCATTACAACCCTGGCCACGCACGCAT-<br>ACTCTG<br>ATGTTGTCAAAATGAGTGCATCTAACCCACTGCGCCCGCTTGATGCAATTTTGGCTAT-<br>TGT<br>GCGTAAAATGCCCGATTACATT-<br>CAATACCTTGGGGGTCAGTTCTTTGTCTGTAACCCCGAG<br>GATGCTGCGGAGAACTTCGCCGAGAAGTGGAACCGTGTTGGTGAAGGCTA-<br>CAAATATAAGG<br>AAGCGTTTTTCCAGTGGCACACAAACGCTATGGCCTCGGTCAGCATCGGCTTAGAG-<br>GATTT<br>TAGTTCCTACGAGTCGTTCGAGGCAGTTATCAAAGAAAAATTTGGCTT-<br>GAGTGGTTCGTTC |

TABLE 2-continued

| Representative CD-NTase nucleic acid sequences | | |
|---|---|---|
| | | ATCTCTCAAGTTAACCGCGAGATTCCTCCCGAT-<br>TGGACACAGCCAGGCCGCGTAGAGGGGA<br>CCACCCGTAACGCGGCGGCGATTGGGATTTTGTTCGGTGGTGAGTCCAATTCG-<br>GAGAATAT<br>TCAGAACACGGTTAAGCCGGTAGGACGTCTGGGA |
| NTase044 | 132 | ATGTCTATGTCGAATGAGCAGACAAAACGCGGTTCATGG-<br>GAGCACTTTCTTTTGCGCGCTG<br>CACGCGAAATTAGTCTTAGTGAAGCACAATACGAAAAAATCAATGACCGCTAT-<br>TCTCAGCT<br>TGAACAAATTCTTAATGCCAGTGACAACCCTCTGTTAGCGGAGGCACACATCTTCGTA-<br>CAG<br>GGCAGCATGCGCCTGAAAACGACCATTAAACCAGTCAGCGGGGCGCCGGAG-<br>GATCTTGACA<br>CAATCGATGCAGACGCTATTATCTGGCTGCCTCACGCGCAAGGAGCCGGAGCT-<br>CAAGAAGT<br>GTTAGATGCTATCGAAGAACGCTTTAAGGCAGGATCTCGCGTTCAAGAGGAGAT-<br>CAAACAG<br>TTACGCCGTGGCATCCGTATTATTTACGCCGACGAAAATCCTGGTTTTCACATC-<br>GATGTCA<br>CACCTGCCCGCGCTATCAATGGAAACTCTCAGGGTAATGGCGAGGGTAAACTG-<br>GAAGTCCC<br>GGACCGTGTGACAGGCTGGAAGGCTTCGAGCCCAATTCCATATAGCAATTGGCTT-<br>CAAGTA<br>GCCTCGAAACAGACGATCTCACTTGAACACTTAGCTGTAGC-<br>CAAAAGTCAGCGTGCTTTCG<br>ATGCAGCTACTCAGGACCCCCTTCCTCAGTACGAAGATTACCTTGACCAA-<br>GACCCTCTGCG<br>TGCTACAATTAAGCTTTTAAAACGCCATCGTGACGAATGGGC-<br>TATCCGCACGAAGAACGCG<br>GACCATCGTCCCATTTCTGCGGTCATTACAACGCTGGCTACCCATGCTTATCTG-<br>GAGGTAG<br>CTAAAGAGTCCCAAACCGCGCCCCTTAAACCTCTTGATGCGATTTTG-<br>GAAATCGTCCGCCG<br>CATGCCCGATCATGTAAAACGTCAAGGGAACGAATGCTTAGTGTGCAACCCCGCGGA-<br>TAAC<br>GGTGAGAACTTCGCAGAGAAGTGGAATCGTCCCTTAGACGGTCATCGC-<br>TACCGTCGTGCTT<br>TTGAGGAATGGCATGAGAATGCTTCTGCGTCGGTTTCATTGGGCCTTGAGTCCTTT-<br>GAAAG<br>TGCTGAAGCGTTTGCAAAGGCTGTAAAGGAGAACTTTGGTATGGGTCCAACATTTATT-<br>AGC<br>ACAGTGAACAGTGAAATTCCCTCAAATTGGACTATGCCCGGCCGCCCA-<br>GATGGCACGACAC<br>GTAATTCCACCAGCATGGGCGCATTGTTTGGGGGATTTAGCGGAACTGCATCATCT-<br>CAAGA<br>GGACGTTAAACCTGTCGGCCGCTTGGGA |
| NTase045 | 135 | ATGCAAACGCCCCAGCGCCGTTCCACCTTCTCGCATCGCGCAGCCACGCAGTTCTTT-<br>CACC<br>TGGCAGACACTATTGCCCGTTCGCATGAGCCTACGTCGACGCAACTGTTGGCGCTG-<br>GAATC<br>TTCATACATTTCCACGGCCGAGTACTTGGCAGAAAGCGACGAGTTTGCTGGACTTAC-<br>TACC<br>AACATCCATGGTCACGGGTCTCGTGCGCTTGGGACACTGCTTCGTCCGTCA-<br>GACGAGAGCC<br>GCGAAGGTTTTGATATTGACTTAGTCGCCCGTTTAGATCAACGTGCAATGCTGCGC-<br>TATGG<br>AGGCGACGGGGGGCCTGGCTTGCTGCTGAACCATCTGCATGCGGTATTATCACGC-<br>TATGCC<br>TCAGCTCACGGGTTGAAAATTAAACGCTGGGAACGTTGCGTCACCTTG-<br>GAGTATGCTTCAG<br>GGATGTTCGCTGACATTACCCCAGTAGTGGACGACCCACTTTCGTGGGCTCCC-<br>TATGGCGA<br>CACGCACGGCCGCGTCCCCGACCGCCAGCTTCGCACGTAT-<br>GAACCGACGAACCCGCGTGGT<br>TTGACTCGCAGCTTCGCTCGCGCCGCTTCCATCGTGCCCGTCTTCACTGCAGTAGAA-<br>CATC<br>TGACTTTCGCGGCAGACTCAGTCCGCAAGTCTATCTCTCCACTGCCCAAGGCGGAT-<br>GAGGT<br>TTTCGAACGCTTACTGAGTCGCTTGGTTCAATTACT-<br>GAAACTGCACCGTAACGTTGCGTTC<br>GGGAAAGCGACCGGGCATGAAGACTTCGCTCCTTCGAGTGTATTCATCACTACAT-<br>TGGCGG<br>CTGCTGCTTATGTTGACTTAGCACCTAAACCTCACTCAACCCCATTAGACCTTTTAT-<br>TGGA<br>TATCGTAGAAGCCATGCCACGTTACTTTACCCGCGAGCGCGACTTTGGTGGCCGT-<br>GAAGTG<br>TGGTATCTTCAAAATCCCTCATCGCCGTACGACAACCTTGCAAGCTCCAT-<br>GAATATGCGCG<br>AGCGTCAAGGCGCGTTTGATGAGTGGCATGCTCG-<br>CATCTGTCGTGACCTGCGTCGTCTGGT<br>GGATATGATCGAAGCTAATGCCGGACTGGATGCCGTTGTTCG-<br>CATCGTTTTGGCCGTCTTT |

TABLE 2-continued

| Representative CD-NTase nucleic acid sequences | | |
|---|---|---|
| | | GGGGAGCGCGCACGTGCCGAAATCTTAAAGGATGACCGCGCGCGTCGT-<br>GAAGCAGGTCGCA<br>AAGCGGGTCGCGTTGCAATCATGGGCGGTTCAGCAGCCCCAAGCTCAGT-<br>TATCGCAAAAAG<br>TAAGCCGCATACATTCTATGGTGAC |
| NTase046 | 138 | ATGCAGAATTTATTCTCAAAGAATAATCTGCTTGATGATCTGTTACAACGCATCG-<br>GAACCA<br>AATTACAGATTGGCAAGACTCAACGTAAGCTGGCCGAAGATCGCTATAATGCCGTCGG-<br>GAT<br>CTGGTTAAGCAAGGACGACGATTTCTTCAACAACGCCAAGATTGAAATT-<br>TATCCTCAGGGG<br>AGCCTTAGCATCGGAACCACAGTGAAGCCGTTGTCCAAGCAGGAGTATGACTTA-<br>GATCTTG<br>TTTGCCAGATTAATGAAAACTGGCAAGGCAAAGATCCACTGCAACTGCTGAACTC-<br>GATCGA<br>AAAACGTTTGCGTGAAAATGAAATTTATGATAAAATGATT-<br>GAGCGTAAGAATCGCTGTATC<br>CGTTTAAATTACGCAAACGAGTTTCACATGGACATTCTTCCCGCTCACCCTTTGGAC-<br>CATA<br>GCACTTCAACAAACGTGAAAGTCCCGGATCGCAAAGCTAAGAACTG-<br>GAAGGACAGCAATCC<br>CAAAGGTTTTAGTCAGTGGTTTAATGAACAGGCGTTACAGTACAACACAAAGTTATTT-<br>GAA<br>ATTCGCGCAGGTATCGAACCCTTACCCTCTGAGGA-<br>TAATGTCGAGCGCAAGCCTCCGCTGA<br>AACGTGCTGTACAGCTTATCAAACGCTATCGCGACATC-<br>TACTTCGAAAAGGACCCCGACTC<br>GGCGCCCATTTCCATCGTCTTAACAACACTTGCATGCAACTTTTATAGCGAGCA-<br>GATCAGT<br>GTCAATGAGTCTATCAGTCACATTCTTAACAGCATTTTACT-<br>TAATCTTCCTAAGAACGGCA<br>AACGCTTGAAAGTTACGAATCCCACCAATCAAAATGAAGATTTGAGCGAACGTTGGAT-<br>TGG<br>ACATCCCGAACTTTATCAAAAATTTGTCGAGTTCATCCGTGTTTT-<br>TAACAAGAAATGGCAG<br>GGCCTTCAAAAGAAAACCGGCATTTCCGAGATCAACGAAGAGCTTAAATTTATGTTTG-<br>GAG<br>AAAAGGTCGCGACAGAATCACTGAAGGACCAAACGAAACTGATTTCAGATATGCGT-<br>GAAAA<br>TGAAAAACTTGCTGTAACGCATACGGGATCATTTGTGGCAGCTGCCT-<br>CAAATAAGAAACCA<br>ACAACTATTAAGCGCAATACCTTTTACGGTATT |
| NTase047 | 141 | ATGTACGGGTCTGCTACTGCTCGTTCTCTTCCGGCAGGGAAGAAGCAACGTAT-<br>TGCGGACC<br>TGCTTAGTCAGATTATCGAGACGTTGGACTTAACCAAAACACAATACGCGAATAT-<br>CAAATC<br>TGCTTACAACGGCGTGGGCACGTTTCTGAGCGAAGGTGATGATCCCCTGTTGCAA-<br>GATGCG<br>GTTATTTATCCACAGGGCTCCGTGCGCCTTAACACTACAGT-<br>CAAACCGAAAAACGAAGAGC<br>AGTATGATATCGACCTTATTTGTTACTTGCCTCATGCTAGGGAGGCAGACTA-<br>CACAGGCGT<br>GATTTCGGCCATCCGTCGCCGTTTGGAGTCTCACAACACGTACAAAGACTTAT-<br>TGTCGGAC<br>CTGCCGCGCGGTTTTCGTATCAACTACGCCGGGGATTATCACTTGGACATTA-<br>CACCGGGTC<br>GTGAACATACAGGGGCACAA-<br>CATCCCGGCCAGCCCTTGTGGGTAGTGGACGCGCACACAGC<br>ATGGAAGGAATCCAACCCTAGTGGTTACGCAGAGTGGTTCGA-<br>TAGCAGCGCAAGTGTCCAG<br>CCTTTGCGTACCATCTTAGTGATGGACAGCGCTTCGCGCGTCGGAACCGAGGCTTTAT-<br>TAC<br>CGCTGCCTGACAGTACGGACAAGAAGCTGCTGAACCGTATCGTTCAAATTCT-<br>GAAACGTCA<br>TCGTGACGAGTGGGCCGCCGAACAAGACGATGTACGCCAGCGCTGCCGCCCCAT-<br>TTCAGTC<br>ATTATTACGACATTAGCCTGCCATGCTTACAATCACATTATCGCC-<br>GATCGTCGTTCGTATG<br>ATAATGACCTTGATATTTTGTTGGACGTTTTAGAGTTGATGCCCGATTTTATCGTGAG-<br>CAT<br>CCAAGGGGAAATCCAAGTATCGAATCCGCACATGCCG-<br>GAAGAAAACTTCGCAGAGAAATGG<br>AATCGCAGTGAACAAGATGAAGGCCCGCAGCGCTCCGAAACCTTCTATCAATGG-<br>CATGCAG<br>CCGCTCAAGCTACGTTCAACACAATTGCTGCATCCGTAGGTGAGGATAACTTGTTCTT-<br>GAG<br>TTTAGAGGATGGTTTTGGGAAAAAGCCTGTAGATGTTGTCCGCCAGCGTTTGATG-<br>GAACAC |

TABLE 2-continued

| Representative CD-NTase nucleic acid sequences | | |
|---|---|---|
| | | ATGCAATCGGCCCGCGAGCAAGGTAGCTTGCAATTGGACAAAAAAACCGGGGGTT-<br>TAATCG<br>CGACCGGCCTTGCCAGTACGGCGGCACAAGCAGGAGTGCCAAAAAATACGTTC-<br>TATGGTGA<br>A |
| NTase048 | 144 | ATGCGCCAGTCCCAGTTGGTAGACTTGATTGAAGAGGCCTGCCAGCATTTG-<br>GAGCCTTCGG<br>CACACCAGCGCGATCTGGCCAAGCAACGCTATGAAGGAGTGGGCGAATGGT-<br>TAGCCGCGGC<br>TGACGATTGGTTACTGACATCTATTGCGATCCGTTTACAAGGTAGCGTAGCGAT-<br>TGGCACC<br>ACAGTCAAGCCGATTGGTAAAAACGAGCATGATGTTGATTTAGTAGCACATGTGGCC-<br>GATC<br>TTGATTTGACCGTCTCTCCCGCACTTTTAAAGCAACG-<br>CATCGGCGACCGTCTTCGCAGTAA<br>TGGTCACTACGCACCTCTGTTAGTCGAGATGCCCCGTTGTTGGCGTCTGGATTATGC-<br>CAAC<br>GAGTTTCATTTAGACATTACTCCTTCTATCCCGAACCCCGAATGCCGTTTCTGTGGT-<br>GAGT<br>TGGTACCTGACAAGACATTAAAAACGTGGAAAGCAAGTAACCCCCAGGGA-<br>TACCGCGCGAA<br>GTTCGAGCGTCGTGCTGCGTTACTGCCCCGTATCCGTTCTGTATTCGG-<br>GAAGGCCTTCGAC<br>TCGGCTCACGCTAATGCACAAGTTGAACCGTACCCTGAAGAAAAGCGTCTTAAAGG-<br>CATCC<br>TGCGCCGTATTGTGCAAATCGCCAAACGCCACCGCGATATCCATTTTATTGACGAT-<br>GATCA<br>AGGGCTGGCACCATTAAGTATCATTATTACAACGTTAGCTAGTCGCGCGTACGAGA-<br>CATGT<br>GTGTCAAATTTTGAGTATGACCACGAGCTTGATCTGATCGTG-<br>GATGTGCTGCGCCGTATGC<br>CGCAGATGTTACAAACCTCAATGACCGAAGGTCGCGTGATGTGGTGCTTATGGAACCA-<br>GAC<br>AACTGCAGGTGAGAACTTCTGTGAAAAATGGAACCGTCACCCAGAGCGCGCCACTG-<br>CATTC<br>TTCGAGTGGCACTCCAAGGTGGTCGCTGACGTCGAA-<br>CATCTGGCCGCTGCACGTGGCTTGG<br>ATCAAGTGCGTCGTGGCTTAGGCGACATCTTTG-<br>GAACTGCACCTGCTAACAAGGTAATGGA<br>TACGTTGACGGAACGTGTCGACAT-<br>TGCTCGTCGTACTAACCGCCTGTTGGCAACTCGTTCA<br>GCGGGACTTATCATGTC-<br>TACTGCTGCCTCCGCGACTCCTGTGCGCGCGAATACTTTTTTTG<br>GAGACGGCCCG |
| NTase049 | 147 | ATGAACCAGATGTTTACAGCACCTCCCCAAACCCACCTTCTTTTGCGCAAGGCG-<br>GAGGTCT<br>ACTCTCTTTTAGATCAAATTTGCCAGGCGTTAGAGCTGACGGCTGCACAGTTG-<br>GAAGCAGC<br>CCGTACATCTTACGAAGCAGTCGCCGAGTGGTTATCCGGAAGCGACAATCCACTGT-<br>TAAAG<br>TGGATCGACATCTACGCTCACGGCAGCACTGGGCTGGGCACCACCGTAAAAC-<br>CAATCGGGC<br>GCGAGGACTTCGACGTCGATTTAATTTGCAAGGTCCTTCGTTTTACAGCGGATCGCC-<br>CACC<br>GGCAGAACTGAAGCGCATCGTCGGGGACCGTCTGAAAGAAAATGCCCGCTACGCAGC-<br>TATG<br>CTGGAGGAGAAAAAACGCTGCTGGCGCCTTAATTACGCGCGTGAGTACCATCTGGA-<br>CATCT<br>CTCCTACGATCAACAACGCCAAATGTGCCAACGGGGGT-<br>GAACTGGTCCCTGACAAAAAATT<br>ACGCGAGTTCAAGCCAACGAATCCAAAGGGCTA-<br>CAAAGCGTTGTTCGAGCGCCGTGCGGCT<br>TTAATTCCAACGCTTCGCATGCAAAAAGCCTTAGCTGCCGAG-<br>GATCGCGCCGCAGTAGAGC<br>CTTTTCCCGTTCATGGAACCGCCAAAGGCATCTTACGCCGCACAGTGCAGATCCT-<br>TAAACG<br>CCATCGTGATGTCCATTTCTTAGAAGTTGTGGAGGAGATTGCCCCCATTTCGATCATT-<br>ATT<br>ACGACGCTGGCCGCGCAGAGCTACGAATATTGTGTAAAGAGTTTTGTAT-<br>TCGACTCAGAAC<br>TTGATGTACTTATTGCAACGATCCGCTTGATGCCACACTTTATCGACAAACCGGTCGT-<br>CAA<br>TGGGCGCCGCATTTACGTGGTTGCGAATGAGACGACTGTGGGTGAAAATTTTGCG-<br>GAGCGC<br>TGGAATACTGAACCTGCGCGCGCAGCCGCCTTTTATGAGTGGCACGCTAAGGCATT-<br>AGCCG<br>ACTTCGAAGCTTTGCCGGATCTTCAAGGCATTGACGTGATCGGTAAAAGTCTGGAGG-<br>GAAG |

TABLE 2-continued

| Representative CD-NTase nucleic acid sequences | | |
|---|---|---|
| | | TTTGGGAAGTTCAGTTGTCCGTAAAGTCATTGACGCTCGCACCGACT-<br>CAATCAGTCAGGCA<br>CGCACCGCCAAAAAACTTTATGTAGCTCCGACTGTCGGACTTACCCT-<br>TAGTTCAGCGGCCA<br>ATGCAACACCCGTACGCTCCAACACTTTCTTCGGTGAC |
| NTase050 | 150 | ATGGATACTATGGAACAGATGCTTTCTATGCTTTTAAGTGGCGCAGTTGAAACCTTA-<br>GACA<br>TCCCCCCCCACTTACAAGCCCTGGCCATTGCCTCTTATGAAGAAGTTGGTAACTGGT-<br>TAGC<br>TGAACATGGT-<br>GAACACCGTTGTCGTGTGTATCCGCAAGGTAGTTTTCGCCTTGGGACTGTA<br>GTCCGTCCACATTCGTTAACGGGGGATTTCGACATTGACCTTGTCTTTTT-<br>GATGTTGCTGG<br>CAAAGGAAGCAACCACCCAAGCCCGTTTAAAGCAGGATGTCGGCGACCTTCTGCACT-<br>CATA<br>TCTTGATTGGAAGGAGCGTAATGGCCACCCTGGCGGTTT-<br>GAAAACCTGCGAGAGCCGCCGT<br>CGTTGCTGGACGTTGGATGATCCAGTCAATGGTTTCCATCTTGACGTTCTGCCGGC-<br>CATCC<br>CGGATCTGGAGTATCTTCCAACGGGCATCCTGCTTACTGACAAAGAGCTGTTC-<br>CACTGGCA<br>GCACTCAGATCCGATTGGGTACGCCAATTGGTTCCGTCGCCGTAGTCAGGAACTT-<br>CAAAAC<br>AAGGTTATTACTGCCGCCGCACAACGCGGTGTTGATGTCGAAGATGTACCCATCTGG-<br>GAAT<br>TCCGCACTACGTTACAGCGCGTGGTCCAGGTGCTTAAATGGCAT-<br>TGTATGTTGTACTTCGC<br>CGATGATCCTGACAACCGCCCCCCATCTATTTTAATCAC-<br>TACTCTTGCTGCAAAAGCGTAC<br>CGTGGGGAGACCGACCTGTTTACCGCAACTCGCAACGCCTTGGCAGGGATGAATCGT-<br>TATA<br>TTGAGGACCGCAATGGCGTTAATTGGGTCGCTAACCCTGCTCACGAAGAG-<br>GAAAACTTTGT<br>AGACAAGTGGAAAGAATATCCGGAGCGTCGCAAGGCCTATTATGCTTGGCAACGTGAT-<br>TTG<br>GCAGATACACTTGACGACGCCCT-<br>TAGTCTGCGCGGTAAGGGTTTGCAAACAGTAGCCTCTC<br>AGTTGGCACAGTCCTTTGGTGCAGAGCCGATCCGCCAAAGTACCTT-<br>GAAATATGGACAACG<br>TATGCGCGGACATACTACTAATCGTTCACTGCGTCTGGGAACGACCGGAT-<br>TGCTTGCCCCT<br>TCCGCGACGGGTATCGCCGTACCGCCCCACAATTTTTACGGGCAGCATCCCGATCCTT-<br>CAC<br>AT |
| NTase051 | 153 | ATGGAAAATATCATTATTGGCAAAGAGATTAAGGAACTTATTGAAGAATTA-<br>GACGTCTCCG<br>ATTCGGAATATGAAGAAGCAACGAAACGTTACAATAGTATCGCCGAATATAT-<br>CAAGAACTC<br>GGAACTGGACTCCGAAAAACCCGATATTTATTTGCAAGGATCTTTCAAATT-<br>AGGGACAGCC<br>ATCCGTCCGCTGACAGAAGACGGCGCATACGACATCGACATCGTGTGCAACTT-<br>TACTAAAC<br>TTAAAAAGGAGGATCAGAGCCAGAGTTCGCTTAAGTACGAGTTGGGCAAGGTCGT-<br>GAAGCA<br>GTACGCCAAAAGTAAGTCCATGTCTAATGACCC-<br>CAAAGAGAGTAAACGCTGCTGGACGTTA<br>AAGTACGTTGACGACAATAATTTTCACATTGACATTTTGCCCTCCGTGC-<br>CACTGCACAATA<br>AAGATGACGAATACATCGCCATTACGGATAAGGCAAAGGATAACTATTTT-<br>GAGATCAGCTC<br>CAATTGGGAGACCAGTAATCCAAAGGGCTATGCCGATTGGTTTCGTGAGGTATC-<br>CAAATAC<br>ACAGTATACCAAGAAAAGATTGCAAAGCGCTTCTATGCAAGTATTGAAAAAGTTCCT-<br>GAGT<br>ACAAAGTGCGTACCCCTCTTCAGCGTATTGTGCAAATCTTAAAACGTCATGCG-<br>GAAATCTG<br>CTTCGAGGATGATATTGAGTTTAAGCCAGGAAGTGTTATTAT-<br>CACGACACTTGCCGCAAAG<br>CAGTATCGCCTTGCCTCGAGCATTCACAATGATTTTTGGGACGTCATCTCCTATAT-<br>CATCA<br>ATCATCTTAAGGACGGCATCGAGTTGCGTAATGGAAAACCCTGCGTATACAACCCGGT-<br>GAA<br>TTACAGCGAGGTCTTATCCGGAAAATGGGACAAGGACAAACGCTACGTGGAGGCCTT-<br>TAAT<br>AATTGGTTGAAGCAATTGGAGTCGGACTTTAATATTGGGAATGACGAAATCACC-<br>TATCCTA<br>ATCGCATCCAGTATCTTAAACGTAGTTTGTTTAAAAACGCCCGCAGCCAGTTCCCGAT-<br>CAT<br>TAACGTTACATCATTGCGTCATCAGGAAAAAAGTAAATGGACT-<br>GAATGTTTGGTAAAGGAT<br>GTATTCGTTAAAGCAATGTATTCACAAAATGGGTTCCGCTGGAAGACCAT-<br>TCGTAGTGGCA |

TABLE 2-continued

| Representative CD-NTase nucleic acid sequences | | |
|---|---|---|
| | | CCGCTCTTAACAAACACGGTGACCTGAAATTCGAAGTCAAAGCCAATGACTT-<br>GAAGCAATA<br>TGAGATTTGGTGGCAAATCACAAACACCGG-<br>GAAAGAAGCAGAAAACGCTAACAGTTTGCGC<br>GGAGATTTTTATTCCTCGGAATTAATCGAAGGTAAGAAGATCAAAAAGGAATC-<br>CACTCTGT<br>ACACTGGCCGCCACTTCGTGGAAGCCTACCTTGTGAAAGATGGGAT-<br>TTGTTTCGGTAAATC<br>TCAGCCGTTCGAAGTTAATATCGTGGATAATTTTACATTGGACTTCGCCCGC |
| NTase052 | 156 | ATGCCAACCAAGAACGCTGAGGACTTCCTTACGGCTTTAGCTGAAGAACTGGC-<br>TATCTCCG<br>ATTCCCGCTATGAACAGGCATGCCGCAGCTACACCAGTTTGGGGGAATGGTTG-<br>CATCGTCC<br>CGAATCCGCTGTGGCTAAATATGACCCCCAGGTTTACGTGCAGG-<br>GAAGTTTTCGTCTGGGC<br>ACCGCAATCCGCCCTTTAAATGATGCT-<br>GAAGAGTATGACGTGGACTCCGTGTGTCTGCTTC<br>AGAGTTTAGGAACGAAGGATTTAACCCAATACAACTTAAA-<br>GACTCTTGTTGGGGACGAGAT<br>CAAAGCTTACCGTAAGGCACAGAACATGGTTAAACCTGTTCGT-<br>GAGGGCCGTCGTTGTTGG<br>GTTCTTGATTATGCAGATGGTGCACAATTCCACATGGACGTGGTTC-<br>CATCTCTTCCTAATG<br>CGACACAACAGCGTATCCTTCTTGAGACTTACGGTTATGACCT-<br>GAAATGGTCAGAAACAGC<br>GATGGTTATTACCGACATCGAATCGCCCGTTTACCAGGTACTTTCAGA-<br>TAACTGGCAACGC<br>TCAAATCCTAAGGGCTATGCGGAATGGTTTAAAATGCGTATGCGTGACGTCTTT-<br>GAGCAAC<br>GTCGTAAGATGTTGGCTGAAAGTATCAAGGCGAGCGTTGAGGAGATTCCGGAT-<br>TATAAGGT<br>CCGCACCCCACTGCAGTCTGCGATTATGATCCTGAAGCGCCATCGTGACGGCATGTTT-<br>GAG<br>AAACGCTATGATGAACGCCCCATTTCAATTATTATCACAACCTTGGCAGCGCACGCC-<br>TATA<br>ACGGTGAGGTGAAAATCGCGGATGCTTTATATTCCATTCTGAGCCGTATGGACAGCTT-<br>TAT<br>CGAGCGTGACGGTGGCCGTTACATCATTCGTAACCCCTCCGACCCGCTG-<br>GAAAACTTCGCG<br>GACAAATGGCCGAATCACCCCGAACGTAAAGATGCTTTTTATGAATGGTTAGAC-<br>CAAGCTC<br>GCCAAGACTTCGGCAATCTGGCCCACCAAATT-<br>GAGAAACGCCGCCTTGTCGAATCCGTGCG<br>TCCCCACATGGGCGCGGTCGCCGACCGTGCTGCAACCCGTTTGAGCCCTACGCCGG-<br>GATCT<br>ATGCTGCAGCCAGCTACTGGTGTTGCCGCTCTTGGAGTCGTTGCAGCTTC-<br>CACACCCGCGT<br>TCCCCAACACACGTCGCGAGCCTACCTCACCTAAAGGTTTTGCT |
| NTase053 | 159 | ATGTCGAACACTAAGTCGAATGATGTGTTAAATACTATTTTAGAGAAGATCGAAT-<br>TGCCCG<br>ACTCAGCCTACGAGAAGGCCGAAAAGCGCTATAAAGACCTTGGAGATTGGTTA-<br>CACCGTCC<br>CGAAAGTACGTGCGTCAATTTTGATCCTCATGTATTCT-<br>CACAAGGCTCCTTTCGTTTGGGG<br>ACGGCCATCCGTCCAGATTCAGAGGAACAGTATGACTTGGA-<br>CATGGGGTGTAACCTGCGCC<br>GCGGGTTAGATAAGACTAGCATTACGCAAAAACAACTGAAGCACCTTGTAGGT-<br>CACGAGCT<br>GGAACTGTATCGTAACGCTCGCGGTATTAAGGAAGAGT-<br>TAGCAGAAAAAAAACGCTGTTGG<br>CGCTTAGAGTATGCAGACGGGTTATCATTTCACATGGATATTGTGCCCTGTGTCCCT-<br>GAGA<br>GTGATACGGGACGTGGGTTGCTGAAAAAGTTGATGGTAGAGAACTCTAAATTTGAT-<br>GAGAA<br>CCTGGCTCAAAACGTATCACAGTTGGCAGTGTCTATTACAGATAACACCGATTTTA-<br>CATAC<br>GCAGTTGTCAATGAGAACTGGCGTATTAGTAATCCT-<br>GAGGGGTACGCGCGCTGGTTCGAAA<br>CGCGTATGAAGACAGCTCGTTTAGTAATCAATGAGCGCGAGATGCGTTT-<br>TAAAGCCAGTAT<br>CGATTCGCTGCCTTATTATCAGTGGAAGACTCCCTTGCAACAAGTAATCCAACTTCT-<br>TAAA<br>CGCCACCGTGACACCATGTTCAAAAATAATGAAGACTCGAAGCCCATTAGCGTTAT-<br>CATCA<br>CAACTCTGGCGGCGAAAAGTTATAAGGGGGAAAGTGATCTGGCATCAGCATT-<br>GAACACCGT<br>TCTTAGCGAAATGGACGATCATATCTCTGCTCAGGCCCCTATGATCCC-<br>CAATCCTGTAAAC<br>CCCGCAGAGGATTTTGCCGATAAGTGGTACGATGAAAAATCGGCT-<br>CAATACCGTCTGCAAG<br>AGAACTTCTATAAGTGGCTGTATCAGGCACGCGCCGATTTCAGTGCGT-<br>TATGTAGCTCAGA |

TABLE 2-continued

| Representative CD-NTase nucleic acid sequences | | |
|---|---|---|
| | | TGATACGCAGCGCATTGTAAACGCTGCTCAGAACGGCCTGGACTTAAAGCTTGAT-<br>TCGTCA<br>TCCGTAGCTCGTCTGTTGGGAATCCCAGCCGTGACGGCTAAGC-<br>CAACCTTCGCAATCCAGT<br>CCTCAGATCCTAAACCGTGGTTCAAACAG |
| NTase054 | 162 | ATGCAAGACCAAGGTTTCAAGTCTCTGCGTCAATTATCTGCGTCGGACAAGGAAT-<br>TTTGTT<br>TCGAAATGATCTCGCACATTACAAGCAATCTTGACCTTACGGAAACTCAGT-<br>TATCGCAGTT<br>GAAAACAGCGTACCGCGCTATTGGTTCATACCTTGCCAACCAAGGGGGCGAATTAGCT-<br>GAG<br>TGTCACATTTACGCGCAGGGTTCCGTCGGAATTGGAACATCGGTCAAGCCAATCGAT-<br>GAGG<br>ACAGTGACATGGATATTGACTTAGTGTTGCATCTGCCATCCCAACACTACCCTA-<br>CAACAAC<br>GGATGAGGCTAATGAATTACTTTTTAACTTGATTCGCGTGCTTAAAGATTCCCAACGT-<br>TAC<br>GGCGACAAGATCGAAAACATGCCAAAGCGTCGCTGCGTGACGTTACAATACGGTG-<br>GAATCG<br>AGGGGCAAGGGTTCCACATGGATATTACGCCCAGTATGCCGGAAGATATGGAT-<br>TCTCCGAA<br>CCATAAATCAAAAGTTCGCGTCGCCGACATTAAGGACGCGAATAGCCCCAGC-<br>CACCCGTAC<br>GGCTACCGTAAATGGTTTCGCTCCGCGTGTAGTAAGGAGATTCGTTG-<br>GAACCGTAAATCTA<br>ATTACCGCAGCAACAATGACATTTATGCCGGGACGGTCGAACCTTTGCCCGGC-<br>CAAGGCCG<br>TAAGACGGTGCTTCAAATTGTCGTTCAATTGTTGAAACGCCACCGCGATATGTG-<br>GAAGCAG<br>AATAAGCAAAATGTGTATGGCGATTGTGCCCCTATCTCGATCATCATCAC-<br>CACGTTGGCCG<br>GTTTGGCATACGAAAAGTGCAGTAACAGTAATAAAGAGTATTATAACCCCTTTGACT-<br>TAAT<br>GTTAGACGTGCTGGAGGAAATGCCCAATTTCATTTCGCAC-<br>CAATATCAGAGTAATGGTACC<br>GTCAAATATACAATTCGTAACCCCGCACTTCCCACTGAAAACTTCGCGGA-<br>TAAGTGGCACG<br>AGAAGCCTATGTTACCCCAGGCGTTCAAAGCGTGGTATACGCAAGTTACGGAA-<br>GATCTTGC<br>TAAGCTGCTTGAATTGGATCAGGGCCTGGACAAGACCATCGAGCGTAGTCGT-<br>GAGATGTTC<br>GGCTCCCAAGCAGCGCGCGGAATCCAGGCAAAGTTGGCAGACACATTAACT-<br>GAGCGTCGTG<br>CTAAAAATCGCGCCGTCGTTTCCAGTATCGGGTTGGGCGTGTCTAATGCAGC-<br>CACCGCGAC<br>GCCCGTCCCAAAGCATAATTTTTACGGAGACGTG |
| NTase055 | 165 | ATGAGCATCTCTGAAGCGCAGTTAGAAACCTGGAGTCATCAAGGTGC-<br>GATCCGTGGGTCCA<br>GTTTAACTTACCAGGCTATCAAATCGACACTTGAGAATGCCGATTCACCCTATGCTG-<br>GAAA<br>GAACATTGAAGTTTTCCTTCAGGGCAGCTATGGAAACGCTACGAATATC-<br>TATGCAGAAAGC<br>GATGTGGACGTGGTGATCCTGCTGAAAGATTGTTTCCAGCAGGATTTAAAAGCCT-<br>TATCCG<br>AGGAGCAGAAGACGGCATGGCGCGCTGCATACCACGATGCAGTGTATGCACATCGC-<br>GATTT<br>CAAAAAAGACGTCGTAAGCGTCCTTCGCGACGCTTATGGTGGAGATGTGACAGTCGGT-<br>GAT<br>AAAGCCATTGCTATCGCCGCACGCGGCGTACGTCGCAAAGCGGATGTAAT-<br>TGCGGCAATCG<br>GCTATCGTCGCTACTATCGTTTCAATGGGTTGCGTGACCAATCTTACGACGAGGGAAT-<br>TTG<br>TTTTTACGATGCTGCTGGGACGCGCATCGCTAATTATC-<br>CAAAGCAACACGCCGAAAACTTG<br>ACTGCCCAGCATCAAGCCACGCAGCAACGCTTAAAACCTATGGTACGCATTTG-<br>GAAGAATT<br>TGCGTAGCGCTCTTGTAGAAGCGGCTGCTATTGAGGCGGGGGCTGCGCCTTCATAT-<br>TACTT<br>GGAGGGTTTGTTGTATAATGTCCCCGTCGACAAATTTGTAGGGTCCTATGGTGA-<br>TACCTTT<br>GTGAACGTCTACAACTGGTTAGTTACAGAAGCAGATAAAACACAATT-<br>AGTCTGCGCAAACC<br>GTCAGTATTATCTGTTACGCGACAATGCTCC-<br>CACGTGCTGGGCCCCTGCACAATGCGAAGC<br>CTTTCTGGCAGCGACCTTAGCGTATTGGGACGATTGGGGCGCA |
| NTase057<br>aka Lp-<br>CdnE02 | 170 | ATGTCTATCGATTGGGAACAAACCTTTCGCAAATGGTCAAAGCCAAGCTCAGAAACG-<br>GAAT<br>CGACAAAGGCTGAAAATGCCGAGCGCATGATTAAAGCCGCGATCAATAGTAGCCAAAT-<br>TCT<br>TTCCACCAAAGACATTAGCGTGTTCCCGCAAGGGTCT-<br>TATCGTAACAATACTAATGTCCGC |

TABLE 2-continued

| Representative CD-NTase nucleic acid sequences | | |
|---|---|---|
| | | GAGGACTCTGATGTGGACATTTGTGTGTGTTTAAATACCTTGGTGCTTAGTGAT-<br>TATAGTC<br>TGGTGCCGGGCATGAATGATAAATTGGCTGAATTACGCACCGCTTCCTATACCTA-<br>CAAACA<br>ATTTAAGAGTGATCTTGAGACTGCCTTGAAAAACAAATTCGGGACACTTG-<br>GAGTAAGTCGT<br>GGCGATAAAGCCTTCGACGTACACGCCAACAGTTATCGTGTGGACGCC-<br>GATGTAGTTCCCG<br>CAATCCAAGGACGTCTTTATTATGACAAAAATCATAACGCTTTCATTCGTGGCACCTG-<br>CAT<br>CAAGCCGGATAGTGGGGGAACAATTTACAATTGGCCTGAGCAAAAC-<br>TATAGTAATGGCGTC<br>AATAAGAACAAGTCAACGGGGAATCGCTTCAAATTGATTGTGCGTGCAATCAAACGTT-<br>TAC<br>GCAACCATTTAGCGGAGAAAGGGTATAACACAGCCAAACCAATTCCGTCCTATCT-<br>GATGGA<br>GTGCTTGGTATATATTGTGCCAGATCAGTATTTTACCGGGGATAGCTATAA-<br>GACTAATGTG<br>GAGAACTGCATCAATTACCTTTACAATCAAATCGACAGCAGTGATTGGACGGAAAT-<br>CAATG<br>AGATCAAGTACTTATTTGGTTCGCATCAAATGTGGAATAAGACACAGGTGAAAGAAT-<br>TTCT<br>GCTTACGGCATGGAGTTATATTCAGAAAAAC |
| NTase058 | 173 | ATGAAATTTAGCGAAGAAAAGTTACGCTTGTTCGCCGCCCCTTTATCCGAGACCGAG-<br>GATC<br>AGAAGTGCAAGAACGCCATCGGGATGGTACGTGATGCTTTGAAGGATATCGGATT-<br>TACCGA<br>CGATGGAAAGACTATTGAGAAGTTGTACGCTGATACTTACTCATATTCCT-<br>TAGAGATGCGT<br>AATGCCACGAAAAATCGCAAGGTAAAACTGTTTGTAAAGGGCAGCTATGC-<br>CAACAATACGA<br>ATGTGCGCACCGAAAGTGATGTTGATATTGCCGTAGTTTTAGAAAGTACCTTCAAAGT-<br>GAA<br>ATACCGCCCAAATATTAATGATGCGAAATACGGTTTCTCAAATAGTACGGATAATGT-<br>GATG<br>ACCTTCAAAGACGATGTTGAAGACGCCCTGCGTAAAAAGTTTGGCTCCGATGTT-<br>GAACGTA<br>AGAACAAATCTATCAAGATTCACGGAAACACTTATCGTGTGGATGCC-<br>GATGCTGTTCCCTG<br>CATGCGTCACCGTGATTATTCAAATGACTATAACAGTGATCCGAACAACTT-<br>TATCGGTGGT<br>ATCTTTATTCGTTCTGATGACGGGCAAACTATCATCAACTATCCTGAACAGCA-<br>CATCCGTA<br>ATGGGCGCGAAAAGAACAACCAGACCAATACATACTATAAAAAGATGGTCCGCATTAT-<br>TAA<br>GAAAATGCGCTATATTATGCAGGACGAGAATTAT-<br>GAAAGTGCAAATAACGTGTCCTCGTTC<br>GGTCTTGAGAGTTTGCTTTGGAATTTGCCCAACGGGGTGTTTACCAAATACACAATC-<br>TATC<br>GCTATGCCTTCGGAGAAATTACAGAGTATTTGTGGAATAATTCGCA-<br>CATGTTGCCCTTTTA<br>CAAGGAAGCTAATGGAATTAAGCCTTTGTGCGAATCAGCGATTGACGTT-<br>GAGAAGTATACT<br>CGTTTCATTAAAGACCTGTACAATTTCTATGAATACGATATC |
| NTase059 | 176 | tTGCTTTTCACCGAAGAACAGTTAAAGTTATACTCAAAACCGCTGTCGGAATCG-<br>GAAAAGG<br>AAAAGTGTGAAAATGCAATTCGCATCATTCAAGAATCCCTT-<br>GAATCTCTGGGGTACGAAAT<br>CAAAAAAGGTATTCACCGCAACAATGAAGATACTCTGAGTTATCAAAT-<br>TAAAATGACTAAT<br>TCCTCTAAAGATTACGAGTTAAGCATCTTTGTGAAGGGGTCT-<br>TACGCAACGAATACTAACG<br>TGCGTCAGAACTCAGACGTGGACATCGCCGTAGTTAAAGAAAGCGAAT-<br>TCTTCGACAAATA<br>CCGCGAAGGCAAGACCCGCGAGAACTACAAGTTTATCAGTTCCAACAAACCGCCGTAC-<br>TAT<br>TTCAAAGATGAAGTAGAGGAGGCTTTAATCGAAAAAT-<br>TTGGCCGTTCAGAAGTTCGCCGTG<br>GTAACAAGGCAATTCGCATCAACGGGAATACTTACCGTAAAGAAACAGATTGTGTGC-<br>CATG<br>CTTTCGTTATCGCGATTACTCGAACGACTATATGGACGATCCCAATAATTTTAT-<br>TGGTGGC<br>ATCACCATCTATAGTGATAAAGGCGAACGCATCATTAATTATCCTGAACAACATAT-<br>TAATA<br>ACAGCGTAATCAAGAACAACAACACTAACTACAAATACAAGAAGATGGTTCGTATCAT-<br>CAA<br>GGAAATCCGCTATCAACTTATTGACAGCAAAAACCGCAATGCTGAGCAGACAT-<br>CATCGTTT |

TABLE 2-continued

| Representative CD-NTase nucleic acid sequences | | |
|---|---|---|
| | | GGGGTCGAAGGATTATTCTGGAATATTCCGGACTATAAATATAGCAACGATGAAATGT-<br>TAG<br>GTGACACGTTCAACGCCCTGATCGCTTTCTTAATTGACAATATCGACAAGCT-<br>TAGCGAGTT<br>CAAGGAACCCAATGACCGT |
| NTase060 | 179 | ATGTACGAGACTAAGACGACTGCGTCGGACTGGGACAAGACATTGATCACACTGT-<br>CAAAGG<br>GGCCGTCCGAATCCGAAAGCCAGAAATGTGAAAACACTGAAAACGCTAT-<br>TCGTAAAGCAAT<br>CACCTCTAATGCAAAGCTGTCACAAATGGACATCTCGATTTTCGCGCAAGGAAGT-<br>TATAAA<br>GCACGTACAAATGTGCGTGCAGAATCCGACGTGGACATCGCTGTATTAT-<br>TAAATACCGTAG<br>CATATAACGACTATCCGGTCGGCTTAACGGCAGAAAACTTTGGCTTTACACCCGCCAA-<br>GAT<br>CGAGTTCATTGACTTTAAAAACCTGGTCAAACAGGCAATGGAGGAATATTTTGGCTAT-<br>TTT<br>AACATTGACCGTAGCGGAAAGAAGAGTATTAAAGTGCATTCGAATACT-<br>TATCGTGTTGACG<br>CCGATGTCGTGCCAATGTTCTGTCATAACCACTTCTTATCTGCGAATCCT-<br>GATGACTGCTT<br>GCGCGGAGTGGCTTTCAGTACCAATGAAGGCATGATCAT-<br>TAAGAACTGGCCTCAGCAAAAT<br>TATGAGAACGGAATCCAAAAAAACACAGCCACTAAACGTAAATATAAACGTCT-<br>GATCCGTA<br>TCTTGAAGCGTTTGAAGGCGTACATGATTCAAGAAGGCATTCAAGAGGCGAATAT-<br>TCCGTC<br>GTATCTGATTGAGTGCCTTGTGTGGAATGTACCTAATGTAGAATTCTTTCACGAT-<br>TCTTTG<br>TATCAGAACTTGCGCCAGATTTTGTTTATCTTTGGGATAAGACGCGCACGAACGAAA-<br>CAT<br>GTTCGAATTGGGGAGAAGTGAATGAATTGAAGTATTTGTTCTCCACATCT-<br>CAACCGTGGAC<br>GTTCCAGCAAGCTCATAACTTTATCCTGGCAACGTGGAAGTACATTGGTTACAAA |
| NTase061 | 182 | GTGTCACGCGATTGGGAAAGTGTATTTGCAACGTGGAGCCAGGGTCCCTCAGCGACG-<br>GAAC<br>AGGAACGCGCGCAGAACGCTGAACGCCAGATCCGCCAAGCTATTCAAGCAAGCGA-<br>TAAACT<br>GAAAAACCGTAATATCAAAGTGTTTACCCAAGGCTCCTATCGCAATCGCGT-<br>TAATGTTCGC<br>CGCGACAGCGATGTGGATATTGGGGTCTTATGCTTTGACACATATTTTCCT-<br>GAATACCCGG<br>ACGATAACGTCAAGATGGAATTGGCCAAGAACTCGGTCCCGGCGACGTATGAGTATGC-<br>CAC<br>CTTTAAATCTGAGCTGGAAGAGGCGCTTGTCGCTCGCTTTGGACGTGACGCAGT-<br>CACACGC<br>GGTTCAAAAGCGTTTGATATCAAGGCAAATACTTATCGCGTAGAGTCT-<br>GATGTGGCAGCCT<br>TCTTCGAGCACCGCCGTTATGTTACGGCAACTTATTACCATAGTGGAGTTGAGAT-<br>GATCCC<br>TGACGATTATGATCCCCCCCGTGTGAAGAATTGGCCCGAGCAGCAC-<br>TACGAAAATGGCGTT<br>TCGAAAAACACGTATTCACTTCGCCGTTATAAACGTGTAGTACGTGTTTTGAA-<br>GACTCTGA<br>GTAACGAAATGGCGTCGAAAGGCATCCAAAGCGCGAAAGATGCGCCATCGTTCCTTAT-<br>TGA<br>ATCGCTGGTTTTTAATGCGAGTAACTCATGCTTTGAATATCAATCCTTCAAGCC-<br>GATGGTT<br>CGTCATATTTTAGCCGAGTTGTTCAACAACACAATGTCGCAT-<br>GAAAAATGCAGCGAATGGG<br>GAGAGGTTAACGAGCT-<br>GAAGTATCTGTTCCGCAGTTCTCAGCCGTGGACCCGCGAGAGCGC<br>CCACCAGTTTTTGTCAGACGCGTGGGACTACATCGGATACGAG |
| NTase062 | 185 | ATGAGTAACAGTTTTTCGGCACGTATCGAACGCATGAAAT-<br>CACGCCGTAAAGGGACTTTCG<br>ACCAGCTTAATGTAGCACGTGAATCTATTAGTAACCAGCGTATCGATGGGVTG-<br>GAGAACTA<br>TGCCTTGTTAGAAGGGTTTCTGGATTTGAACGAAAGTTGGGAAACGCGTGGTAAGCAA-<br>GAT<br>AGCGCGACTCGTTATGTGATTGGGGCGATGCAGCCCGTTGACAATCGTTACACT-<br>GAAATTA<br>GTTTTGAAACCGCCAAGCGCATCGAAAATCAGTTAGTGAAGAAATTAGATTT-<br>GAACCTTGA<br>GTTTCGTGTCCAAGGCTCGGTTCCACTTGATATCCACATTAAGTCTTTCAGT-<br>GATGTTGAC<br>TTGTTGATTATCGACACTCAAATGTTAATCTACGACTCGGACGGTATTGGACGC-<br>TATACTC<br>CGACGAACAAGAACGACGGGGACGTTATTTTAGAATTGCGCGATGCAGCACGTGACG-<br>CATT<br>AAAGGCGACCTTTCCTGCAGCAGATGTTGATGATAACAATGCAAAATCACTTCGCAT-<br>TACA |

TABLE 2-continued

| Representative CD-NTase nucleic acid sequences | | |
|---|---|---|
| | | GGGGGTTCCCTGCAGCGTGAAGTCGACGTAGTCCCTAGTATTTGGTGGGATAC-<br>CAAGGAAT<br>ATCAGCACACCAAAGATGTCGATCAACGCGGAGTAACTATCATCGA-<br>TAAAAACACACGTCA<br>GCGCATCTACAATCTGCCATTCTTACATATTAAGCGCATTAAAGACAAATGT-<br>GATCAGTGC<br>AATGGAGGACTGCGTAAGTCCATTCGCTTCCTGAAAACGCTTAAAGCAGATAGT-<br>GAGGCCG<br>AGGGGACAAAGATCGAGTTATCAAGCTACGACATCGCATCGTTGATGTACCATGCT-<br>GATGG<br>GAACAACCTGCGCCACTCTCAGTATTACGAACTGGCGGTATTAGTAGAGACT-<br>CATCGCTGG<br>TTAAACTATCTGGCGCAAAACCCGAATGCAGCTATGTTGTTGTATGTCC-<br>CAAATGGTACTC<br>GCAAAATTATCGACAAGAATGAGACATTCGCGGAATTGCTGAAACTTACCGG-<br>CATGGTAAA<br>TTCGATTGTGACCGAAGTCTTACGTGAAATCACAGGGCAACCGACCGAATATTA-<br>CACGCCC<br>GCCAAAGGCATCCTTCTGATTAAACAAGCAGTCTAC |
| NTase063 | 188 | ATGAATACCCCTATCAACGAGCGTATCAACCGTTTGCGTTCTCGTCGTTCCGGACTG-<br>GATC<br>GCTCAAGCGTCATTGCCATGGATGCAAAGGATTTCATTGTAAACCGCTCCCTTA-<br>CAAAGGA<br>AGCCTGGGAACATCGTGTTAAGGACAAGCCGAACACGACATTCGCATTGGGTGC-<br>TATGCAG<br>GAGGTTGATCCCACCTATACTCGCATCAGTATTGAGACGGCTGAGCGTGTATCAAAT-<br>CAAT<br>TATCAAAGCGTACCTCGGGTAACTTGGAGTTTGAATTGCAAGGGTCAGTACCGCT-<br>GAACGT<br>ACATATTCGCGGGGTCTCCGACGTGGATTTGCTGGCCATTGAGGCGGATTTTCACACT-<br>TAT<br>GACGCACGCGGCTATATGTCTA-<br>CATCAGGGCAATATCGCAGCCCGACCTCTCGTACTTCAG<br>TTGGGGTCCTTACGGCACGCCGTGGAGAAATTGGACGCGCCCTGCGT-<br>GATGCGTTCCCTGC<br>GGCTACTATTGACACTTCGGGTTCAAAGGCCATCAAATTA-<br>CAAGGGGGGTCGTTGGCCCGC<br>CCCGTTGATGTTGTGCCCTCTCATTGGCATGACACAATTACC-<br>TATCAGGCCTCCGGACAGA<br>AGCATGACCGTGCTGTTACCATCTTAGACTCTCATAAGTCAACGACTATCGAGAAT-<br>TGGCC<br>TTTTCTTCACATCAAGAAGGTGCGCGAGCGCTGCGAGACAACGGGTGGAGGTT-<br>TACGTAAG<br>TCGATCCGCTTATGCAAAAATATCAAGGCAGAGCTGGAGGCG-<br>GAAGGAAAGCCTGTGACTA<br>TCTCGAGTTTTGACATCGCAAGCATTATGTATCATGCGAACATGCACTCTT-<br>TATCGGCCGG<br>GGCCTACTACGAGCTGGCGATCCTTGCAGAGACCCAGCGTTACCTGGATTATCTTTG-<br>GAAT<br>AATAAGGAGGAAGCGCGCCGTCTTGTAGTACCAGATGGGTCTCGTTTCATCTT-<br>TAACACGG<br>AGGATAAGTTCAACGGCCTGTTACATTTATCTGTTGCCATGGATTCCCTTTTGCGT-<br>GAAGC<br>CGCGAAGGAGCAAAATTACCTGCTGTCATTATCTGACAAACCGTTACTT-<br>GATGCGTCGCGT<br>ATTGCAGTCACCAACGCTATTATCTTC |
| NTase064 | 191 | ATGAGTATCTTGGTGACAAATTCTTACGTCACTCCGCTTGAAGCACGTCA-<br>GACAATCGCGC<br>GTCGTTACCGTATCGTAACAAAGGCTATCAATGTGGAATTCTGGAACAG-<br>CATCTCCGAAAC<br>CGCACACAGCTTTTACGTGGGCTCGTACGGACGTGGTACGGCCATTTCCACATCTGA-<br>TATC<br>GACATCCTGGTGGAAATTCCGAATAGCGAGTATGATAAGTTTAACAGCTCAACGGG-<br>GAATG<br>GACAAAGCCGCCTTTTGCAATCAATTCGTAAAAGCTTGCAGGTTGCT-<br>TATCCGCAATCCGA<br>TATTCGCGCTGATGGACAAGTGGTGAAAATTAACTTCCACGATGGTATCAAGTTT-<br>GAGATT<br>TTGCCAGCATTCCAGAATATCGACTACTGGGGTAAGAACCAAGGATATATTTATCCG-<br>GATT<br>CAAACATGGGCGGGAACTGGAAGGCGACAAATCCCAAGAACGAACAGGAGGCGAT-<br>GAAAAT<br>CAAAAATGGTCCGACTTACTCCAATGGGTTGCTTTATGCAACATGCCGTCACTTCCGC-<br>TAC |

TABLE 2-continued

| Representative CD-NTase nucleic acid sequences | | |
|---|---|---|
| | | GTGCGTGACACATACTTCAGTTCGTATCACCTGAGCGGGATCGT-<br>GATCGACAGCTTTGTTT<br>ATAACGCGATGGGGAATTGGCGTTATACAGAGAGTGGGAGTAGTTCTAATGCCT-<br>CAATGGG<br>TGCATACGAAAACATCTTACTTGAGTATTTCAATAACAATACTAT-<br>TTGGGGCCTGTCCTTA<br>AATAGCCCTGGGAGTAACCAGACCGTTTCCACCACTAACTCCATTACGTGCCTT-<br>GAAAAAG<br>TTATCAAGAAGATTGCGACC |
| NTase065 | 194 | ATGTCCACCGCAACTGATTTTAAGACATTGCTGGATAATATCAAGAT-<br>TGACAACGCCGGGC<br>AGATCTCTAAGCGTTACGGGCGTATTACCAAGGCCCTGAACCAATATTTTTA-<br>CAACCTTGA<br>CTCAAAGACAGCTAATAGCTTGCAGGTAGGGTCGTATGGTCGCTTCACGGGTAT-<br>TCGTGGT<br>ATTAGTGACCTGGACATGCTGTAT-<br>TTTCTGCCCGCGACTGCCTGGCCTCGTTTCCGTGACC<br>GCCAGTCGTATTTACTGCAAGTAGTAAAAACAGAGATTAAGAAAACATT-<br>CAAGAACACTGA<br>CATTCGCGGGGACGGCCAAGTGGTCGTTGTTAAGTTTAAAAACCAAGAAGTT-<br>GAGGTCGTG<br>CCTGTGTTTAGCAACGAGGACGGCACATTCACATATCCGGACACTCAT-<br>GATGGTGGCAGTT<br>GGAAAGTCTGTAACCCTCGCGCAGAGATGTCATCGTTCCGCGCCT-<br>TAAATGACGACCGTAA<br>GGGCCACCTTCGTCGCCTTAGTAAAATGATTCGCGCCTGGAAGGCTCGT-<br>CACGAGGTAGAG<br>ATTTCAGGATTTTTGATCGACACGTTATGCTATAATTTCTTCAGTAAT-<br>TTGACAGAGTATG<br>ATGATAAGTCGTTTAAGAGTTACGACCAACTTAGCCTTGACTTTTTCACCTTCCTT-<br>GAGAA<br>CGAAGGGGATCGTGTTTTCTATTATGCCCCCGG-<br>GAGCCGTTCGAAAGTCTCGGTAAAGAAA<br>AGCTTCAATAAGGTTGCTAAGTTGACAAAGGAATATTGCGAAGAAGCCCTTAGTGCTA-<br>CAT<br>CAGAGAACTCCCGCAATTTAGCATGGAAAAAGGTCTTCGGTCGCCCATTTCCAAACTA-<br>CAC<br>CACTAAAGCATTGTCTAATGTTAACGTAAGTGAGCAGTTTATCGAAGACCAATAT-<br>GAAATG<br>AATTTGTACGGGCATGTGAGCATTGAATGCGAAATTCGCAAGAATAATTTGCTG-<br>GAAGCCC<br>TTTTGAGCAATCTGTTGGGGGAAGGACATGATATTTCCAC-<br>CAACCGCAAACTTCGCTTCTA<br>CGTGGACGAGATTAACAACATTAGCCACCCGTACAAAATTAAGTGGAAAAT-<br>TAAGAATGTT<br>GGAGATGAAGCAGAACGCCGTGGAAATGTTCGTGGGGAGATCTTGGACGATGAAGGGG-<br>GAA<br>GTGAACGCTTTGAGACCGCTGACTTCAGTGGGCCTCATTTTGTGGAGTGC-<br>TATGTAATCTA<br>TGGAAACCAGGTTGTAGCGCGTGACCGTATTGACGTCCCTATCCATAAC |
| NTase066 | 197 | atgggattattagtcccgcgTGCAAATACTTACACAATCCCATTAACGAAGCGT-<br>CAACTTA<br>TTGCCAAACGCTACCAACGCATTACACGCGCTATTAATCGCGAGTTCTGGAATTCG-<br>GAGTC<br>TGACACCGCCCACTCACTGTACGTGGGATCATACGGTCGCGGTACAGCCATTT-<br>CAACCTCT<br>GATATCGACATCATCGTGGAGTTGCCAATGGCCGAGTTTGATCGTTTTAAGAACTACT-<br>TAT<br>CTAACGGTCCATCGAAGTTACTTCAAGTTATCAAAAACGCTTTTCAG-<br>GAGATCTTGCCGAA<br>TTCTGATATTCGCGCGGATGGCCAAGTCGTCAAGATCAATTTCCATGATGGCAT-<br>TAAATTC<br>GAGATCGTGCCTGCGTTCAACGAGAAAGACTACTGGGGTGAGAGCAAGGGCTTTATT-<br>TATC<br>CTGACTCGAATATGGGCGGCAATTG-<br>GAAAGCAACGAACCCTAAGAAGGAACAAGAGGCAAT<br>GAAATTGAAGAATACCAAGAGCAATAACCTTTTGTATGCGACGTGCAAGCATTTTCGC-<br>CAT<br>GTGCGTGATACGGAGTTTACAAGCTATCATTTAAGTGGAATCGTAATTGAT-<br>TCGTTTGTCT<br>ATGAAGCTATGGGGAATTGGAAATTCGTGGAAAATAAT-<br>TCGGGCGGGCAGAATATCTCTAG<br>TGTATCCTACGAGACCGCTCTGTTGGAGTATTATAACTCACATAAAGT-<br>CATGGGTGGACTG<br>AATTTATACTCACCAGGATCAAATCAATTCGTCAACTCGGACAGCAGCATCAT-<br>TTGTCTgg<br>aaaaagtacttaaaaaaatcgctctt |
| Rm-CdnE | 200 | atgcctgtccctgagtcccaactggaacgttggtctcaccagggagc-<br>cacgacaaccgcaa<br>aaaaaacgcacgagtccatccgcgcagctttggatcgctacaaatggcccaaggg-<br>gaagcc |

TABLE 2-continued

| Representative CD-NTase nucleic acid sequences | | |
|---|---|---|
| | | ggaggtgtaccttcaagggtcgtataaaaatagcacaaacat-<br>tcgcggcgactctgacgta<br>gatgttgtcgtacaattgaactctgtttttatgaataacttgaccgct-<br>gagcaaaagcgtc<br>gttttggttttgtcaaatccgattatacctggaatgatttc-<br>tatagtgacgtcgaacgtgc<br>tttgactgattattatggagcatccaaagtgcgccgtgggcgcaagaccttaaaagtt-<br>gag<br>actacttatttaccagctgatgtcgtcgtgtgcatccagtatcgcaagtatccgc-<br>caaatc<br>gcaagtctgaggatgattatattgaaggaatgacgttctatgtgccctcggag-<br>gatcgctg<br>ggtagttaactatcctaagttgcattacgagaacggagctgccaaaaatcagca-<br>gacgaat<br>gagtggtacaagccaacaatccgtatgttcaagaatgcccgcacttattt-<br>gatcgagcaag<br>gtgcgccacaagatttggctccctcctatttcttagagtgcttat-<br>tgtataacgttccaga<br>ctctaaatttggcggaaccttcaaggacacgttctgttccgttatcaattggct-<br>taaacgt<br>gctgatctttccaaattccgctgtcaaaatggccaggacgacttgttcggt-<br>gagtttcctg<br>aacagtggtctgaagaaaaggctcgtcgtttttttgcgctacatggacgatt-<br>tatggacagg<br>gtgggggcagggatcccaccatcaccatcaccattgataa |
| Em-CdnE | 203 | ATGAATTTCTCGGAACAGCAGCTTATTAATTGGTCACGCCCAGTCTCAACCACGGAA-<br>GACT<br>TAAAGTGCCAAAACGCTATTACACAAATCACGGCGGCTTTACGTGCGAAATTTGG-<br>GAACCG<br>CGTAACCATTTTTTTACAGGGGAGTTATCGCAACAATACCAATGTGCGTCAAAATAGT-<br>GAT<br>GTTGATATTGTGATGCGTTATGACGATGCGTTCTATCCGGAT-<br>TTGCAACGTCTTTCCGAAA<br>GTGATAAGGCAATTTATAATGCACAACGCACCTATTCGGGCTACAATTTCGATGAGTT-<br>GAA<br>AGCGGATACAGAAGAGGCATTGCGTAACGTATTTA-<br>CAACCAGTGTAGAACGTAAAAACAAG<br>TGCATTCAAGTAAATGGCAATAGTAATCGTATCACAGCCGATGTTAT-<br>TCCCTGCTTTGTCC<br>TGAAGCGCTTCAGCACGCTGCAATCCGTCGAAGCTGAGGGGATCAAGTTTTACAGT-<br>GATGA<br>CAACAAAGAGATCATTAGTTTCCCGGAGCAGCATTACTCAAATGGAACAGAAAA-<br>GACGAAC<br>CAGACATATCGTCTGTACAAGCGCATGGTACGTATCCTGAAGGTGGTAAAC-<br>TACCGTTTGA<br>TTGACGACGGTGAGATTGCCGATAACCTGGTAAGCTCGTTTTTCATT-<br>GAGTGCCTTGTTTA<br>TAATGTCCCCAACAACCAATTCATCTCTGGTAATTATACTCAAACTCTTCGTAATGT-<br>CATC<br>GTTAAAATCTATGAGGATATGAAGAATAACGCCGACTATACTGAGGTGAACCGCTTAT-<br>TCT<br>GGTTATTCAGTAACCGTTCTCCACGCACGCGTCAGGATGCTTTGGGATT-<br>TATGCAGAAATG<br>TTGGAATTACCTGGGGTATCAA |

Included in Table 1 are orthologs of the proteins, as well as polypeptide molecules comprising an amino acid sequence having at least 80%, 81%, 82%, 83%, 84%, 85%, 86%, 87%, 88%, 89%, 90%, 91%, 92%, 93%, 94%, 95%, 96%, 97%, 98%, 99%, 99.5%, or more identity across their full length with an amino acid sequence of any SEQ ID NO listed in Table 1, or a portion thereof. Such polypeptides can have a function of the full-length polypeptide as described further herein.

Included in Table 2 are RNA nucleic acid molecules (e.g., thymines replaced with uredines), nucleic acid molecules encoding orthologs of the encoded proteins, as well as DNA or RNA nucleic acid sequences comprising a nucleic acid sequence having at least 80%, 81%, 82%, 83%, 84%, 85%, 86%, 87%, 88%, 89%, 90%, 91%, 92%, 93%, 94%, 95%, 96%, 97%, 98%, 99%, 99.5%, or more identity across their full length with the nucleic acid sequence of any SEQ ID NO listed in Table 2, or a portion thereof. Such nucleic acid molecules can have a function of the full-length nucleic acid as described further herein.

II. Agents and Compositions

A. Isolated Nucleic Acids

One aspect encompassed by the present invention pertains to isolated nucleic acid molecules that encode a modified polypeptide that catalyzes production of nucleotide-based second messengers, wherein said polypeptide comprises an amino acid sequence having at least 70% identity to any one of CD-NTase amino acid sequences listed in Table 1 and further comprises a nucleotidyltransferase protein fold and an active site, wherein the active site comprises the amino acid sequence $GSX_1X_2$ [ . . . ] $X_n$ $A_1Y_1B_1$, optionally wherein the active site comprises the amino acid sequence $GSX_1X_2$ [ . . . ] $X_n$ $A_1Y_1B_1Z_1Z_2$ [ . . . ] $Z_mC_1$, wherein:

$A_1$, $B_1$, and $C_1$ independently represent amino acid residue D or E;

$X_1$, $X_2$, . . . , $X_n$, $Y_1$, $Z_1$, $Z_2$, . . . , and Zn independently represent any amino acid residue; and n or m is any integer. As described above, in some embodiments, n is 5-40 residues and m is $10^{-200}$ residues, or any range in between, inclusive, such as n is 6-15 residues and m is 50-100 residues.

Another way to express this amino acid sequence motif is by the following: $GSX_x(D/E)X(D/E)X_x(D/E)$, wherein X is any amino acid residue and $X_x$ is any number of any amino acid residues. As described above, in some embodiments, $X_x$ is 5-40 residues, $10^{-200}$, residues, or any range in between, inclusive, such as 6-100 residues, 6-15 residues, 50-100 residues, etc.

As used herein, the term "nucleic acid molecule" is intended to include DNA molecules (i.e., cDNA or genomic DNA) and RNA molecules (i.e., mRNA) and analogs of the DNA or RNA generated using nucleotide analogs. The nucleic acid molecule can be single-stranded or double-stranded, but preferably is double-stranded DNA. An "isolated" nucleic acid molecule is one which is separated from other nucleic acid molecules which are present in the natural source of the nucleic acid. Preferably, an "isolated" nucleic acid is free of sequences which naturally flank the nucleic acid (i.e., sequences located at the 5' and 3' ends of the nucleic acid) in the genomic DNA of the organism from which the nucleic acid is derived. For example, in various embodiments, the isolated nucleic acid molecule that encodes a modified CD-NTase polypeptide, or biologically active portions thereof, can contain less than about 5 kb, 4 kb, 3 kb, 2 kb, 1 kb, 0.5 kb or 0.1 kb of nucleotide sequences which naturally flank the nucleic acid molecule in genomic DNA of the cell from which the nucleic acid is derived. Moreover, an "isolated" nucleic acid molecule, such as a cDNA molecule, can be substantially free of other cellular material, or culture medium when produced by recombinant techniques, or chemical precursors or other chemicals when chemically synthesized.

A nucleic acid molecule that encodes a modified CD-NTase polypeptide, or biologically active portions thereof, encompassed by the present invention, e.g., a nucleic acid molecule having the nucleotide sequence shown in Table 2, or a nucleotide sequence which is at least about 50%, preferably at least about 60%, more preferably at least about 70%, yet more preferably at least about 80%, still more preferably at least about 90%, and most preferably at least about 95% or more (e.g., about 98%) homologous to the nucleotide sequence shown in Table 2, or a portion thereof (i.e., 100, 200, 300, 400, 450, 500, or more nucleotides), wherein the polypeptide encoded by the nucleic acid molecule further comprises a nucleotidyltransferase protein fold and an active site described herein, can be isolated using standard molecular biology techniques and the sequence information provided herein. For example, a modified CD-NTase polypeptide cDNA can be isolated from a bacterium using all or portion of the nucleotide sequence shown in Table 2, or fragment thereof, as a hybridization probe and standard hybridization techniques (i.e., as described in Sambrook, J., Fritsh, E. F., and Maniatis, *T. Molecular Cloning: A Laboratory Manual. 2nd, ed., Cold Spring Harbor Laboratory*, Cold Spring Harbor Laboratory Press, Cold Spring Harbor, NY, 1989). Moreover, a nucleic acid molecule encompassing all or a portion of the nucleotide sequence shown in Table 2, or a nucleotide sequence which is at least about 50%, preferably at least about 60%, more preferably at least about 70%, yet more preferably at least about 80%, still more preferably at least about 90%, and most preferably at least about 95% or more homologous to the nucleotide sequence shown in Table 2, or fragment thereof, wherein the polypeptide encoded by the nucleic acid molecule further comprises a nucleotidyltransferase protein fold and an active site described herein, can be isolated by the polymerase chain reaction using oligonucleotide primers designed based upon the sequence of the nucleotide sequence shown in Table 2, or fragment thereof, or the homologous nucleotide sequence. For example, mRNA can be isolated from human cancer cells (i.e., by the guanidinium-thiocyanate extraction procedure of Chirgwin et al. (1979) *Biochemistry* 18:5294-5299) and cDNA can be prepared using reverse transcriptase (i.e., Moloney MLV reverse transcriptase, available from Gibco/BRL, Bethesda, MD; or AMV reverse transcriptase, available from Seikagaku America, Inc., St. Petersburg, FL). Synthetic oligonucleotide primers for PCR amplification can be designed based upon the nucleotide sequence shown in Table 2, or fragment thereof, or to the homologous nucleotide sequence. A nucleic acid of the invention can be amplified using cDNA or, alternatively, genomic DNA, as a template and appropriate oligonucleotide primers according to standard PCR amplification techniques. In addition, a nucleic acid of the invention can be generated by site-directed mutagenesis technique using cDNA, or genomic DNA of wild-type CD-NTase as a template and specific oligonucleotide primers that contain the intended mutation. The nucleic acid so amplified or generated can be cloned into an appropriate vector and characterized by DNA sequence analysis. Furthermore, oligonucleotides corresponding to a modified CD-NTase polypeptide nucleotide sequence can be prepared by standard synthetic techniques, i.e., using an automated DNA synthesizer.

Probes based on the modified CD-NTase polypeptide nucleotide sequences can be used to detect transcripts or genomic sequences encoding the same or homologous proteins. In preferred embodiments, the probe further comprises a label group attached thereto, i.e., the label group can be a radioisotope, a fluorescent compound, an enzyme, or an enzyme co-factor. Such probes can be used as a part of a diagnostic test kit for identifying cells or tissue which express a modified CD-NTase polypeptide, such as by measuring a level of a modified CD-NTase polypeptide-encoding nucleic acid in a sample of cells from a subject, i.e., detecting mRNA levels of modified CD-NTase polypeptides.

Nucleic acid molecules encoding other modified CD-NTase polypeptides and thus having a nucleotide sequence which differs from the nucleotide sequences shown in Table 2, or fragment thereof, are contemplated. Moreover, nucleic acid molecules encoding modified CD-NTase polypeptides from different species, and thus which have a nucleotide sequence which differs from the nucleotide sequences shown in Table 2 are also intended to be within the scope encompassed by the present invention.

In one embodiment, the nucleic acid molecule(s) of the invention encodes a protein or portion thereof which includes an amino acid sequence which is sufficiently homologous to an amino acid sequence shown in Table 1 and further comprises a nucleotidyltransferase protein fold and an active site described herein, or fragment thereof, such that the protein or portion thereof catalyzes production of cyclic or linear nucleotide-based second messengers. Methods and assays for measuring each such biological activity are well-known in the art and representative, non-limiting embodiments are described in the Examples below and Definitions above.

As used herein, the language "sufficiently homologous" refers to proteins or portions thereof which have amino acid sequences which include a minimum number of identical or equivalent (e.g., an amino acid residue which has a similar side chain as an amino acid residue in an amino acid sequence shown in Table 1, or fragment thereof) amino acid residues to an amino acid sequence shown in Table 1, or fragment thereof, such that the protein or portion thereof catalyzes production of cyclic or linear nucleotide-based second messengers.

In another embodiment, the protein is at least about 50%, preferably at least about 60%, more preferably at least about 70%, 75%, 80%, 85%, 90%, 91%, 92%, 93%, 94%, 95%, 96%, 97%, 98%, 99% or more homologous to the entire amino acid sequence of an amino acid sequence shown in Table 1, or a fragment thereof.

Portions of proteins encoded by the modified CD-NTase nucleic acid molecule encompassed by the present invention are preferably biologically active portions of the modified CD-NTase polypeptide. As used herein, the term "biologically active portion of the modified CD-NTase polypeptide" is intended to include a portion, e.g., a domain/motif, of the modified CD-NTase polypeptide that has one or more of the biological activities of the full-length modified CD-NTase polypeptide, respectively.

Standard binding assays, e.g., immunoprecipitations and yeast two-hybrid assays, as described herein, or functional assays, e.g., RNAi or overexpression experiments, can be performed to determine the ability of a modified CD-NTase polypeptide or a biologically active fragment thereof to maintain a biological activity of the full-length modified CD-NTase polypeptide.

The invention further encompasses nucleic acid molecules that differ from the nucleotide sequences shown in Table 2, or fragment thereof due to degeneracy of the genetic code and thus encode the same modified CD-NTase polypeptide, or fragment thereof. In another embodiment, an isolated nucleic acid molecule of the invention has a nucleotide sequence encoding a protein having an amino acid sequence shown in Table 1, or fragment thereof, or a protein having an amino acid sequence which is at least about 70%, 75%, 80%, 85%, 90%, 91%, 92%, 93%, 94%, 95%, 96%, 97%, 98%, 99% or more homologous to an amino acid sequence shown in Table 1, or fragment thereof, or differs by at least 1, 2, 3, 5 or 10 amino acids but not more than 30, 20, 15 amino acids from an amino acid sequence shown in Table 1, wherein the protein further comprises a nucleotidyltransferase protein fold and an active site described herein. In another embodiment, a nucleic acid encoding a modified CD-NTase polypeptide consists of nucleic acid sequence encoding a portion of a full-length modified CD-NTase polypeptide of interest that is less than 195, 190, 185, 180, 175, 170, 165, 160, 155, 150, 145, 140, 135, 130, 125, 120, 115, 110, 105, 100, 95, 90, 85, 80, 75, or 70 amino acids in length.

It will be appreciated by those skilled in the art that DNA sequence polymorphisms that lead to changes in the amino acid sequences of the modified CD-NTase polypeptides may exist within a population (e.g., a human population). Such genetic polymorphism in the modified CD-NTase gene may exist among individuals within a population due to natural allelic variation. As used herein, the terms "gene" and "recombinant gene" refer to nucleic acid molecules comprising an open reading frame encoding a modified CD-NTase protein. Such natural allelic variations can typically result in 1-5% variance in the nucleotide sequence of the modified CD-NTase gene. Any and all such nucleotide variations and resulting amino acid polymorphisms in the modified CD-NTase polypeptide that are the result of natural allelic variation and that do not alter the functional activity of the modified CD-NTase polypeptide are intended to be within the scope of the invention. Nucleic acid molecules corresponding to natural allelic variants and homologues of the modified CD-NTase cDNAs encompassed by the present invention can be isolated based on their homology to the modified CD-NTase nucleic acid sequences disclosed herein using the becterium cDNA, or a portion thereof, as a hybridization probe according to standard hybridization techniques under stringent hybridization conditions (as described herein).

In addition to naturally-occurring allelic variants of the modified CD-NTase polypeptide sequence that may exist in the population, the skilled artisan will further appreciate that changes can be introduced by mutation into the nucleotide sequences shown in Table 2, or fragment thereof, thereby leading to changes in the amino acid sequence of the encoded modified CD-NTase polypeptide, without altering the functional ability of the modified CD-NTase polypeptide. For example, nucleotide substitutions leading to amino acid substitutions at "non-essential" amino acid residues can be made in the sequence shown in Table 2, or fragment thereof. A "non-essential" amino acid residue is a residue that can be altered from the sequence of the modified CD-NTase polypeptide (e.g., the sequence shown in Table 1, or fragment thereof) without significantly altering the activity of the modified CD-NTase polypeptide, whereas an "essential" amino acid residue is required for the modified CD-NTase polypeptide activity. Other amino acid residues, however, (e.g., those that are not conserved or only semi-conserved between mouse and human) may not be essential for activity and thus are likely to be amenable to alteration without altering the modified CD-NTase polypeptide activity.

Accordingly, another aspect encompassed by the present invention pertains to nucleic acid molecules encoding modified CD-NTase polypeptides that contain changes in amino acid residues that are not essential for the modified CD-NTase polypeptide activity. Such modified CD-NTase polypeptides differ in amino acid sequence from an amino acid sequence shown in Table 1, or fragment thereof, yet retain at least one of the modified CD-NTase polypeptide activities described herein. In one embodiment, the isolated nucleic acid molecule comprises a nucleotide sequence encoding a protein, wherein the protein lacks one or more modified CD-NTase polypeptide domains. As stated in the Definitions section, the structure-function relationship of CD-NTase polypeptide is known or disclosed in the present disclosure, such that the ordinarily skilled artisan readily understands the regions that may be mutated or otherwise altered while preserving at least one biological activity of the modified CD-NTase polypeptide.

"Sequence identity or homology", as used herein, refers to the sequence similarity between two polypeptide molecules or between two nucleic acid molecules. When a position in both of the two compared sequences is occupied by the same base or amino acid monomer subunit, e.g., if a position in each of two DNA molecules is occupied by adenine, then the molecules are homologous or sequence identical at that position. The percent of homology or sequence identity between two sequences is a function of the number of matching or homologous identical positions shared by the two sequences divided by the number of positions compared x 100. For example, if 6 of 10, of the positions in two sequences are the same then the two sequences are 60% homologous or have 60% sequence identity. By way of example, the DNA sequences ATTGCC and TATGGC share 50% homology or sequence identity. Generally, a comparison is made when two sequences are aligned to give maximum homology. Unless otherwise specified "loop out regions", e.g., those arising from deletions or insertions in one of the sequences are counted as mismatches.

The comparison of sequences and determination of percent homology between two sequences can be accomplished using a mathematical algorithm. Preferably, the alignment can be performed using the Clustal Method. Multiple alignment parameters include GAP Penalty=10, Gap Length Penalty=10. For DNA alignments, the pairwise alignment parameters can be Htuple=2, Gap penalty=5, Window=4, and Diagonal saved=4. For protein alignments, the pairwise alignment parameters can be Ktuple=1, Gap penalty=3, Window=5, and Diagonals Saved=5.

In a preferred embodiment, the percent identity between two amino acid sequences is determined using the Needleman and Wunsch (J. Mol. Biol. (48): 444-453 (1970)) algorithm which has been incorporated into the GAP program in the GCG software package (available online), using either a Blossom 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package (available online), using a NWSgapdna.CMP matrix and a gap weight of 40, 50, 60, 70, or 80 and a length weight of 1, 2, 3, 4, 5, or 6. In another embodiment, the percent identity between two amino acid or nucleotide sequences is determined using the algorithm of E. Meyers and W. Miller (CABIOS, 4:11-17 (1989)) which has been incorporated into the ALIGN program (version 2.0) (available online), using a PAM120 weight residue table, a gap length penalty of 12 and a gap penalty of 4.

An isolated nucleic acid molecule encoding a modified CD-NTase polypeptide homologous to the protein show in Table 1 and further comprising a nucleotidyltransferase protein fold and an active site described herein, or fragment thereof, can be created by introducing one or more nucleotide substitutions, additions or deletions into the nucleotide sequences shown in Table 2, or fragment thereof, or a homologous nucleotide sequence such that one or more amino acid substitutions, additions or deletions are introduced into the encoded protein. Mutations can be introduced into a nucleotide sequence shown in Table 2, or fragment thereof, or the homologous nucleotide sequence by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), branched side chains (e.g., threonine, valine, isoleucine) and aromatic side chains (e.g., tyrosine, phenylalanine, tryptophan, histidine). Thus, a predicted nonessential amino acid residue in the modified CD-NTase polypeptide is preferably replaced with another amino acid residue from the same side chain family. Alternatively, in another embodiment, mutations can be introduced randomly along all or part of a modified CD-NTase polypeptide coding sequence, such as by saturation mutagenesis, and the resultant mutants can be screened for the modified CD-NTase polypeptide activity described herein to identify mutants that retain the modified CD-NTase polypeptide activity. Following mutagenesis of a nucleotide sequence shown in Table 2, or fragment thereof, the encoded protein can be expressed recombinantly (as described herein) and the activity of the protein can be determined using, for example, assays described herein.

The levels of the modified CD-NTase polypeptides may be assessed by any of a wide variety of well-known methods for detecting expression of a transcribed molecule or protein. Non-limiting examples of such methods include immunological methods for detection of proteins, protein purification methods, protein function or activity assays, nucleic acid hybridization methods, nucleic acid reverse transcription methods, and nucleic acid amplification methods.

In preferred embodiments, the levels of the modified CD-NTase polypeptides are ascertained by measuring gene transcript (e.g., mRNA), by a measure of the quantity of translated protein, or by a measure of gene product activity. Expression levels can be monitored in a variety of ways, including by detecting mRNA levels, protein levels, or protein activity, any of which can be measured using standard techniques. Detection can involve quantification of the level of gene expression (e.g., genomic DNA, cDNA, mRNA, protein, or enzyme activity), or, alternatively, can be a qualitative assessment of the level of gene expression, in particular in comparison with a control level. The type of level being detected will be clear from the context.

In a particular embodiment, the modified CD-NTase polypeptide mRNA expression level can be determined both by in situ and by in vitro formats in a biological sample using methods known in the art. The term "biological sample" is intended to include tissues, cells, biological fluids and isolates thereof, isolated from a subject, as well as tissues, cells and fluids present within a subject. Many expression detection methods use isolated RNA. For in vitro methods, any RNA isolation technique that does not select against the isolation of mRNA can be utilized for the purification of RNA from cells (see, e.g., Ausubel et al., ed., *Current Protocols in Molecular Biology*, John Wiley & Sons, New York 1987-1999). Additionally, large numbers of tissue samples can readily be processed using techniques well-known to those of skill in the art, such as, for example, the single-step RNA isolation process of Chomczynski (1989, U.S. Pat. No. 4,843,155).

The isolated mRNA can be used in hybridization or amplification assays that include, but are not limited to, Southern or Northern analyses, polymerase chain reaction analyses and probe arrays.

In one format, the mRNA is immobilized on a solid surface and contacted with a probe, for example by running the isolated mRNA on an agarose gel and transferring the mRNA from the gel to a membrane, such as nitrocellulose. In an alternative format, the probe(s) are immobilized on a solid surface and the mRNA is contacted with the probe(s), for example, in a gene chip array, e.g., an Affymetrix™ gene chip array. A skilled artisan can readily adapt known mRNA detection methods for use in detecting the level of the modified CD-NTase mRNA expression levels.

An alternative method for determining the modified CD-NTase mRNA expression level in a sample involves the process of nucleic acid amplification, e.g., by rtPCR (the experimental embodiment set forth in Mullis, 1987, U.S. Pat. No. 4,683,202), ligase chain reaction (Barany, 1991, *Proc. Natl. Acad. Sci. USA,* 88:189-193), self-sustained sequence replication (Guatelli et al., 1990, *Proc. Natl. Acad. Sci. USA* 87:1874-1878), transcriptional amplification system (Kwoh et al., 1989, *Proc. Natl. Acad. Sci. USA* 86:1173-

1177), Q-Beta Replicase (Lizardi et al., 1988, *Bio/Technology* 6:1197), rolling circle replication (Lizardi et al., U.S. Pat. No. 5,854,033) or any other nucleic acid amplification method, followed by the detection of the amplified molecules using techniques well-known to those of skill in the art. These detection schemes are especially useful for the detection of nucleic acid molecules if such molecules are present in very low numbers. As used herein, amplification primers are defined as being a pair of nucleic acid molecules that can anneal to 5' or 3' regions of a gene (plus and minus strands, respectively, or vice-versa) and contain a short region in between. In general, amplification primers are from about 10 to 30 nucleotides in length and flank a region from about 50 to 200 nucleotides in length. Under appropriate conditions and with appropriate reagents, such primers permit the amplification of a nucleic acid molecule comprising the nucleotide sequence flanked by the primers.

For in situ methods, mRNA does not need to be isolated from the cells prior to detection. In such methods, a cell or tissue sample is prepared/processed using known histological methods. The sample is then immobilized on a support, typically a glass slide, and then contacted with a probe that can hybridize to the modified CD-NTase polypeptide mRNA.

As an alternative to making determinations based on the absolute the modified CD-NTase polypeptide expression level, determinations may be based on the normalized modified CD-NTase polypeptide expression level. Expression levels are normalized by correcting the absolute modified CD-NTase polypeptide expression level by comparing its expression to the expression of a non-CD-NTase polypeptide gene, e.g., a housekeeping gene that is constitutively expressed. Suitable genes for normalization include housekeeping genes such as the actin gene, or epithelial cell-specific genes. This normalization allows the comparison of the expression level in one sample, e.g., a subject sample, to another sample, e.g., a normal sample, or between samples from different sources.

The level or activity of a modified CD-NTase polypeptide can also be detected and/or quantified by detecting or quantifying the expressed polypeptide. The modified CD-NTase polypeptide can be detected and quantified by any of a number of means well-known to those of skill in the art. These may include analytic biochemical methods such as electrophoresis, capillary electrophoresis, high performance liquid chromatography (HPLC), thin layer chromatography (TLC), hyperdiffusion chromatography, and the like, or various immunological methods such as fluid or gel precipitin reactions, immunodiffusion (single or double), immunoelectrophoresis, radioimmunoassay (RIA), enzyme-linked immunosorbent assays (ELISAs), immunofluorescent assays, Western blotting, and the like. A skilled artisan can readily adapt known protein/antibody detection methods for use in determining whether cells express the modified CD-NTase polypeptide.

b. Recombinant Expression Vectors and Host Cells

Another aspect of the invention pertains to the use of vectors, preferably expression vectors, containing a nucleic acid encoding a modified CD-NTase polypeptide (or a portion thereof). As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions. In one embodiment, adenoviral vectors comprising a modified CD-NTase nucleic acid molecule are used.

The recombinant expression vectors encompassed by the present invention comprise a nucleic acid of the invention in a form suitable for expression of the nucleic acid in a host cell, which means that the recombinant expression vectors include one or more regulatory sequences, selected on the basis of the host cells to be used for expression, which is operatively linked to the nucleic acid sequence to be expressed. Within a recombinant expression vector, "operably linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described, for example, in Goeddel; Gene Expression Technology: Methods in Enzymology 185, Academic Press, San Diego, CA (1990). Regulatory sequences include those which direct constitutive expression of a nucleotide sequence in many types of host cell and those which direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein.

The recombinant expression vectors of the invention can be designed for expression of the modified CD-NTase polypeptide in prokaryotic or eukaryotic cells. For example, the modified CD-NTase polypeptide can be expressed in bacterial cells such as *E. coli*, insect cells (using baculovirus expression vectors) yeast cells or mammalian cells. Suitable host cells are discussed further in Goeddel, Gene Expression Technology: Methods in Enzymology 185, Academic Press, San Diego, CA (1990). Alternatively, the recombinant expression vector can be transcribed and translated in vitro, for example using T7 promoter regulatory sequences and T7 polymerase.

Expression of proteins in prokaryotes is most often carried out in *E. coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith, D. B. and Johnson, K. S. (1988) *Gene* 67:31-40), pMAL (New England Biolabs, Beverly, MA) and pRIT5 (Pharmacia, Piscataway, NJ) which fuse glutathione S-transferase (GST), maltose E binding protein, or protein A, respectively, to the target recombinant protein. In one embodiment, the coding sequence of the modified CD-NTase polypeptide is cloned into a pGEX expression vector to create a vector encoding a fusion protein comprising, from the N-terminus to the C-terminus, GST-thrombin cleavage site-modified CD-NTase polypeptide. The fusion protein can be purified by affinity chromatography using glutathione-agarose resin. Recombinant modified CD-NTase polypeptide unfused to GST can be recovered by cleavage of the fusion protein with thrombin.

Examples of suitable inducible non-fusion *E. coli* expression vectors include pTrc (Amann et al., (1988) Gene 69:301-315) and pET 11d (Studier et al., *Gene Expression Technology: Methods in Enzymology* 185, Academic Press, San Diego, California (1990) 60-89). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a coexpressed viral RNA polymerase (T7 gn1). This viral polymerase is supplied by host strains BL21 (DE3) or HMS174 (DE3) from a resident λ prophage harboring a T7 gn1 gene under the transcriptional control of the lacUV 5 promoter.

One strategy to maximize recombinant protein expression in *E. coli* is to express the protein in a host bacteria with an impaired capacity to proteolytically cleave the recombinant protein (Gottesman, S., *Gene Expression Technology: Methods in Enzymology* 185, Academic Press, San Diego, California (1990) 119-128). Another strategy is to alter the nucleic acid sequence of the nucleic acid to be inserted into an expression vector so that the individual codons for each amino acid are those preferentially utilized in *E. coli* (Wada et al. (1992) *Nucleic Acids Res.* 20:2111-2118). Such alteration of nucleic acid sequences of the invention can be carried out by standard DNA synthesis techniques.

In another embodiment, the modified CD-NTase polypeptide expression vector is a yeast expression vector. Examples of vectors for expression in yeast *S. cerivisae* include pYepSec1 (Baldari, et al., (1987) *EMBO J.* 6:229-234), pMFa (Kurjan and Herskowitz, (1982) *Cell* 30:933-943), pJRY88 (Schultz et al., (1987) *Gene* 54:113-123), and pYES2 (Invitrogen Corporation, San Diego, CA).

Alternatively, the modified CD-NTase polypeptide can be expressed in insect cells using baculovirus expression vectors. Baculovirus vectors available for expression of proteins in cultured insect cells (e.g., Sf 9 cells) include the pAc series (Smith et al. (1983) *Mol. Cell Biol.* 3:2156-2165) and the pVL series (Lucklow and Summers (1989) *Virology* 170:31-39).

In yet another embodiment, a nucleic acid of the invention is expressed in mammalian cells using a mammalian expression vector. Examples of mammalian expression vectors include pCDM8 (Seed, B. (1987) *Nature* 329:840) and pMT2PC (Kaufman et al. (1987) *EMBO J.* 6:187-195). When used in mammalian cells, the expression vector's control functions are often provided by viral regulatory elements. For example, commonly used promoters are derived from polyoma, Adenovirus 2, cytomegalovirus and Simian Virus 40. For other suitable expression systems for both prokaryotic and eukaryotic cells see chapters 16 and 17 of Sambrook, J., Fritsh, E. F., and Maniatis, T. *Molecular Cloning: A Laboratory Manual.* 2nd, ed., *Cold Spring Harbor Laboratory*, Cold Spring Harbor Laboratory Press, Cold Spring Harbor, NY, 1989.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert et al. (1987) *Genes Dev.* 1:268-277), lymphoid-specific promoters (Calame and Eaton (1988) *Adv. Immunol.* 43:235-275), in particular promoters of T cell receptors (Winoto and Baltimore (1989) *EMBO J.* 8:729-733) and immunoglobulins (Banerji et al. (1983) *Cell* 33:729-740; Queen and Baltimore (1983) *Cell* 33:741-748), neuron-specific promoters (e.g., the neurofilament promoter; Byrne and Ruddle (1989) *Proc. Natl. Acad. Sci. USA* 86:5473-5477), pancreas-specific promoters (Edlund et al. (1985) *Science* 230:912-916), and mammary gland-specific promoters (e.g., milk whey promoter; U.S. Pat. No. 4,873,316 and European Application Publication No. 264,166). Developmentally-regulated promoters are also encompassed, for example the murine hox promoters (Kessel and Gruss (1990) *Science* 249:374-379) and the «-fetoprotein promoter (Campes and Tilghman (1989) *Genes Dev.* 3:537-546).

Another aspect encompassed by the present invention pertains to host cells into which a recombinant expression vector or nucleic acid encompassed by the present invention has been introduced. The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, the modified CD-NTase polypeptide can be expressed in bacterial cells such as *E. coli*, insect cells, yeast or mammalian cells (such as Fao hepatoma cells, primary hepatocytes, Chinese hamster ovary cells (CHO) or COS cells). Other suitable host cells are known to those skilled in the art.

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in Sambrook, et al. (*Molecular Cloning: A Laboratory Manual. 2nd, ed., Cold Spring Harbor Laboratory*, Cold Spring Harbor Laboratory Press, Cold Spring Harbor, NY, 1989), and other laboratory manuals.

A cell culture includes host cells, media and other byproducts. Suitable media for cell culture are well-known in the art. A modified CD-NTase polypeptide or fragment thereof, may be secreted and isolated from a mixture of cells and medium containing the polypeptide. Alternatively, a modified CD-NTase polypeptide or fragment thereof, may be retained cytoplasmically and the cells harvested, lysed and the protein or molecular complex isolated. A modified CD-NTase polypeptide or fragment thereof, may be isolated from cell culture medium, host cells, or both using techniques known in the art for purifying proteins, including ion-exchange chromatography, gel filtration chromatography, ultrafiltration, electrophoresis, and inmmunoaffinity purification with antibodies specific for particular epitopes of the modified CD-NTase polypeptide or a fragment thereof.

In some embodiments, the modified CD-NTase polypeptide, or biologically active fragment thereof, and may be fused to a heterologous polypeptide. In certain embodiments, the fused polypeptide has greater half-life and/or cell permeability than the corresponding unfused modified CD-NTase polypeptide, or biologically active fragment thereof. For example, the modified CD-NTase polypeptide may be fused to a cell permeable peptide to facilitate the delivery of the modified CD-NTase polypeptide into the intact cells. Cell permeable peptides, also known as protein transduction domains (PTDs), are carriers with small peptide domains that can freely cross cell membranes. Several PTDs have been identified that allow a fused protein to efficiently cross cell membranes in a process known as protein transduction. Studies have demonstrated that a TAT peptide derived from the HIV TAT protein has the ability to transduce peptides or proteins into various cells. PTDs have been utilized in anticancer strategy, for example, a cell permeable Bcl-2 binding peptide, cpm1285, shows activity in slowing human myeloid leukemia growth in mice. Cell-permeable phosphopeptides, such as FGFR730pY, which mimics receptor binding sites for specific SH2 domain-containing proteins are potential tools for cancer research and cell signaling mechanism studies. In other embodiments, heterologous tags can be used for purification purposes (e.g., epitope tags and Fc fusion tags), according to standards methods known in the art.

Thus, a nucleotide sequence encoding all or a selected portion of the modified CD-NTase polypeptide may be used to produce a recombinant form of the protein via microbial or eukaryotic cellular processes. Ligating the sequence into a polynucleotide construct, such as an expression vector, and transforming or transfecting into hosts, either eukaryotic (yeast, avian, insect, or mammalian) or prokaryotic (bacterial cells), are standard procedures. Similar procedures, or modifications thereof, may be employed to prepare recombinant modified CD-NTase polypeptides, or fragments thereof, by microbial means or tissue-culture technology in accordance with the subject invention.

In another variation, protein production may be achieved using in vitro translation systems. In vitro translation systems are, generally, a translation system which is a cell-free extract containing at least the minimum elements necessary for translation of an RNA molecule into a protein. An in vitro translation system typically comprises at least ribosomes, tRNAs, initiator methionyl-tRNAMet, proteins or complexes involved in translation, e.g., eIF2, eIF3, the cap-binding (CB) complex, comprising the cap-binding protein (CBP) and eukaryotic initiation factor 4F (eIF4F). A variety of in vitro translation systems are well-known in the art and include commercially available kits. Examples of in vitro translation systems include eukaryotic lysates, such as rabbit reticulocyte lysates, rabbit oocyte lysates, human cell lysates, insect cell lysates and wheat germ extracts. Lysates are commercially available from manufacturers such as Promega Corp., Madison, Wis.; Stratagene, La Jolla, Calif.; Amersham, Arlington Heights, Ill.; and GIBCO/BRL, Grand Island, N.Y. In vitro translation systems typically comprise macromolecules, such as enzymes, translation, initiation and elongation factors, chemical reagents, and ribosomes. In addition, an in vitro transcription system may be used. Such systems typically comprise at least an RNA polymerase holoenzyme, ribonucleotides and any necessary transcription initiation, elongation and termination factors. In vitro transcription and translation may be coupled in a one-pot reaction to produce proteins from one or more isolated DNAs.

In certain embodiments, the modified CD-NTase polypeptide, or fragment thereof, may be synthesized chemically, ribosomally in a cell free system, or ribosomally within a cell. Chemical synthesis may be carried out using a variety of art recognized methods, including stepwise solid phase synthesis, semi-synthesis through the conformationally-assisted re-ligation of peptide fragments, enzymatic ligation of cloned or synthetic peptide segments, and chemical ligation. Native chemical ligation employs a chemoselective reaction of two unprotected peptide segments to produce a transient thioester-linked intermediate. The transient thioester-linked intermediate then spontaneously undergoes a rearrangement to provide the full length ligation product having a native peptide bond at the ligation site. Full length ligation products are chemically identical to proteins produced by cell free synthesis. Full length ligation products may be refolded and/or oxidized, as allowed, to form native disulfide-containing protein molecules. (see e.g., U.S. Pat. Nos. 6,184,344 and 6,174,530; and T. W. Muir et al., (1993) *Curr. Opin. Biotech.*: vol. 4, p 420; M. Miller, et al., (1989) *Science*: vol. 246, p 1149; A. Wlodawer, et al., (1989) *Science*: vol. 245, p 616; L. H. Huang, et al., (1991) *Biochemistry*: vol. 30, p 7402; M. Sclmolzer, et al., (1992) *Int. J. Pept. Prot. Res.*: vol. 40, p 180-193; K. Rajarathnam, et al., (1994) *Science*: vol. 264, p 90; R. E. Offord, "Chemical Approaches to Protein Engineering", in Protein Design and the Development of New therapeutics and Vaccines, J. B. Hook, G. Poste, Eds., (Plenum Press, New York, 1990) pp. 253-282; C. J. A. Wallace, et al., (1992) *J. Biol. Chem.*: vol. 267, p 3852; L. Abrahmsen, et al., (1991) *Biochemistry*: vol. 30, p 4151; T. K. Chang, et al., (1994) *Proc. Natl. Acad. Sci. USA* 91:12544-12548; M. Schnlzer, et al., (1992) *Science*: vol., 3256, p 221; and K. Akaji, et al., (1985) *Chem. Pharm. Bull.* (Tokyo) 33:184).

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Preferred selectable markers include those which confer resistance to drugs, such as G418, hygromycin and methotrexate. Nucleic acid encoding a selectable marker can be introduced into a host cell on the same vector as that encoding the modified CD-NTase polypeptide or can be introduced on a separate vector. Cells stably transfected with the introduced nucleic acid can be identified by drug selection (e.g., cells that have incorporated the selectable marker gene will survive, while the other cells die).

A host cell encompassed by the present invention, such as a prokaryotic or eukaryotic host cell in culture, can be used to produce (i.e., express) the modified CD-NTase polypeptide. Accordingly, the invention further provides methods for producing the modified CD-NTase polypeptide using the host cells of the invention. In one embodiment, the method comprises culturing the host cell of invention (into which a recombinant expression vector encoding the modified CD-NTase polypeptide has been introduced) in a suitable medium until the modified CD-NTase polypeptide is produced. In another embodiment, the method further comprises isolating the modified CD-NTase polypeptide from the medium or the host cell.

The host cells of the invention can also be used to produce human or non-human transgenic animals and/or cells that, for example, overexpress the modified CD-NTase polypeptide or oversecrete the modified CD-NTase polypeptide. The non-human transgenic animals can be used in screening assays designed to identify agents or compounds, e.g., drugs, pharmaceuticals, etc., which are capable of ameliorating detrimental symptoms of selected disorders such as diffuse gastric cancer (DGC), lobular breast cancer, or other types of EMT cancers. For example, in one embodiment, a host cell encompassed by the present invention is a fertilized oocyte or an embryonic stem cell into which the modified CD-NTase polypeptide-encoding sequences, or fragments thereof, have been introduced. Such host cells can then be used to create non-human transgenic animals in which exogenous modified CD-NTase polypeptide sequences have been introduced into their genome or homologous recombinant animals in which endogenous CD-NTase sequences have been altered. Such animals are useful for studying the function and/or activity of the modified CD-NTase polypeptide, or fragments thereof, and for identifying and/or evaluating modulators of the modified CD-NTase polypeptide activity. As used herein, a "transgenic animal" is a non-human animal, preferably a mammal, more preferably a rodent such as a rat or mouse, in which one or more of the cells of the animal includes a transgene. Other examples of transgenic animals include nonhuman primates, sheep, dogs, cows, goats, chickens, amphibians, etc. A transgene is exogenous DNA which is integrated into the genome of a cell from which a transgenic animal develops and which remains in the genome of the mature animal, thereby directing the expression of an encoded gene product in one or more cell types or tissues of the transgenic animal. As used herein, a "homologous recombinant animal" is a nonhuman animal, preferably a mammal, more preferably a mouse, in which an endogenous CD-NTase gene has been altered by homologous recombination between the endogenous gene and an exogenous DNA molecule introduced into a cell of the animal, e.g., an embryonic cell of the animal, prior to development of the animal.

A transgenic animal encompassed by the present invention can be created by introducing nucleic acids encoding the modified CD-NTase polypeptide, or a fragment thereof, into the male pronuclei of a fertilized oocyte, e.g., by microinjection, retroviral infection, and allowing the oocyte to develop in a pseudopregnant female foster animal. The modified CD-NTase cDNA sequence can be introduced as a transgene into the genome of a nonhuman animal. Alternatively, a nonhuman homologue of the modified CD-NTase gene can be used as a transgene. Intronic sequences and polyadenylation signals can also be included in the transgene to increase the efficiency of expression of the transgene. A tissue-specific regulatory sequence(s) can be operably linked to the modified CD-NTase transgene to direct expression of the modified CD-NTase polypeptide to particular cells. Methods for generating transgenic animals via embryo manipulation and microinjection, particularly animals such as mice, have become conventional in the art and are described, for example, in U.S. Pat. Nos. 4,736,866 and 4,870,009, both by Leder et al., U.S. Pat. No. 4,873,191 by Wagner et al. and in Hogan, B., Manipulating the Mouse Embryo, (Cold Spring Harbor Laboratory Press, Cold Spring Harbor, N.Y., 1986). Similar methods are used for production of other transgenic animals. A transgenic founder animal can be identified based upon the presence of the modified CD-NTase transgene in its genome and/or expression of the modified CD-NTase mRNA in tissues or cells of the animals. A transgenic founder animal can then be used to breed additional animals carrying the transgene. Moreover, transgenic animals carrying a transgene encoding the modified CD-NTase polypeptide can further be bred to other transgenic animals carrying other transgenes.

To create a homologous recombinant animal, a vector is prepared which contains at least a portion of a modified CD-NTase gene. For example, a modified CD-NTase gene can be used to construct a homologous recombination vector suitable for altering an endogenous CD-NTase gene, in the mouse genome. In the homologous recombination vector, the modified CD-NTase gene is flanked at its 5' and 3' ends by additional nucleic acid of the CD-NTase gene to allow for homologous recombination to occur between the exogenous modified CD-NTase gene carried by the vector and an endogenous CD-NTase gene in an embryonic stem cell. The additional flanking CD-NTase nucleic acid is of sufficient length for successful homologous recombination with the endogenous gene. Typically, several kilobases of flanking DNA (both at the 5' and 3' ends) are included in the vector (see e.g., Thomas, K. R. and Capecchi, M. R. (1987) *Cell* 51:503 for a description of homologous recombination vectors). The vector is introduced into an embryonic stem cell line (e.g., by electroporation) and cells in which the modified CD-NTase gene has homologously recombined with the endogenous CD-NTase gene are selected (see e.g., Li, E. et al. (1992) *Cell* 69:915). The selected cells are then injected into a blastocyst of an animal (e.g., a mouse) to form aggregation chimeras (see e.g., Bradley, A. in *Teratocarcinomas and Embryonic Stem Cells: A Practical Approach*, E.J. Robertson, ed. (IRL, Oxford, 1987) pp. 113-152). A chimeric embryo can then be implanted into a suitable pseudopregnant female foster animal and the embryo brought to term. Progeny harboring the homologously recombined DNA in their germ cells can be used to breed animals in which all cells of the animal contain the homologously recombined DNA by germline transmission of the transgene. Methods for constructing homologous recombination vectors and homologous recombinant animals are described further in Bradley (1991) *Current Opinion in Biotechnology* 2:823-829 and in PCT International Publication Nos.: WO 90/11354 by Le Mouellec et al.; WO 91/01140 by Smithies et al.; WO 92/0968 by Zijlstra et al.; and WO 93/04169 by Berns et al.

In another embodiment, transgenic nonhuman animals can be produced which contain selected systems which allow for regulated expression of the transgene. One example of such a system is the cre/loxP recombinase system of bacteriophage P1. For a description of the cre/loxP recombinase system, see, e.g., Lakso et al. (1992) *Proc. Natl. Acad. Sci. USA* 89:6232-6236. Another example of a recombinase system is the FLP recombinase system of

*Saccharomyces cerevisiae* (O'Gorman et al. (1991) Science 251:1351-1355. If a cre/loxP recombinase system is used to regulate expression of the transgene, animals containing transgenes encoding both the Cre recombinase and a selected protein are required. Such animals can be provided through the construction of "double" transgenic animals, e.g., by mating two transgenic animals, one containing a transgene encoding a selected protein and the other containing a transgene encoding a recombinase.

Clones of the nonhuman transgenic animals described herein can also be produced according to the methods described in Wilmut, I. et al. (1997) *Nature* 385:810$^{-813}$ and PCT International Publication Nos. WO 97/07668 and WO 97/07669. In brief, a cell, e.g., a somatic cell, from the transgenic animal can be isolated and induced to exit the growth cycle and enter Go phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyst and then transferred to pseudopregnant female foster animal. The offspring borne of this female foster animal will be a clone of the animal from which the cell, e.g., the somatic cell, is isolated.

C. Modified CD-NTase Polypeptides

The present invention also provides soluble, purified and/or isolated forms of modified CD-NTase polypeptides that catalyzes production of circular or linear nucleotide-based second messengers, wherein said polypeptide comprises an amino acid sequence having at least 70% identity to any one of CD-NTase amino acid sequences listed in Table 1 and further comprises a nucleotidyltransferase protein fold and an active site, wherein the active site comprises the amino acid sequence $GSX_1X_2$ [ . . . ] $X_n$ $A_1Y_1B_1$, optionally wherein the active site comprises the amino acid sequence $GSX_1X_2$ [ . . . ] $X_n$ $A_1Y_1B_1Z_1Z_2$ [ . . . ] $Z_mC_1$, wherein:

$A_1$, $B_1$, and $C_1$ independently represent amino acid residue D or E; $X_1$, $X_2$, . . . , $X_n$, $Y_1$, $Z_1$, $Z_2$, . . . , and Zn independently represent any amino acid residue; and n or m is any integer, for use according to methods described herein.

In one aspect, a modified CD-NTase polypeptide may comprise a CD-NTase amino acid sequence of any one of CD-NTase amino acid sequences listed in Table 1 and further comprising a nucleotidyltransferase protein fold and an active site described herein, or a CD-NTase amino acid sequence of any one of CD-NTase amino acid sequences listed in Table 1 and further comprising a nucleotidyltransferase protein fold and an active site described herein with 1 to about 20 additional conservative amino acid substitutions. Amino acid sequence of any modified CD-NTase polypeptide described herein can also be at least 50, 55, 60, 65, 70, 75, 80, 85, 90, 91, 92, 93, 94, 95, 96, 97, 98, 99, or 99.5% identical to a CD-NTase amino acid sequence of any one of CD-NTase amino acid sequences listed in Table 1 and further comprises a nucleotidyltransferase protein fold and an active site described herein, or a fragment thereof.

In another aspect, the present invention contemplates a composition comprising an isolated modified CD-NTase polypeptide described herein and less than about 25%, or alternatively 15%, or alternatively 5%, contaminating biological macromolecules or polypeptides.

The present invention further provides compositions related to producing, detecting, or characterizing a modified CD-NTase polypeptide, or fragment thereof, such as nucleic acids, vectors, host cells, and the like. Such compositions may serve as compounds that modulate a modified CD-NTase polypeptide's expression and/or activity, such as antisense nucleic acids.

In certain embodiments, a modified CD-NTase polypeptide of the invention may be a fusion protein containing a domain which increases its solubility and bioavailability and/or facilitates its purification, identification, detection, and/or structural characterization. In some embodiments, it may be useful to express a modified CD-NTase polypeptide in which the fusion partner enhances fusion protein stability in blood plasma and/or enhances systemic bioavailability. Exemplary domains, include, for example, glutathione S-transferase (GST), protein A, protein G, calmodulin-binding peptide, thioredoxin, maltose binding protein, HA, myc, poly arginine, poly His, poly His-Asp or FLAG fusion proteins and tags. Additional exemplary domains include domains that alter protein localization in vivo, such as signal peptides, type 2I secretion system-targeting peptides, transcytosis domains, nuclear localization signals, etc. In various embodiments, a modified CD-NTase polypeptide of the invention may comprise one or more heterologous fusions. Polypeptides may contain multiple copies of the same fusion domain or may contain fusions to two or more different domains. The fusions may occur at the N-terminus of the polypeptide, at the C-terminus of the polypeptide, or at both the N- and C-terminus of the polypeptide. It is also within the scope of the invention to include linker sequences between a polypeptide of the invention and the fusion domain in order to facilitate construction of the fusion protein or to optimize protein expression or structural constraints of the fusion protein. In another embodiment, the polypeptide may be constructed so as to contain protease cleavage sites between the fusion polypeptide and polypeptide of the invention in order to remove the tag after protein expression or thereafter. Examples of suitable endoproteases, include, for example, Factor Xa and TEV proteases.

In some embodiments, the modified CD-NTase polypeptides, or fragments thereof, are fused to an antibody (e.g., IgG1, IgG2, IgG3, IgG4) fragment (e.g., Fc polypeptides). Techniques for preparing these fusion proteins are known, and are described, for example, in WO 99/31241 and in Cosman et.al. (2001) *Immunity* 14:123-133. Fusion to an Fc polypeptide offers the additional advantage of facilitating purification by affinity chromatography over Protein A or Protein G columns.

In still another embodiment, a modified CD-NTase polypeptide may be labeled with a fluorescent label to facilitate their detection, purification, or structural characterization. In an exemplary embodiment, a modified CD-NTase polypeptide of the invention may be fused to a heterologous polypeptide sequence which produces a detectable fluorescent signal, including, for example, green fluorescent protein (GFP), enhanced green fluorescent protein (EGFP), *Renilla Reniformis* green fluorescent protein, GFPmut2, GFPuv4, enhanced yellow fluorescent protein (EYFP), enhanced cyan fluorescent protein (ECFP), enhanced blue fluorescent protein (EBFP), citrine and red fluorescent protein from discosoma (dsRED).

In preferred embodiments, the modified CD-NTase polypeptide or portion thereof comprises an amino acid sequence which is sufficiently homologous to an amino acid sequence shown in Table 1 or fragment thereof and further comprises a nucleotidyltransferase protein fold and an active site described herein, such that the modified CD-NTase polypeptide or portion thereof catalyzes production of circular or linear nucleotide-based second messengers. The portion of the protein is preferably a biologically active portion as described herein. In another preferred embodiment, the modified CD-NTase polypeptides has an amino acid sequence shown in Table 1, or fragment thereof, and further comprises comprises a nucleotidyltransferase protein fold and an active site described herein, or an amino acid sequence which is at least about 50%, 55%, 60%, 65%, 70%, 75%, 80%, 85%, 90%, 91%, 92%, 93%, 94%, 95%, 96%, 97%, 98%, 99% or more homologous to the amino acid sequence shown in Table 1, or fragment thereof, and further comprises comprises a nucleotidyltransferase protein fold and an active site described herein. In yet another preferred embodiment, the modified CD-NTase polypeptide has an amino acid sequence which is encoded by a nucleotide sequence which hybridizes, e.g., hybridizes under stringent conditions, to the nucleotide sequence shown in Table 2, or fragment thereof, or a nucleotide sequence which is at least about 50%, preferably at least about 60%, more preferably at least about 70%, yet more preferably at least about 80%, still more preferably at least about 90%, and most preferably at least about 95% or more homologous to the nucleotide sequence shown in Table 2, or fragment thereof. The preferred modified CD-NTase polypeptides encompassed by the present invention also preferably possess at least one of the modified CD-NTase polypeptide biological activities described herein.

Biologically active portions of a modified CD-NTase polypeptide include peptides comprising amino acid sequences derived from the amino acid sequence of the modified CD-NTase protein, or the amino acid sequence of a protein homologous to the modified CD-NTase protein, which include fewer amino acids than the full-length modified CD-NTase protein or the full-length polypeptide which is homologous to the modified CD-NTase protein, and exhibit at least one activity of the modified CD-NTase protein. Typically, biologically active portions (peptides, e.g., peptides which are, for example, 50, 55, 60, 65, 70, 75, 80, 85, 90, 95, 100 or more amino acids in length) comprise a domain or motif, (e.g., the full-length protein minus the signal peptide). In a preferred embodiment, the biologically active portion of the protein which includes one or more the domains/motifs described herein catalyzes production of circular or linear nucleotide-based second messengers. Moreover, other biologically active portions, in which other regions of the protein are deleted, can be prepared by recombinant techniques and evaluated for one or more of the activities described herein. Preferably, the biologically active portions of the modified CD-NTase protein include one or more selected domains/motifs or portions thereof having biological activity. In one embodiment, a modified CD-NTase polypeptide fragment of interest consists of a portion of a full-length modified CD-NTase polypeptide that is less than 240, 230, 220, 210, 200, 195, 190, 185, 180, 175, 170, 165, 160, 155, 150, 145, 140, 135, 130, 125, 120, 115, 110, 105, 100, 95, 90, 85, 80, 75, or 70 amino acids in length.

The modified CD-NTase polypeptides of the precent invention can be produced by recombinant DNA techniques. For example, a nucleic acid molecule encoding the protein is cloned into an expression vector (as described above), the expression vector is introduced into a host cell (as described above) and the modified CD-NTase polypeptide is expressed in the host cell. The modified CD-NTase polypeptide can then be isolated from the cells by an appropriate purification scheme using standard protein purification techniques. Alternative to recombinant expression, a modified CD-NTase protein, polypeptide, or peptide can be synthesized chemically using standard peptide synthesis techniques. Moreover, modified CD-NTase protein can be isolated from cells (e.g., engineered cells that harboring modified CD-NTase), for example using an anti-CD-NTase antibody.

The invention also provides modified CD-NTase chimeric or fusion proteins. As used herein, a modified CD-NTase "chimeric protein" or "fusion protein" comprises a modified CD-NTase polypeptide operatively linked to a non-CD-NTase polypeptide. A "modified CD-NTase polypeptide" refers to a polypeptide having an amino acid sequence having at least 70% identity to CD-NTase with a nucleotidyltransferase protein fold and an active site described herein, whereas a "non-CD-NTase polypeptide" refers to a polypeptide having an amino acid sequence corresponding to a protein which is not substantially homologous to the modified CD-NTase protein, e.g., a protein which is different from the modified CD-NTase protein and which is derived from the same or a different organism. Within the fusion protein, the term "operatively linked" is intended to indicate that the modified CD-NTase polypeptide and the non-CD-NTase polypeptide are fused in-frame to each other. The non-CD-NTase polypeptide can be fused to the N-terminus or C-terminus of the modified CD-NTase polypeptide. For example, in one embodiment the fusion protein is a modified CD-NTase-GST and/or modified CD-NTase-Fc fusion protein in which the modified CD-NTase sequences, respectively, are fused to the N-terminus of the GST or Fc sequences. Such fusion proteins can be made using the modified CD-NTase polypeptides. Such fusion proteins can also facilitate the purification, expression, and/or bioavailability of recombinant modified CD-NTase polypeptides. In another embodiment, the fusion protein is a modified CD-NTase protein containing a heterologous signal sequence at its C-terminus. In certain host cells (e.g., mammalian host cells), expression and/or secretion of the modified CD-NTase polypeptides can be increased through use of a heterologous signal sequence.

Preferably, a modified CD-NTase chimeric or fusion protein of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and reamplified to generate a chimeric gene sequence (see, for example, *Current Protocols in Molecular Biology*, eds. Ausubel et al. John Wiley & Sons: 1992). Moreover, many expression vectors are commercially available that already encode a fusion moiety (e.g., a GST polypeptide). A modified CD-NTase-encoding nucleic acid can be cloned into such an expression vector such that the fusion moiety is linked in-frame to the modified CD-NTase protein.

The present invention also pertains to homologues of the modified CD-NTase proteins. Homologues of the modified CD-NTase protein can be generated by mutagenesis, e.g., discrete point mutation or truncation of the modified CD-NTase protein, respectively. As used herein, the term "homologue" refers to a variant form of the modified CD-NTase protein. In one embodiment, treatment of a subject with a homologue having a subset of the biological activities of the naturally occurring form of the protein has fewer side effects in a subject relative to treatment with the naturally occurring form of the modified CD-NTase protein.

In an alternative embodiment, homologues of the modified CD-NTase protein can be identified by screening combinatorial libraries of mutants, e.g., truncation mutants, of the modified CD-NTase protein. In one embodiment, a variegated library of the modified CD-NTase variants is generated by combinatorial mutagenesis at the nucleic acid level and is encoded by a variegated gene library. A variegated library of the modified CD-NTase variants can be produced by, for example, enzymatically ligating a mixture of synthetic oligonucleotides into gene sequences such that a degenerate set of potential modified CD-NTase sequences is expressible as individual polypeptides, or alternatively, as a set of larger fusion proteins (e.g., for phage display) containing the set of the modified CD-NTase sequences therein. There are a variety of methods which can be used to produce libraries of potential modified CD-NTase homologues from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential modified CD-NTase sequences. Methods for synthesizing degenerate oligonucleotides are known in the art (see, e.g., Narang, S.A. (1983) *Tetrahedron* 39:3; Itakura et al. (1984) *Annu. Rev. Biochem.* 53:323; Itakura et al. (1984) *Science* 198:1056; Ike et al. (1983) *Nucleic Acid Res.* 11:477.

In addition, libraries of fragments of the modified CD-NTase protein coding can be used to generate a variegated population of the modified CD-NTase fragments for screening and subsequent selection of homologues of a modified CD-NTase protein. In one embodiment, a library of coding sequence fragments can be generated by treating a double stranded PCR fragment of a modified CD-NTase coding sequence with a nuclease under conditions wherein nicking occurs only about once per molecule, denaturing the double stranded DNA, renaturing the DNA to form double stranded DNA which can include sense/antisense pairs from different nicked products, removing single stranded portions from reformed duplexes by treatment with S1 nuclease, and ligating the resulting fragment library into an expression vector. By this method, an expression library can be derived which encodes N-terminal, C-terminal and internal fragments of various sizes of the modified CD-NTase protein.

Several techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of the modified CD-NTase homologues. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a new technique which enhances the frequency of functional mutants in the libraries, can be used in combination with the screening assays to identify modified CD-NTase homologues (Arkin and Youvan (1992) *Proc. Natl. Acad. Sci. USA* 89:7811-7815).

III. Uses of CD-NTases to Produce Nucleotide-Based Second Messengers

The modified CD-NTase nucleic acid and polypeptide molecules described herein may be used to produce nucleotide-based second messengners. For example, the modified CD-NTase nucleic acid or polypeptide molecules may be delivered into a cell or an organism cultured at an optimal condition so that the modified CD-NTase nucleic acid or polypeptide molecules catalyze nucleotide-based second messenger synthesis. The delivery method is known in the art and also described herein. For example, the modified CD-NTase nucleic acid or polypeptide molecules may be delivered using chemical vehicles like liposomes or through viral delivery. In other embodiments, the modified CD-NTase nucleic acid or polypeptide molecules may be contacted with nucleotide substrates in a cell-free condition where buffers, ions, and/or ligands required for the catalytic activity of the modified CD-NTase are supplied.

Second messenger synthesis by the CD-NTases can be modulated further in addition to expressing the CD-NTases. For example, the nucleotide substrates may be modified or unnatural nucloetides as described in the definitions, so that the nucleotide-based second messengers synthesized may include modified or unnatural nucloetides. Methods for identifying, purifying, and/or characterizing the produced nucleotide-based second messengers are known in the art and described in the examples below. The nucleotide-based second messengers may be further modified for better properties. For example nonhydrolyzable sulfate analogs or lapidated versions of the nucleotide-based second messengers may be synthesized. In some embodiments, making non-natural linear or cyclic oligonucleotides available as substrates for the CD-NTases can modulate the second messengers synthesized (e.g., feeding the CD-NTases non-natural linear or cyclic oligonucleotides of interest, such as by ingestion in vivo or contact in vitro).

The CD-NTases themselves and/or nucleotide-based second messengers produced using the modified CD-NTase nucleic acid and polypeptide molecules described herein, can be used as therapeutics.

IV. Identification of Compounds that Modulate CD-NTases

The modified CD-NTase nucleic acid and polypeptide molecules described herein may be used to design and/or screen for modulators of one or more of biological activities of CD-NTase polypeptides or complexes. In particular, information useful for the design of therapeutic and diagnostic molecules, including, for example, the protein domain, structural information, and the like for modified CD-NTase polypeptides of the invention is now available or attainable as a result of the ability to prepare, purify and characterize the modified CD-NTase polypeptides and complexes, and domains, fragments, variants and derivatives thereof.

Therefore, one aspect encompassed by the present invention pertains to methods of screening for modulators of the modified CD-NTase nucleic acid and polypeptide molecules. For example, in one such method, a modified CD-NTase nucleic acid and/or polypeptide, is contacted with a test compound, and the activity of the modified CD-NTase nucleic acid and/or polypeptide is determined in the presence of the test compound, wherein a change in the activity of the modified CD-NTase nucleic acid and/or polypeptide in the presence of the compound as compared to the activity in the absence of the compound (or in the presence of a control compound) indicates that the test compound modulates the activity of the modified CD-NTase nucleic acid and/or polypeptide. The modulators of the invention may elicit a change in one or more of the following activities: (a) a change in the level and/or rate of formation of a CD-NTase-nucleotide complex and/or a CD-NTase-DNA-nucleotide complex, (b) a change in the activity of a CD-NTase nucleic acid and/or polypeptide, including, e.g., circular or linear nucleotide-based second messenger synthesis, enzyme kinetics, STING pathway activity, RECON pathway activity, etc., (c) a change in the stability of a CD-NTase nucleic acid and/or polypeptide, (d) a change in the conformation of a CD-NTase nucleic acid and/or polypeptide, or (e) a change in the activity of at least one component contained in a CD-NTase-nucleotide complex and/or a CD-NTase-DNA-nucleotide complex.

Compounds to be tested for their ability to act as modulators of CD-NTase nucleic acids and/or polypeptides, can be produced, for example, by bacteria, yeast or other organisms (e.g. natural products), produced chemically (e.g. small molecules, including peptidomimetics), or produced recombinantly. Compounds for use with the above-described methods may be selected from the group of compounds consisting of lipids, carbohydrates, polypeptides, peptidomimetics, peptide-nucleic acids (PNAs), small molecules, natural products, aptamers and polynucleotides. In certain embodiments, the compound is a polynucleotide. In some embodiments, said polynucleotide is an antisense nucleic acid. In other embodiments, said polynucleotide is a siRNA. In certain embodiments, the compound comprises a biologically active fragment of a CD-NTase polypeptide (e.g., a dominant negative form that binds to DNA and/or nucleotide substrates, but does not activate, nucleotide-based second messenger synthesis).

A variety of assay formats will suffice and, in light encompassed by the present disclosure, those not expressly described herein may nevertheless be comprehended by one of ordinary skill in the art based on the teachings herein. Assay formats for analyzing activity of a modified CD-NTase nucleic acid and/or polypeptide, may be generated in many different forms, and include assays based on cell-free systems, e.g. purified proteins or cell lysates, as well as cell-based assays which utilize intact cells. Simple binding assays can also be used to detect agents which modulate a modified CD-NTase, for example, by enhancing the binding of a modified CD-NTase polypeptide to DNA, and/or by enhancing the binding of the modified CD-NTase-DNA complex to a substrate. Another example of an assay useful for identifying a modulator of CD-NTase is a competitive assay that combines one or more modified CD-NTase polypeptides with a potential modulator, such as, for example, polypeptides, nucleic acids, natural substrates or ligands, or substrate or ligand mimetics, under appropriate conditions for a competitive inhibition assay. The modified CD-NTase polypeptides can be labeled, such as by radioactivity or a colorimetric compound, such that CD-NTase-DNA complex formation and/or activity can be determined accurately to assess the effectiveness of the potential modulator.

Assays may employ kinetic or thermodynamic methodology using a wide variety of techniques including, but not limited to, microcalorimetry, circular dichroism, capillary zone electrophoresis, nuclear magnetic resonance spectroscopy, fluorescence spectroscopy, and combinations thereof. Assays may also employ any of the methods for isolating, preparing and detecting the modified CD-NTase polypeptide, or complexes thereof, as described above.

Complex formation between a modified CD-NTase polypeptide, or fragment thereof, and a binding partner (e.g., DNA or neucleotides) may be detected by a variety of methods. Modulation of the complex's formation may be quantified using, for example, detectably labeled proteins such as radiolabeled, fluorescently labeled, or enzymatically labeled polypeptides or binding partners, by immunoassay, or by chromatographic detection. Methods of isolating and identifying CD-NTase-DNA complexes described above may be incorporated into the detection methods.

In certain embodiments, it may be desirable to immobilize a modified CD-NTase polypeptide to facilitate separation of modified CD-NTase complexes from uncomplexed forms of modified CD-NTase polypeptides, DNA fragments, and/or nucleotide substrates, as well as to accommodate automation of the assay. Binding of a modified CD-NTase polypeptide to a binding partner may be accomplished in any vessel suitable for containing the reactants. Examples include microtitre plates, test tubes, and micro-centrifuge tubes. In one embodiment, a fusion protein may be provided which adds a domain that allows the protein to be bound to a matrix. For example, glutathione-S-transferase/polypeptide (GST/polypeptide) fusion proteins may be adsorbed onto glutathione sepharose beads (Sigma Chemical, St. Louis, Mo.) or glutathione derivatized microtitre plates, which are then combined with the binding partner, e.g. an 35S-labeled binding partner, and the test compound, and the mixture incubated under conditions conducive to complex formation, e.g. at physiological conditions for salt and pH, though slightly more stringent conditions may be desired. Following incubation, the beads are washed to remove any unbound label, and the matrix immobilized and radiolabel determined directly (e.g. beads placed in scintillant), or in the supernatant after the complexes are subsequently dissociated. Alternatively, the complexes may be dissociated from the matrix, separated by SDS-PAGE, and the level of the modified CD-NTase polypeptides found in the bead fraction quantified from the gel using standard electrophoretic techniques such as described in the appended examples.

Other techniques for immobilizing proteins on matrices are also available for use in the subject assay. For instance, a modified CD-NTase polypeptide may be immobilized utilizing conjugation of biotin and streptavidin. For instance, biotinylated polypeptide molecules may be prepared from biotin-NHS (N-hydroxy-succinimide) using techniques well-known in the art (e.g., biotinylation kit, Pierce Chemicals, Rockford, Ill.), and immobilized in the wells of streptavidin-coated 96 well plates (Pierce Chemical). Alternatively, antibodies reactive with the polypeptide may be derivatized to the wells of the plate, and polypeptide trapped in the wells by antibody conjugation. As above, preparations of a binding partner and a test compound are incubated in the polypeptide presenting wells of the plate, and the amount of complex trapped in the well may be quantified. Exemplary methods for detecting such complexes, in addition to those described above for the GST-immobilized complexes, include immunodetection of complexes using antibodies reactive with the binding partner, or which are reactive with the modified CD-NTase polypeptide and compete with the binding partner; as well as enzyme-linked assays which rely on detecting an enzymatic activity associated with the binding partner, either intrinsic or extrinsic activity. In the instance of the latter, the enzyme may be chemically conjugated or provided as a fusion protein with the binding partner. To illustrate, the binding partner may be chemically cross-linked or genetically fused with horseradish peroxidase, and the amount of the modified CD-NTase polypeptide trapped in the modified CD-NTase-DNA complex and/or CD-NTase-DNA-nucleotide complex may be assessed with a chromogenic substrate of the enzyme, e.g. 3,3'-diaminobenzadine terahydrochloride or 4-chloro-1-napthol. Likewise, a fusion protein comprising the modified CD-NTase polypeptide and glutathione-S-transferase may be provided, and the modified CD-NTase-DNA complex and/or CD-NTase-DNA-nucleotide complex formation may be quantified by detecting the GST activity using 1-chloro-2,4-dinitrobenzene (Habig et al (1974) *J Biol Chem* 249:7130).

Antibodies against the modified CD-NTase polypeptide can be used for immunodetection purposes. Alternatively, the modified CD-NTase polypeptide to be detected may be "epitope-tagged" in the form of a fusion protein that includes, in addition to the polypeptide sequence, a second polypeptide for which antibodies are readily available (e.g. from commercial sources). For instance, the GST fusion proteins described above may also be used for quantification of binding using antibodies against the GST moiety. Other useful epitope tags include myc-epitopes (e.g., see Ellison et al. (1991) *J Biol Chem* 266:21150-21157) which includes a 10-residue sequence from c-myc, as well as the pFLAG system (International Biotechnologies, Inc.) or the pEZZ-protein A system (Pharmacia, N.J.).

In certain in vitro embodiments encompassed by the present assay, the protein or the set of proteins engaged in a protein-protein, protein-substrate, or protein-nucleic acid interaction comprises a reconstituted protein mixture of at least semi-purified proteins. By semi-purified, it is meant that the proteins utilized in the reconstituted mixture have been previously separated from other cellular or viral proteins. For instance, in contrast to cell lysates, the proteins involved in a protein-substrate, protein-protein or nucleic acid-protein interaction are present in the mixture to at least 50% purity relative to all other proteins in the mixture, and more preferably are present at 90-95% purity. In certain embodiments of the subject method, the reconstituted protein mixture is derived by mixing highly purified proteins such that the reconstituted mixture substantially lacks other proteins (such as of cellular or viral origin) which might interfere with or otherwise alter the ability to measure activity resulting from the given protein-substrate, protein-protein interaction, or nucleic acid-protein interaction.

In one embodiment, the use of reconstituted protein mixtures allows more careful control of the protein-substrate, protein-protein, or nucleic acid-protein interaction conditions. Moreover, the system may be derived to favor discovery of modulators of particular intermediate states of the protein-protein interaction. For instance, a reconstituted protein assay may be carried out both in the presence and absence of a candidate agent, thereby allowing detection of a modulator of a given protein-substrate, protein-protein, or nucleic acid-protein interaction.

Assaying biological activity resulting from a given protein-substrate, protein-protein or nucleic acid-protein interaction, in the presence and absence of a candidate modulator, may be accomplished in any vessel suitable for containing the reactants. Examples include microtitre plates, test tubes, and micro-centrifuge tubes.

In another embodiment, the modified CD-NTase polypeptide, or complexes thereof, of interest may be generated in whole cells, taking advantage of cell culture techniques to support the subject assay. For example, the modified CD-NTase polypeptide, or complexes thereof, may be constituted in a prokaryotic or eukaryotic cell culture system. Advantages to generating the modified CD-NTase polypeptide, or complexes thereof, in an intact cell includes the ability to screen for modulators of the level and/or activity of the modified CD-NTase polypeptide, or complexes thereof, which are functional in an environment more closely approximating that which therapeutic use of the modulator would require, including the ability of the agent to gain entry into the cell. Furthermore, certain of the in vivo embodiments of the assay are amenable to high through-put analysis of candidate agents.

The modified CD-NTase nucleic acids and/or polypeptide can be endogenous to the cell selected to support the assay. Alternatively, some or all of the components can be derived from exogenous sources. For instance, fusion proteins can be introduced into the cell by recombinant techniques (such as through the use of an expression vector), as well as by microinjecting the fusion protein itself or mRNA encoding the fusion protein. Moreover, in the whole cell embodiments of the subject assay, the reporter gene construct can provide, upon expression, a selectable marker. Such embodiments of the subject assay are particularly amenable to high through-put analysis in that proliferation of the cell can provide a simple measure of the protein-protein interaction.

The amount of transcription from the reporter gene may be measured using any method known to those of skill in the art to be suitable. For example, specific mRNA expression may be detected using Northern blots or specific protein product may be identified by a characteristic stain, western blots or an intrinsic activity. In certain embodiments, the product of the reporter gene is detected by an intrinsic activity associated with that product. For instance, the reporter gene may encode a gene product that, by enzymatic activity, gives rise to a detection signal based on color, fluorescence, or luminescence.

In many drug screening programs which test libraries of compounds and natural extracts, high throughput assays are desirable in order to maximize the number of compounds surveyed in a given period of time. Assays encompassed by the present invention which are performed in cell-free systems, such as may be derived with purified or semi-purified proteins or with lysates, are often preferred as "primary" screens in that they can be generated to permit rapid development and relatively easy detection of an alteration in a molecular target which is mediated by a test compound. Moreover, the effects of cellular toxicity and/or bioavailability of the test compound can be generally ignored in the in vitro system, the assay instead being focused primarily on the effect of the drug on the molecular target as may be manifest in an alteration of binding affinity with other proteins or changes in enzymatic properties of the molecular target. Accordingly, potential modulators of a modified CD-NTase may be detected in a cell-free assay generated by constitution of a functional modified CD-NTase in a cell lysate. In an alternate format, the assay can be derived as a reconstituted protein mixture which, as described below, offers a number of benefits over lysate-based assays.

The activity of a modified CD-NTase nucleic acid and/or polypeptide may be identified and/or assayed using a variety of methods well-known to the skilled artisan. For example, the activity of a modified CD-NTase nucleic acid and/or polypeptide may be determined by assaying for the level of expression of RNA and/or protein molecules. Transcription levels may be determined, for example, using Northern blots, hybridization to an oligonucleotide array or by assaying for the level of a resulting protein product. Translation levels may be determined, for example, using Western blotting or by identifying a detectable signal produced by a protein product (e.g., fluorescence, luminescence, enzymatic activity, etc.). Depending on the particular situation, it may be desirable to detect the level of transcription and/or translation of a single gene or of multiple genes. In another embodiment, the biological activity of a modified CD-NTase nucleic acid and/or polypeptide may be assessed by monitoring the modification of the substrate. For example, the synthesis of nucleotide-based second messengers may be monitored as described in the examples herein.

In yet another embodiment, the biological activity of a modified CD-NTase nucleic acid and/or polypeptide may be assessed by monitoring changes in the phenotype of a targeted cell. For example, the repression of *V. cholera* chemotaxis may be detected as described in the examples herein. The detection means can also include a reporter gene construct which includes a transcriptional regulatory element that is dependent in some form on the level and/or activity of a modified CD-NTase nucleic acid and/or polypeptide. The modified CD-NTase nucleic acid and/or polypeptide may be provided as a fusion protein with a domain that binds to a DNA element of a reporter gene construct. The added domain of the fusion protein can be one which, through its DNA-binding ability, increases or decreases transcription of the reporter gene. Whichever the case may be, its presence in the fusion protein renders it responsive to a modified CD-NTase nucleic acid and/or polypeptide. Accordingly, the level of expression of the reporter gene will vary with the level of expression of a modified CD-NTase nucleic acid and/or polypeptide.

Moreover, in the whole cell embodiments of the subject assay, the reporter gene construct can provide, upon expression, a selectable marker. A reporter gene includes any gene that expresses a detectable gene product, which may be RNA or protein. Preferred reporter genes are those that are readily detectable. The reporter gene may also be included in the construct in the form of a fusion gene with a gene that includes desired transcriptional regulatory sequences or exhibits other desirable properties. For instance, the product of the reporter gene can be an enzyme which confers resistance to an antibiotic or other drug, or an enzyme which complements a deficiency in the host cell (i.e. thymidine kinase or dihydrofolate reductase). To illustrate, the aminoglycoside phosphotransferase encoded by the bacterial transposon gene Tn5 neo can be placed under transcriptional control of a promoter element responsive to the level of a modified CD-NTase nucleic acid and/or polypeptide present in the cell. Such embodiments of the subject assay are particularly amenable to high through-put analysis in that proliferation of the cell can provide a simple measure of inhibition of the modified CD-NTase nucleic acid and/or polypeptide.

V. Structure of CD-NTases

The present invention provides, crystals of CD-NTase polypeptides, as well as structures determined therefrom. In one aspect, the invention relates to a crystal of a CD-NTase polypeptide, wherein the crystal effectively diffracts X-rays for the determination of the atomic coordinates of the CD-NTase polypeptideto a resolution of greater than 5.0 Angstroms, alternatively greater than 3.0 Angstroms, or alternatively greater than 2.0 Angstroms. In one embodiment, the crystal of a CD-NTase polypeptide has a space group P 21 21 21. In another embodiment, the crystal of a CD-NTase polypeptide has a unit cell of dimensions of $\alpha=\beta=\gamma=90.0°$. In yet another embodiment, the crystal has the set of structural coordinates as given in Table 3+/−the root mean square deviation from the backbone atoms of the CD-NTase polypeptide of less than 2 Angstroms, e.g., less than 1.5 Angstroms, less than 1.25 Angstroms, less than 1.0 Angstroms, less than 0.75 Angstroms, less than 0.5 Angstroms, less than 0.45 Angstroms, less than 0.4 Angstroms, less than 0.35 Angstroms, less than 0.3 Angstroms, less than 0.25 Angstroms, or less than 0.2 Angstroms. In one embodiment, CD-NTase in the crystals encompassed by the present invention is a modified CD-NTase polypeptide having at least 70% identity to the CD-NTase amino acid sequence of any one listed in Table 1 and further comprising a nucleotidyltransferase protein fold and an active site described herein. In another embodiment, the modified CD-NTase is a fragment of CD-NTase, e.g., a biologically active fragment of CD-NTase. The CD-NTase polypeptide may be in an Apo form or neucleotide-bound form in the crystal. In still another embodiment, the conformation of the CD-NTase polypeptide is the conformation shown in FIGS. 3A-3B, 4B, and 5F-5H.

X-ray structure coordinates define a unique configuration of points in space. Those of skill in the art understand that a set of structure coordinates for protein or an protein/ligand complex, or a portion thereof, define a relative set of points that, in turn, define a configuration in three dimensions. A similar or identical configuration can be defined by an entirely different set of coordinates, provided the distances and angles between coordinates remain essentially the same. In addition, a scalable configuration of points can be defined by increasing or decreasing the distances between coordinates by a scalar factor while keeping the angles essentially the same.

The present invention thus includes the scalable three-dimensional configuration of points derived from the structure coordinates of at least a portion of a CD-NTase molecule or molecular complex, as listed in Table 3, as well as structurally equivalent configurations, as described below. Preferably, the scalable three-dimensional configuration includes points derived from structure coordinates representing the locations of a plurality of the amino acids defining a CD-NTase binding pocket.

In certain embodiments, the structure coordinates of CD-NTase, as determined by X-ray crystallography, are listed in Table 3. Slight variations in structure coordinates can be generated by mathematically manipulating the CD-NTase structure coordinates. For example, the structure coordinates set forth in Table 3 could be manipulated by crystallographic permutations of the structure coordinates, fractionalization of the structure coordinates, integer additions or subtractions to sets of the structure coordinates, inversion of the structure coordinates or any combination of the above. Alternatively, modifications in the crystal structure due to mutations, additions, substitutions, and/or deletions of amino acids, or other changes in any of the components that make up the crystal, could also yield variations in structure coordinates. Such slight variations in the individual coordinates will have little effect on overall shape. If such variations are within an acceptable standard error as compared to the original coordinates, the resulting three-dimensional shape is considered to be structurally equivalent.

It should be noted that slight variations in individual structure coordinates of the CD-NTase polypeptide would not be expected to significantly alter the nature of chemical entities such as modulators that could associate with the binding pockets. In this context, the phrase "associating with" refers to a condition of proximity between a chemical entity, or portions thereof, and a CD-NTase molecule or portions thereof. The association may be non-covalent, wherein the juxtaposition is energetically favored by hydrogen bonding, van der Waals forces, or electrostatic interactions, or it may be covalent. Thus, for example, a modulator that bound to a binding pocket of CD-NTase would also be expected to bind to or interfere with a structurally equivalent binding pocket.

For the purpose of this invention, any molecule or molecular complex or binding pocket thereof, or any portion thereof, that has a root mean square deviation of conserved residue backbone atoms (N, Ca, C, O) of less than about 0.75 Å, when superimposed on the relevant backbone atoms described by the reference structure coordinates listed in Table 3, is considered "structurally equivalent" to the reference molecule. That is to say, the crystal structures of those portions of the two molecules are substantially identical, within acceptable error. As used herein, "residue" refers to one or more atoms. Particularly preferred structurally equivalent molecules or molecular complexes are those that are defined by the entire set of structure coordinates listed in Table 3+a root mean square deviation from the conserved backbone atoms of those amino acids of less than about 0.45 Å. More preferably, the root mean square deviation is at most about 0.35 Å, and most preferably at most about 0.2 Å.

The term "root mean square deviation" means the square root of the arithmetic mean of the squares of the deviations. It is a way to express the deviation or variation from a trend or object. For purposes of this invention, the "root mean square deviation" defines the variation in the backbone of a protein from the backbone of a CD-NTase polypeptide or a binding pocket portion thereof, as defined by the structure coordinates of the CD-NTase polypeptides described herein.

Likewise, the invention also includes the scalable three-dimensional configuration of points derived from structure coordinates of molecules or molecular complexes that are structurally homologous to CD-NTase, as well as structurally equivalent configurations. Structurally homologous molecules or molecular complexes are defined below. Advantageously, structurally homologous molecules can be identified using the structure coordinates of CD-NTase according to a method of the invention.

Various computational analyses can be used to determine whether a molecule or a binding pocket portion thereof is "structurally equivalent," defined in terms of its three-dimensional structure, to all or part of CD-NTase or its binding pockets. Such analyses may be carried out in current software applications, such as the Molecular Similarity application of QUANTA (Molecular Simulations Inc., San Diego, Calif.) version 4.1, and as described in the accompanying User's Guide.

The Molecular Similarity application permits comparisons between different structures, different conformations of the same structure, and different parts of the same structure. The procedure used in Molecular Similarity to compare structures is divided into four steps: (1) load the structures to be compared; (2) define the atom equivalences in these structures; (3) perform a fitting operation; and (4) analyze the results.

Each structure is identified by a name. One structure is identified as the target (i.e., the fixed structure); all remaining structures are working structures (i.e., moving structures). Since atom equivalency within QUANTA is defined by user input, for the purpose of this invention equivalent atoms are defined as protein backbone atoms (N, Ca, C, and O) for all conserved residues between the two structures being compared. A conserved residue is defined as a residue which is structurally or functionally equivalent. Only rigid fitting operations are considered.

When a rigid fitting method is used, the working structure is translated and rotated to obtain an optimum fit with the target structure. The fitting operation uses an algorithm that computes the optimum translation and rotation to be applied to the moving structure, such that the root mean square difference of the fit over the specified pairs of equivalent atom is an absolute minimum. This number, given in angstroms, is reported by QUANTA.

The configurations of points in space derived from structure coordinates according to the invention can be visualized as, for example, a holographic image, a stereodiagram, a model, or a computer-displayed image, and the invention thus includes such images, diagrams or models.

In one aspect, the invention relates to methods of producing crystals of a CD-Ntase polypeptide. Crystals of the CD-Ntase polypeptide can be produced or grown by a number of techniques including batch crystallization, vapor diffusion (either by sitting drop or hanging drop), soaking, and by microdialysis. Seeding of the crystals in some instances is required to obtain X-ray quality crystals. Standard micro and/or macro seeding of crystals may therefore be used. Preferably, the crystal effectively diffracts X-rays for the determination of the atomic coordinates of the protein-ligand complex to a resolution greater than 5.0 Angstroms, alternatively greater than 3.0 Angstroms, or alternatively greater than 2.0 Angstroms. Exemplified in the Examples section below is the hanging-drop vapor diffusion procedure.

Once a crystal encompassed by the present invention is produced, X-ray diffraction data can be collected. The example below used standard cryogenic conditions for such X-ray diffraction data collection though alternative methods may also be used. For example, diffraction data can be collected by using X-rays produced in a conventional source (such as a sealed tube or rotating anode) or using a synchrotron source. Methods of X-ray data collection include, but are not limited to, precession photography, oscillation photography and diffractometer data collection. Data can be processed using packages including, for example, DENZO and SCALPACK (Z. Otwinowski and W. Minor) and the like.

The three-dimensional structure of the CD-NTase polypeptide constituting the crystal may be determined by conventional means as described herein. Where appropriate, the structure factors from the three-dimensional structure coordinates of a related CD-NTase polypeptide may be utilized to aid the structure determination of the CD-NTase polypeptide. Structure factors are mathematical expressions derived from three-dimensional structure coordinates of a molecule. These mathematical expressions include, for example, amplitude and phase information. The term "structure factors" is known to those of ordinary skill in the art. Alternatively, the three-dimensional structure of the protein-ligand complex may be determined using molecular replacement analysis. This analysis utilizes a known three-dimensional structure as a search model to determine the structure of a closely related protein-ligand complex. The measured X-ray diffraction intensities of the crystal are compared with the computed structure factors of the search model to determine the position and orientation of the CD-NTase polypeptide crystal. Computer programs that can be used in such analyses include, for example, X-PLOR and AmoRe (J. Navaza, *Acta Crystallographics* ASO, 157-163 (1994)). Once the position and orientation are known, an electron density map may be calculated using the search model to provide X-ray phases. The electron density can be inspected for structural differences and the search model may be modified to conform to the new structure. Using this approach, one may use the structure of the CD-NTase polypeptide described herein to solve other CD-NTase polypeptide crystal structures, or other polypeptide crystal structures, particularly where the polypeptide is homologous to CD-NTase. Computer programs that can be used in such analyses include, for example, QUANTA and the like.

VI. Uses of the Structure Coordinates of CD-NTases

The present invention permits the use of molecular design techniques to design, select and synthesize chemical entities and compounds, including agonist and antagonist, capable of binding to CD-NTases and/or modulating CD-NTases.

One approach enabled herein, is to use the structure coordinates of CD-NTases to design compounds that bind to the CD-NTases and alter the physical properties of the compounds in different ways, e.g., solubility. For example, this invention enables the design of compounds that act as inhibitors of the CD-NTase protein by binding to, all or a portion of, the inhibitor packet above the nucleotide donor site in the active enzyme conformation of CD-NTase. In certain embodiments, this invention also enables the design of compounds that act as modulators of CD-NTases by binding to, all or a portion of, residues involved in DNA-binding, nucleotide coordination, and/or overall protein stability.

Another design approach is to probe a crystal of a CD-NTase polypeptide with molecules composed of a variety of different chemical entities to determine optimal sites for interaction between candidate CD-NTase modulators and the enzyme. For example, high resolution X-ray diffraction data collected from crystals saturated with solvent allows the determination of where each type of solvent molecule sticks. Small molecules that bind tightly to those sites can then be designed and synthesized and tested for their effects on modulating activity of the CD-NTase polypeptide (see, e.g., Travis et al. (1993) Science 262:1374).

This invention also enables the development of compounds that can isomerize to short-lived reaction intermediates in the chemical reaction of a substrate or other compound that binds to CD-NTase. Thus, the time-dependent analysis of structural changes in CD-NTase during its interaction with other molecules is enabled. The reaction intermediates of CD-NTase can also be deduced from the reaction product in co-complex with CD-NTase. Such information is useful to design improved analogues of known CD-NTase modulators or to design novel classes of modulators based on the reaction intermediates of the CD-NTase enzyme and CD-NTase-modulator co-complex. This provides a novel route for designing CD-NTase modulators with both high specificity and stability.

Another approach made possible and enabled herein, is to screen computationally small molecule data bases for chemical entities or compounds that can bind in whole, or in part, to the CD-NTase enzyme. In this screening, the quality of fit of such entities or compounds to the binding site may be judged either by shape complementarity or by estimated interaction energy (see, e.g., Meng et al. (1992) J. Camp. Chem. 13:505-524). Because CD-NTase may crystallize in more than one crystal form, the structure coordinates, or portions thereof, as provided herein are particularly useful to solve the structure of those other crystal forms of CD-NTases. They may also be used to solve the structure of CD-NTase mutants, CD-NTase co-complexes, or of the crystalline form of any other protein with significant amino acid sequence homology to any functional domain of CD-NTase.

One method that may be employed for this purpose is molecular replacement. In this method, the unknown crystal structure, whether it is another crystal form of CD-NTase, an CD-NTase mutant, or an CD-NTase co-complex, or the crystal of some other protein with significant amino acid sequence homology to any functional domain of CD-NTase, may be determined using the CD-NTase structure coordinates of this invention as provided in Table 3. This method may provide an accurate structural form for the unknown crystal more quickly and efficiently than attempting to determine such information ab initio.

In addition, in accordance with this invention, CD-NTase mutants may be crystallized in co-complex with known CD-NTase modulators. The crystal structures of a series of such complexes may then be solved by molecular replacement and compared with that of wild-type CD-NTase. Potential sites for modification within the various binding sites of the enzyme may thus be identified. This information may provide an additional tool for determining the most efficient binding interactions, for example, increased hydrophobic interactions, between CD-NTase and a chemical entity or compound.

All of the complexes referred to above may be studied using well-known X-ray diffraction techniques and may be refined versus 2-3A resolution X-ray data to an R value of about 0.20 or less using computer software, such as X-PLOR (Yale University, @1992, distributed by Molecular Simulations, Inc.). See, e.g., Blundel & Johnson, supra; *Methods in Enzymology*, vol. 114 & 115, H. W. Wyckoff et al., eds., Academic Press (1985). This information may thus be used to optimize known classes of CD-NTase modultors, and more importantly, to design and synthesize novel classes of CD-NTase modulators.

The structure coordinates of CD-NTase mutants provided in this invention also facilitate the identification of related proteins or enzymes analogous to CD-NTase in function, structure or both, thereby further leading to novel therapeutic modes for treating or preventing CD-NTase-mediated diseases, such as cancer and autoimmune diseases.

The design of compounds that bind to or modulate CD-NTase according to this invention may involve consideration of two factors. First, the compound may be capable of physically and structurally associating with CD-NTase. Noncovalent molecular interactions important in the association of CD-NTase with its substrate include hydrogen bonding, van der Waals and hydrophobic interactions. Second, the compound may be able to assume a conformation that allows it to associate with CD-NTase. Although certain portions of the compound will not directly participate in this association with CD-NTase, those portions may still influence the overall conformation of the molecule. This, in turn, may have a significant impact on potency. Such conformational requirements include the overall three-dimensional structure and orientation of the chemical entity or compound in relation to all or a portion of the binding site of ICE, or the spacing between functional groups of a compound comprising several chemical entities that directly interact with CD-NTase.

The potential modulatory or binding effect of a chemical compound on CD-NTase may be analyzed prior to its actual synthesis and testing by the use of computer modelling techniques. If the theoretical structure of the given compound indicates insufficient interaction and association between it and CD-NTase, synthesis and testing of the compound may be obviated. However, if computer modelling indicates a strong interaction, the molecule may then be synthesized and tested for its ability to bind to CD-NTase and modulate activity of CD-NTase, e.g., by measuring nucleotide-based second messenger synthesis. In this manner, synthesis of inoperative compounds may be avoided.

A modulatory or other binding compound of CD-NTase may be computationally evaluated and designed by means of a series of steps in which chemical entities or fragments are screened and selected for their ability to associate with the individual binding pockets or other areas of CD-NTase. One skilled in the art may use one of several methods to screen chemical entities or fragments for their ability to associate with CD-NTase and more particularly with the individual binding pockets of the CD-NTase S active site. This process may begin by visual inspection of, for example, the active site on the computer screen based on the coordinates of the CD-NTase polypeptides in Table 3. Selected fragments or chemical entities may then be positioned in a variety of orientations, or docked, within an individual binding pocket of CD-NTase as defined supra. Docking may be accomplished using software such as Quanta and Sybyl, followed by energy minimization and molecular dynamics with standard molecular mechanics forcefields, such as CHARMM and AMBER.

Specialized computer programs may also assist in the process of selecting fragments or chemical entities. For example, these may include:

1. GRID (Goodford, P. J., "A Computational Procedure for Determining Energetically Favorable Binding Sites on Biologically Important Macromolecules", *J. Med. Chem.,* 28, pp. 849-857 (1985)). GRID is available from Oxford University, Oxford, UK.
2. MCSS (Miranker, A and M. Karplus, "Functionality Maps of Binding Sites: A Multiple Copy Simultaneous Search Method." *Proteins: Structure. Function and Genetics,* 11, pp. 29-34 (1991)). MCSS is available from Molecular Simulations, Burlington, Mass.
3. AUTODOCK (Goodsell, D. S. and A J. Olsen, "Automated Docking of Substrates to Proteins by Simulated Annealing", *Proteins: Structure. Function, and Genetics,* 8, pp. 195-202 (1990)). AUTODOCK is available from Scripps Research Institute, La Jolla, Calif.
4. DOCK (Kuntz, I. D. et al., "A Geometric Approach to Macromolecule-Ligand Interactions", *J. Mol. Biol.,* 161, pp. 269-288 (1982)). DOCK is available from University of California, San Francisco, Calif.

Once suitable chemical entities or fragments have been selected, they can be assembled into a single compound or inhibitor. Assembly may be proceed by visual inspection of the relationship of the fragments to each other on the three-dimensional image displayed on a computer screen in relation to the structure coordinates of the CD-NTase polypeptides. This would be followed by manual model building using software such as Quanta or Sybyl.

For example, useful programs to aid one of skill in the art in connecting the individual chemical entities or fragments may include:

1. CAVEAT (Bartlett, P. A et al, "CAVEAT: A Program to Facilitate the Structure-Derived Design of Biologically Active Molecules". In "*Molecular Recognition in Chemical and Biological Problems*", Special Pub., *Royal Chern. Soc.,* 78, pp. 182-196 (1989)). CAVEAT is available from the University of California, Berkeley, Calif.
2. 3D Database systems such as MACCS-3D (MDL Information Systems, San Leandro, Calif.). This area is reviewed in Martin, Y. C., "3D Database Searching in Drug Design", *J. Med. Chern.,* 35, pp. 2145-2154 (1992)).
3. HOOK (available from Molecular Simulations, Burlington, Mass.).

Instead of proceeding to build a CD-NTase modulator in a step-wise fashion one fragment or chemical entity at a time as described above, modulatory or other CD-NTase binding compounds may be designed as a whole or "de novo" using either an empty active site or optionally including some portion(s) of a known modulator(s). For example, these methods may include:

1. LUDI (Bohm, H.-J., "The Computer Program LUDI: A New Method for the De Novo Design of Enzyme Inhibitors", *J. Camp. Aid. Malec. Design,* 6, pp. 61-78 (1992)). LUDI is available from Biosym Technologies, San Diego, Calif.
2. LEGEND (Nishibata, Y. and A Itai, *Tetrahedron,* 47, p. 8985 (1991)). LEGEND is available from Molecular Simulations, Burlington, Mass.
3. LeapFrog (available from Tripos Associates, St. Louis, Mo.).

Other molecular modelling techniques may also be employed in accordance with this invention. See, e.g., Cohen, N. C. et al., "Molecular Modeling Software and Methods for Medicinal Chemistry", J. Med. Chem., 33, pp. 883-894 (1990). See also, Navia, M. A and M. A Murcko, "The Use of Structural Information in Drug Design", *Current Opinions in Structural Biology,* 2, pp. 202-210 (1992).

Once a compound has been designed or selected by the above methods, the efficiency with which that compound may bind to CD-NTase may be tested and optimized by computational evaluation. For example, a compound that has been designed or selected to function as a CD-NTase-modulator may also preferably traverse a volume not overlapping that occupied by the active site when it is bound to the native substrate. An effective CD-NTase modulator may preferably demonstrate a relatively small difference in energy between its bound and free states (i.e., a small deformation energy of binding). Thus, the most efficient CD-NTase modulators may preferably be designed with a deformation energy of binding of not greater than about 10 kcal/mole, preferably, not greater than 7 kcal/mole. CD-NTase modulators may interact with the enzyme in more than one conformation that is similar in overall binding energy. In those cases, the deformation energy of binding is taken to be the difference between the energy of the free compound and the average energy of the conformations observed when the modulator binds to the enzyme.

A compound designed or selected as binding to CD-NTase may be further computationally optimized so that in its bound state it would preferably lack repulsive electrostatic interaction with the target enzyme. Such non-complementary (e.g., electrostatic) interactions include repulsive charge-charge, dipole-dipole and charge-dipole interactions. Specifically, the sum of all electrostatic interactions between the modulator and the enzyme when the modulator is bound to CD-NTase, preferably make a neutral or favorable contribution to the enthalpy of binding.

Specific computer software is available in the art to evaluate compound deformation energy and electrostatic interaction. Examples of programs designed for such uses may include: Gaussian 92, revision C (M. J. Frisch, Gaussian, Inc., Pittsburgh, Pa. @1992); AMBER, version 4.0 (P. A Kollman, University of California at San Francisco, @1994); QUANTA/CHARMM (Molecular Simulations, Inc., Burlington, Mass. @1994); and Insight 11/Discover (Biosysm Technologies Inc., San Diego, Calif. @1994). These programs may be implemented, for instance, using a Silicon Graphics workstation, IRIS 4D/35 or IBM RISC/6000 workstation model 550. Other hardware systems and software packages will be known to those skilled in the art.

Once an CD-NTase-binding compound has been optimally selected or designed, as described above, substitutions may then be made in some of its atoms or side groups in order to improve or modify its binding properties. Generally, initial substitutions are conservative, i.e., the replacement group will have approximately the same size, shape, hydrophobicity and charge as the original group. It should, of course, be understood that components known in the art to alter conformation should be avoided. Such substituted chemical compounds may then be analyzed for efficiency of fit to CD-NTase by the same computer methods described in detail, above.

The present invention also enables mutants of ICE and the solving of their crystal structure. More particularly, by virtue encompassed by the present invention, the location of the active site and interface of CD-NTase based on its crystal structure permits the identification of desirable sites for mutation.

For example, mutation may be directed to a particular site or combination of sites of wild-type CD-NTase, i.e., the active site, or a location on the interface site may be chosen for mutagenesis. Similarly, only a location on, at or near the enzyme surface may be replaced, resulting in an altered surface charge of one or more charge units, as compared to the wild-type enzyme. Alternatively, an amino acid residue in CD-NTase may be chosen for replacement based on its hydrophilic or hydrophobic characteristics.

Such mutants may be characterized by any one of several different properties as compared with wild-type CD-NTase. For example, such mutants may have altered surface charge of one or more charge units, or have an increased stability to component dissociation. Or such mutants may have an altered substrate specificity in comparison with, or a higher specific activity than, wild-type CD-NTase.

The mutants of CD-NTase prepared herein may be prepared in a number of ways as discussed above. Once the CD-NTase mutants have been generated in the desired location, i.e., active site or DNA binding interface, the mutants may be tested for any one of several properties of interest. For example, one or more of the following activities may be tested: a) nucleotide-based second messenger synthesis; b) enzyme kinetics; c) nucleotide coordination; d) protein stability; e) interactions with the ligand; f) enzyme conformation; g) STING pathway regulation and h) RECON pathway regulation.

VII. Pharmaceutical Compositions

In another aspect, the present invention provides pharmaceutically acceptable compositions which comprise a modified CD-NTase polypeptide comprising an amino acid sequence that has at least 70% identity to any one of the amino acid sequences listed in Table 1 and further comprising a nucleotidyltransferase protein fold and an active site described herein, formulated together with one or more pharmaceutically acceptable carriers (additives) and/or diluents.

As described in detail below, the pharmaceutical compositions encompassed by the present invention may be specially formulated for administration in solid or liquid form, including those adapted for the following: (1) oral administration, for example, drenches (aqueous or non-aqueous solutions or suspensions), tablets, boluses, powders, granules, pastes; (2) parenteral administration, for example, by subcutaneous, intramuscular or intravenous injection as, for example, a sterile solution or suspension; (3) topical application, for example, as a cream, ointment or spray applied to the skin; (4) intravaginally or intrarectally, for example, as a pessary, cream or foam; or (5) aerosol, for example, as an aqueous aerosol, liposomal preparation or solid particles containing the compound.

The phrase "therapeutically-effective amount" as used herein means that amount of an agent that modulates (e.g., inhibits or enhances) expression and/or activity of the modified CD-NTase which is effective for producing some desired therapeutic effect, e.g., cancer treatment, at a reasonable benefit/risk ratio.

The phrase "pharmaceutically acceptable" is employed herein to refer to those agents, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition or vehicle, such as a liquid or solid filler, diluent, excipient, solvent or encapsulating material, involved in carrying or transporting the subject chemical from one organ, or portion of the body, to another organ, or portion of the body. Each carrier must be "acceptable" in the sense of being compatible with the other ingredients of the formulation and not injurious to the subject. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) phosphate buffer solutions; and (21) other non-toxic compatible substances employed in pharmaceutical formulations.

The term "pharmaceutically-acceptable salts" refers to the relatively non-toxic, inorganic and organic acid addition salts of the agents that modulates (e.g., enhances or inhibits) modified CD-NTase polypeptide expression and/or activity. These salts can be prepared in situ during the final isolation and purification of the respiration uncoupling agents, or by separately reacting a purified respiration uncoupling agent in its free base form with a suitable organic or inorganic acid, and isolating the salt thus formed. Representative salts include the hydrobromide, hydrochloride, sulfate, bisulfate, phosphate, nitrate, acetate, valerate, oleate, palmitate, stearate, laurate, benzoate, lactate, phosphate, tosylate, citrate, maleate, fumarate, succinate, tartrate, napthylate, mesylate, glucoheptonate, lactobionate, and laurylsulphonate salts and the like (See, for example, Berge et al. (1977) "Pharmaceutical Salts", J. Pharm. Sci. 66:1-19).

In other cases, the agents useful in the methods encompassed by the present invention may contain one or more acidic functional groups and, thus, are capable of forming pharmaceutically-acceptable salts with pharmaceutically-acceptable bases. The term "pharmaceutically-acceptable salts" in these instances refers to the relatively non-toxic, inorganic and organic base addition salts of a modified CD-NTase polypeptide encompassed by the present invention. These salts can likewise be prepared in situ during the final isolation and purification of the respiration uncoupling agents, or by separately reacting the purified respiration uncoupling agent in its free acid form with a suitable base, such as the hydroxide, carbonate or bicarbonate of a pharmaceutically-acceptable metal cation, with ammonia, or with a pharmaceutically-acceptable organic primary, secondary or tertiary amine. Representative alkali or alkaline earth salts include the lithium, sodium, potassium, calcium, magnesium, and aluminum salts and the like. Representative organic amines useful for the formation of base addition salts include ethylamine, diethylamine, ethylenediamine, ethanolamine, diethanolamine, piperazine and the like (see, for example, Berge et al., supra).

Wetting agents, emulsifiers and lubricants, such as sodium lauryl sulfate and magnesium stearate, as well as coloring agents, release agents, coating agents, sweetening, flavoring and perfuming agents, preservatives and antioxidants can also be present in the compositions.

Examples of pharmaceutically-acceptable antioxidants include: (1) water soluble antioxidants, such as ascorbic acid, cysteine hydrochloride, sodium bisulfate, sodium metabisulfite, sodium sulfite and the like; (2) oil-soluble antioxidants, such as ascorbyl palmitate, butylated hydroxyanisole (BHA), butylated hydroxytoluene (BHT), lecithin, propyl gallate, alpha-tocopherol, and the like; and (3) metal chelating agents, such as citric acid, ethylenediamine tetraacetic acid (EDTA), sorbitol, tartaric acid, phosphoric acid, and the like.

Formulations useful in the methods encompassed by the present invention include those suitable for oral, nasal, topical (including buccal and sublingual), rectal, vaginal, aerosol and/or parenteral administration. The formulations may conveniently be presented in unit dosage form and may be prepared by any methods well-known in the art of pharmacy. The amount of active ingredient which can be combined with a carrier material to produce a single dosage form will vary depending upon the host being treated, the particular mode of administration. The amount of active ingredient, which can be combined with a carrier material to produce a single dosage form will generally be that amount of the compound which produces a therapeutic effect. Generally, out of one hundred percent, this amount will range from about 1 percent to about ninety-nine percent of active ingredient, preferably from about 5 percent to about 70 percent, most preferably from about 10 percent to about 30 percent.

Methods of preparing these formulations or compositions include the step of bringing into association a modified CD-NTase polypeptide encompassed by the present invention, with the carrier and, optionally, one or more accessory ingredients. In general, the formulations are prepared by uniformly and intimately bringing into association a respiration uncoupling agent with liquid carriers, or finely divided solid carriers, or both, and then, if necessary, shaping the product.

Formulations suitable for oral administration may be in the form of capsules, cachets, pills, tablets, lozenges (using a flavored basis, usually sucrose and acacia or tragacanth), powders, granules, or as a solution or a suspension in an aqueous or non-aqueous liquid, or as an oil-in-water or water-in-oil liquid emulsion, or as an elixir or syrup, or as pastilles (using an inert base, such as gelatin and glycerin, or sucrose and acacia) and/or as mouth washes and the like, each containing a predetermined amount of a respiration uncoupling agent as an active ingredient. A compound may also be administered as a bolus, electuary or paste.

In solid dosage forms for oral administration (capsules, tablets, pills, dragees, powders, granules and the like), the active ingredient is mixed with one or more pharmaceutically-acceptable carriers, such as sodium citrate or dicalcium phosphate, and/or any of the following: (1) fillers or extenders, such as starches, lactose, sucrose, glucose, mannitol, and/or silicic acid; (2) binders, such as, for example, carboxymethylcellulose, alginates, gelatin, polyvinyl pyrrolidone, sucrose and/or acacia; (3) humectants, such as glycerol; (4) disintegrating agents, such as agar-agar, calcium carbonate, potato or tapioca starch, alginic acid, certain silicates, and sodium carbonate; (5) solution retarding agents, such as paraffin; (6) absorption accelerators, such as quaternary ammonium compounds; (7) wetting agents, such as, for example, acetyl alcohol and glycerol monostearate; (8) absorbents, such as kaolin and bentonite clay; (9) lubricants, such a talc, calcium stearate, magnesium stearate, solid polyethylene glycols, sodium lauryl sulfate, and mixtures thereof; and (10) coloring agents. In the case of capsules, tablets and pills, the pharmaceutical compositions may also comprise buffering agents. Solid compositions of a similar type may also be employed as fillers in soft and hard-filled gelatin capsules using such excipients as lactose or milk sugars, as well as high molecular weight polyethylene glycols and the like.

A tablet may be made by compression or molding, optionally with one or more accessory ingredients. Compressed tablets may be prepared using binder (for example, gelatin or hydroxypropylmethyl cellulose), lubricant, inert diluent, preservative, disintegrant (for example, sodium starch glycolate or cross-linked sodium carboxymethyl cellulose), surface-active or dispersing agent. Molded tablets may be made by molding in a suitable machine a mixture of the powdered peptide or peptidomimetic moistened with an inert liquid diluent.

Tablets, and other solid dosage forms, such as dragees, capsules, pills and granules, may optionally be scored or prepared with coatings and shells, such as enteric coatings and other coatings well-known in the pharmaceutical-formulating art. They may also be formulated so as to provide slow or controlled release of the active ingredient therein using, for example, hydroxypropylmethyl cellulose in varying proportions to provide the desired release profile, other polymer matrices, liposomes and/or microspheres. They may be sterilized by, for example, filtration through a bacteria-retaining filter, or by incorporating sterilizing agents in the form of sterile solid compositions, which can be dissolved in sterile water, or some other sterile injectable medium immediately before use. These compositions may also optionally contain opacifying agents and may be of a composition that they release the active ingredient(s) only, or preferentially, in a certain portion of the gastrointestinal tract, optionally, in a delayed manner. Examples of embedding compositions, which can be used include polymeric substances and waxes. The active ingredient can also be in micro-encapsulated form, if appropriate, with one or more of the above-described excipients.

Liquid dosage forms for oral administration include pharmaceutically acceptable emulsions, microemulsions, solutions, suspensions, syrups and elixirs. In addition to the active ingredient, the liquid dosage forms may contain inert diluents commonly used in the art, such as, for example, water or other solvents, solubilizing agents and emulsifiers, such as ethyl alcohol, isopropyl alcohol, ethyl carbonate, ethyl acetate, benzyl alcohol, benzyl benzoate, propylene glycol, 1,3-butylene glycol, oils (in particular, cottonseed, groundnut, corn, germ, olive, castor and sesame oils), glycerol, tetrahydrofuryl alcohol, polyethylene glycols and fatty acid esters of sorbitan, and mixtures thereof.

Besides inert diluents, the oral compositions can also include adjuvants such as wetting agents, emulsifying and suspending agents, sweetening, flavoring, coloring, perfuming and preservative agents.

Suspensions, in addition to the active agent may contain suspending agents as, for example, ethoxylated isostearyl alcohols, polyoxyethylene sorbitol and sorbitan esters, microcrystalline cellulose, aluminum metahydroxide, bentonite, agar-agar and tragacanth, and mixtures thereof.

Formulations for rectal or vaginal administration may be presented as a suppository, which may be prepared by mixing one or more respiration uncoupling agents with one or more suitable nonirritating excipients or carriers comprising, for example, cocoa butter, polyethylene glycol, a suppository wax or a salicylate, and which is solid at room temperature, but liquid at body temperature and, therefore, will melt in the rectum or vaginal cavity and release the active agent.

Formulations which are suitable for vaginal administration also include pessaries, tampons, creams, gels, pastes, foams or spray formulations containing such carriers as are known in the art to be appropriate.

Dosage forms for the topical or transdermal administration of a modified CD-NTase polypeptide encompassed by the present invention include powders, sprays, ointments, pastes, creams, lotions, gels, solutions, patches and inhalants. The active component may be mixed under sterile conditions with a pharmaceutically-acceptable carrier, and with any preservatives, buffers, or propellants which may be required.

The ointments, pastes, creams and gels may contain, in addition to a respiration uncoupling agent, excipients, such as animal and vegetable fats, oils, waxes, paraffins, starch, tragacanth, cellulose derivatives, polyethylene glycols, silicones, bentonites, silicic acid, talc and zinc oxide, or mixtures thereof.

Powders and sprays can contain, in addition to a modified CD-NTase polypeptide, excipients such as lactose, talc, silicic acid, aluminum hydroxide, calcium silicates and polyamide powder, or mixtures of these substances. Sprays can additionally contain customary propellants, such as chlorofluorohydrocarbons and volatile unsubstituted hydrocarbons, such as butane and propane.

The modified CD-NTase polypeptide, can be alternatively administered by aerosol. This is accomplished by preparing an aqueous aerosol, liposomal preparation or solid particles containing the compound. A nonaqueous (e.g., fluorocarbon propellant) suspension could be used. Sonic nebulizers are preferred because they minimize exposing the agent to shear, which can result in degradation of the compound.

Ordinarily, an aqueous aerosol is made by formulating an aqueous solution or suspension of the agent together with conventional pharmaceutically acceptable carriers and stabilizers. The carriers and stabilizers vary with the requirements of the particular compound, but typically include nonionic surfactants (Tweens, Pluronics, or polyethylene glycol), innocuous proteins like serum albumin, sorbitan esters, oleic acid, lecithin, amino acids such as glycine, buffers, salts, sugars or sugar alcohols. Aerosols generally are prepared from isotonic solutions.

Transdermal patches have the added advantage of providing controlled delivery of a respiration uncoupling agent to the body. Such dosage forms can be made by dissolving or dispersing the agent in the proper medium. Absorption enhancers can also be used to increase the flux of the peptidomimetic across the skin. The rate of such flux can be controlled by either providing a rate controlling membrane or dispersing the peptidomimetic in a polymer matrix or gel.

Ophthalmic formulations, eye ointments, powders, solutions and the like, are also contemplated as being within the scope of this invention.

Pharmaceutical compositions of this invention suitable for parenteral administration comprise one or more respiration uncoupling agents in combination with one or more pharmaceutically-acceptable sterile isotonic aqueous or nonaqueous solutions, dispersions, suspensions or emulsions, or sterile powders which may be reconstituted into sterile injectable solutions or dispersions just prior to use, which may contain antioxidants, buffers, bacteriostats, solutes which render the formulation isotonic with the blood of the intended recipient or suspending or thickening agents.

Examples of suitable aqueous and nonaqueous carriers which may be employed in the pharmaceutical compositions of the invention include water, ethanol, polyols (such as glycerol, propylene glycol, polyethylene glycol, and the like), and suitable mixtures thereof, vegetable oils, such as olive oil, and injectable organic esters, such as ethyl oleate. Proper fluidity can be maintained, for example, by the use of coating materials, such as lecithin, by the maintenance of the required particle size in the case of dispersions, and by the use of surfactants.

These compositions may also contain adjuvants such as preservatives, wetting agents, emulsifying agents and dispersing agents. Prevention of the action of microorganisms may be ensured by the inclusion of various antibacterial and antifungal agents, for example, paraben, chlorobutanol, phenol sorbic acid, and the like. It may also be desirable to include isotonic agents, such as sugars, sodium chloride, and the like into the compositions. In addition, prolonged absorption of the injectable pharmaceutical form may be brought about by the inclusion of agents which delay absorption such as aluminum monostearate and gelatin.

In some cases, in order to prolong the effect of a drug, it is desirable to slow the absorption of the drug from subcutaneous or intramuscular injection. This may be accomplished by the use of a liquid suspension of crystalline or amorphous material having poor water solubility. The rate of absorption of the drug then depends upon its rate of dissolution, which, in turn, may depend upon crystal size and crystalline form. Alternatively, delayed absorption of a parenterally-administered drug form is accomplished by dissolving or suspending the drug in an oil vehicle.

Injectable depot forms are made by forming microencapsule matrices of a modified CD-NTase polypeptide, in biodegradable polymers such as polylactide-polyglycolide. Depending on the ratio of drug to polymer, and the nature of the particular polymer employed, the rate of drug release can be controlled. Examples of other biodegradable polymers include poly(orthoesters) and poly(anhydrides). Depot injectable formulations are also prepared by entrapping the drug in liposomes or microemulsions, which are compatible with body tissue.

When the respiration uncoupling agents encompassed by the present invention are administered as pharmaceuticals, to humans and animals, they can be given per se or as a pharmaceutical composition containing, for example, 0.1 to 99.5% (more preferably, 0.5 to 90%) of active ingredient in combination with a pharmaceutically acceptable carrier.

Actual dosage levels of the active ingredients in the pharmaceutical compositions of this invention may be determined by the methods encompassed by the present invention so as to obtain an amount of the active ingredient, which is effective to achieve the desired therapeutic response for a particular subject, composition, and mode of administration, without being toxic to the subject.

The nucleic acid molecules of the invention can be inserted into vectors and used as gene therapy vectors. Gene therapy vectors can be delivered to a subject by, for example, intravenous injection, local administration (see U.S. Pat. No. 5,328,470) or by stereotactic injection (see e.g., Chen et al. (1994) *Proc. Natl. Acad. Sci. USA* 91:3054 3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

This invention is further illustrated by the following examples which should not be construed as limiting. The contents of all references, patents and published patent applications cited throughout this application, as well as the Figures, are incorporated herein by reference.

EXAMPLES

Example 1: Materials and Methods for Examples 2-6

A. Bacterial Strains and Growth Conditions

*E. coli* was cultivated at 37° C., shaking, in LB medium (1% tryptone, 0.5% yeast extract, 0.5% NaCl w/v), and stored in LB plus 30% glycerol at −80° C. unless otherwise indicated. When appropriate, carbenicillin (100 μg/ml), ampicillin (100 μg/ml), and chloramphenicol (34 μg/ml) were used. BL21 *E. coli* (strain CodonPlus™ (DE3)-RIL transformed with pRARE2, Agilent) was used for all protein expression and DH10β *E. coli* (strain Top10, Invitrogen) was used for cloning and plasmid propagation. For repression of protein expression from pET vectors, BL21 *E. coli* was cultivated in MDG medium (0.5% glucose, 25 mM $Na_2HPO_4$, 25 mM $KH2P_04$, 50 mM NH4Cl, 5 mM $Na_2SO_4$, 2 mM $MgSO_4$, 0.25% aspartic acid, and trace metals) with ampicillin and chloramphenicol. For optimum protein expression from pET vectors, BL21 *E. coli* was cultivated in M9ZB medium (0.5% glycerol, 1% Cas-Amino Acids, 47.8 mM $Na_2HPO_4$, 22 mM $KH_2PO_4$, 18.7 mM $NH_4Cl$, 85.6 mM NaCl, 2 mM $MgSO_4$, and trace metals) with ampicillin and chloramphenicol (Studier et al. (2005) Protein Expr. and Purif. 41:207-234).

b. Cloning and Plasmid Construction

Cloning and plasmid construction were performed as previously described (Studier et al. (2005) *Protein Expr and Purif* 41:207-234). Briefly, for vectors constructed in this study, genes were either amplified from genomic DNA or synthesized as gBLOCKs (Integrated DNA Technologies) with ≥18 base pairs of homology flanking the insert sequence and ligated into BamHI/NotI linearized vector by Gibson assembly®. Reactions were transformed into electrocompetent DH10β and selected with carbenicillin plates. Sanger sequencing confirmed each vector was free of mutations within the multiple cloning site. N-terminal 6xHis-MBP tag and 6×His-SUMO2 tag fusions were constructed using custom pET16MBP27 or pETSUMO228, respectively. CD-NTases and their effector coding sequences were codon optimized for bacterial expression (Integrated DNA Technologies) with the exception of ECOR31 and *Vibrio cholerae* derived sequences. Synthases were overexpressed in mammalian cells from pcDNA4 plasmids, previously described (Kranzusch et al. (2015) *Mol Cell* 59:891-903). For expression of MBP N-terminally tagged dncV and cdnE in mammalian cells, MBP and the fused CD-NTase were codon optimized for expression in human cells. For coexpression with their putative effector genes, N-terminal MBP-tagged CD-NTases were cloned into pBAD33 (Guzman et al. (1995) *J. Bacteriol.* 177:4121-4130) modified with a ribosomal binding site and oriT for conjugation. For cloned CD-NTase details see Table 4A and for cloned CD-NTase effector details see Table 5.

c. Recombinant Protein Purification

Proteins were purified as previously described (Zhou et al. (2018) *Cell* 174: P300-311). Briefly, chemically competent BL21 *E. coli* was transformed with a protein expression plasmid, recovered on MDG plates overnight, cultivated as a 30 mL starter culture in MDG liquid medium overnight, and was used to seed an M9ZB culture at ~1:1000. 25 mL-4 L M9ZB cultures were cultivated for ~4 h until OD was 2-3.5 at which time IPTG was added at 0.5 mM and cultures were shifted to 16° C. overnight. Harvested *E. coli* was washed in 1×PBS, stored as a flash-frozen pellet at −80° C. or immediately disrupted by sonication in lysis buffer (20 mM HEPES-KOH PH 7.5, 400 mM NaCl, 30 mM imidazole, 10% glycerol, 1 mM DTT). Lysates were clarified by centrifugation, filtered through glass wool, and proteins were purified by affinity chromatography using Ni-NTA (Qiagen) resin and a gravity column. Resin was washed (lysis buffer made with 1 M NaCl), eluted (lysis buffer+300 mM imidizole), and the eluate was dialyzed overnight at 4° C. (20 mM HEPES-KOH PH 7.5, 300 mM NaCl, 1 mM DTT). For SUMO fusion proteins, dialysis was supplemented with ~250 μg of human SENP2 protease (D364-L589, M497A). Small-scale preparations of proteins were flash-frozen at this stage and stored at −80° C. in storage buffer (10% glycerol, 20 mM HEPES-KOH PH 7.5, 250 mM KCl, 1 mM TCEP). Where appropriate, proteins were filter-concentrated using centrifugation through 10 kDa or 30 kDa cut-off column (Millipore Sigma).

For large-scale protein preps (cGAS, DncV, DisA, CdnE, Rm-CdnE, Em-CdnE, STING, RECON, Lp-CdnE02, Ec-CdnD02, CyaA), size exclusion chromatography followed by concentration was performed in storage buffer without glycerol. Initial CD-NTase proteins were purified and screened as N-terminal MBP fusions as they stabilized proteins and increased protein expression levels in *E. coli*. Although a TEV site and linker separated the fused protein of interest, these proteins were used undigested. Proteins were either freshly thawed from −80° C. stocks and immediately used, or maintained at −20° C. in a storage buffer with 50% total glycerol. It was found that glycerol stocks of second messenger synthases at −20° C. retain >90% activity for at least 6 months and were appropriate for biochemical assays. Additional protein details are found in Table 2.1.

TABLE 2.1

Additional protein details

| Protein (Protein Fusion) | Gene | Organisms | Notes | Reference |
|---|---|---|---|---|
| cGAS (HIS-SUMO) | MB21D1, CGAS | *Homo sapiens* | | 1 |
| DncV (HIS-SUMO) | dncV | *Vibrio cholerae* | | 2 |
| DisA (HIS-SUMO) | disA | *Bacillus thuringiensis* | | This study |
| WspR D70E aka WspR* (HIS) | wspR* | *Pseudomonas aeruginosa* | | 3 |
| CdnE (His-MBF) | cdnE | *E. coli* | | This study |
| CdnE N174S (His-MBP) | cdnE | *E. coli* | | This study |
| Rm-CdnE (C-6xHIS) | cdnE $R_m$ (codon optimized) | *Rhodothermus marines* | | This study |
| Em-CdnE (HIS-SUMO) | cdnE $E_m$ (codon optimized) | *Elizabethkingia meningoseptica* | For crystallography | This study |
| Em-CdnE (HIS-MBP) | cdnE $E_m$ (codon optimized) | *Elizabethkingia meningoseptica* | For biochemistry | This study |
| Em-CdnE S169N (HIS-MBP) | cdnE $E_m$ (codan optimized) | *Elizabethkingia meningoseptica* | | This study |
| mSTING (SUMO-mSTING) | TMEM173 | *Mus musculus* | | 4 |
| RECON (SUMO-RECON) | Akr1c13 | *Mus muscus* | | This study |
| Lp-CdnE02 (His-MBP) | cdnE02 $L_p$ (codon optimized) | *Legionella pneumophila* | | This study |
| Ec-CdnD02 (His-MBP) | cdnD02 $E_c$ (codon optimized) | *Enterobacter cloacae* | | This study |
| CyaA (HIS-SUMO) | cyaA | *E. coli* | | This study |

References

1 Kranzusch, P.J. et al. A. Structure of human cGAS reveals a conserved family of second-messenger enzymes in innate immunity. Cell Reports 3, 1363-1368 (2013)
2 Kranzusch, P.J. et al. Structure-Guided Reprogramming of Human cGAS Dinucleotide Linkage Specificity, Cell 158, 1011-1021 (2014).
3 Burdette, D.L. et al. STING is a direct innate immune sensor of cyclic di-GMP. Nature 472, 515-518 (2011).
4 Kranzusch, P.J. et al. Ancient Origin of cGAS-STING Reveals Mechanism of Universal 2',3' cGAMP Signaling. Molecular Cell 59, 891-903 (2015).

D. Biochemistry and Second Messenger Synthesis Assays

Recombinant, candidate nucleotidyltransferase reactions combined 4 μL of 5× reaction buffer (250 mM CAPSO pH 9.4, 175 mM KCl, 25 mM Mg (OAc) 2, 5 mM DTT), 2 μL of 10× NTPs, 1 uL [α-$^{32}$P] NTPs (~1 uCi), 1 μL of candidate enzyme in storage buffer (~20 μM), and a remaining volume of nuclease free water. The final reactions (50 mM CAPSO pH 9.4, 50 mM KCl, 5 mM Mg (OAc) 2, 1 mM DTT, ≤5% glycerol, 25-250 μM individual NTPs, trace amounts of [(-$^{32}$P] NTP, 1 μM enzyme) were started with addition of enzyme. Where indicated, pH was altered by replacing CAPSO buffer with appropriate buffer from "StockOptions pH Buffer Kit" (Hampton Research). When appropriate, $Mg^{2+}$ was replaced with an equimolar concentration of $Mn^{2+}$($MnCl_2$). cGAS reactions were always carried out with Tris at pH 7.5 and supplemented with 1 μM ISD45 dsDNA (Stetson & Medzhitov. (2006) Immunity 24:93-103). Reactions were carried out with 25 μM of each indicated NTP for FIGS. 1B, 3D, 8B, 8C, and 8D and for FIGS. 2C, 2G-2I, 5B, 5C, 10A-10D, 11A, 11B, and 13D. Reactions in all other figures were carried out with 250 μM NTP. The NTP/[α-$^{32}$P] NTPs in FIG. 1B are cGAS (ATP, GTP/[α-$^{32}$P] GTP), DncV (ATP, GTP/[α-$^{32}$P] ATP), DisA (ATP/[α-$^{32}$P] ATP), WspR (GTP/[xx-$^{32}$P] GTP), and CdnE (NTP/[{-$^{32}$P] NTP). P1 nuclease treated reactions in FIG. 1C and FIG. 11B are cGAS (ATP, GTP/[α-$^{32}$P] ATP), DncV (ATP, GTP/[α-$^{32}$P] GTP), CdnE (ATP, UTP/[<- $^{32}$P] ATP), and Lp-CdnE02 (CTP, UTP/ [α-$^{32}$P] UTP) . Where indicated, nonhydrolyzable nucleotides [Ap (c) pp, Gp (c) pp, Cp (c) pp, or Up (n) pp (Jena)] were used at 25 μM.

Reactions were incubated for 2 h at 37° C. prior to analysis unless otherwise stated. Reactions were stopped by addition of 5 U of alkaline phosphatase (New England Biolabs) which removed triphosphates on remaining NTPs and converted the remaining nucleotide [α-$^{32}$P] to $^{32}$Pi and allowed visualization of cyclic nucleotides. After a >20 min incubation, 0.5 L (PEI-cellulose) or 1 uL (silica) of the reaction was spotted 1.5 cm from the bottom of the TLC plate, spaced 0.8 cm apart. 20 cm×20 cm F-coated PEI-cellulose TLCs (Millipore) were developed in 1.5 M $KH_2PO_4$ (pH 3.8) until the buffer front reacted ~1 cm from the top; 20 cm×10 cm F-coated silica HP-TLC plates (Millipore) were developed in 11:7:2 1-propanol: $NH_4OH$: $H_2O$ in a chemical fume hood for 1 hour. Plates were dried and exposed to phosphorscreen prior to detection by Typhoon™ Trio Variable Mode Imager system (GE Healthcare). All TLC data are representative of ≥3 independent experiments, with the exception of the biochemical screen which represents ≥2 independent experiments.

E. Nucleotide Synthesis and Purification for Mass Spectrometry

Cyclic nucleotides were produced in large scale using previously described methods (Sureka et al. (2014) *Cell* 158:1389-1401) with the following changes. Small-scale second messenger synthesis assays were scaled up to $10^{-40}$ mL reactions with final conditions of 50 mM CAPSO pH 9.4, 12.5-50 mM KCl, 5-20 mM Mg (OAc) 2, 1 mM DTT, ≤5% glycerol, 250 μM individual NTPs, and 1 μM enzyme. A 20 μL aliquot of the larger reaction was removed and [cx-$^{32}$P] NTP were added to follow reaction progress. Reactions were incubated for 24 hours at which time 5 U of CIP/mL of reaction was added and the reaction was further incubated for 2-24 hours. Reactions were heat inactivated at 65° C. for 30 min, diluted to a final salt concentration of 12.5 mM, and purified by anion exchange chromatography and FPLC (either 1 mL Q-Sepharose® column,, or Mono Q 4.6/100 PE, GE Healthcare). The column was washed with water and 1 mL fractions were collected during a gradient elution with 2M ammonium acetate. Fractions harboring the appropriate product were identified by $A_{260}$ and silica TLC, visualizing the nucleotide products by UV-shadowing, imaging using a handheld camera, and comparing migration to paired, radiolabeled reactions. Selected fractions were concentrated by evaporation and re-suspended in 30 μL of nuclease free water for MS. For NMR nucleotides were further purified using size chromatography (Superdex™ 30 Increase 10/300 GL, GE Healthcare). The column was washed with water and 1 mL fractions were collected, identified by $A_{260}$, pooled, and evaporated. Concentrations of purified nucleotides were estimated from $A_{260}$ using the estimated extinction coefficients based on RNA oligonucleotides: cUMP-AMP ε=22,800 L mole$^{-1}$ cm$^{-1}$, cAAG 8=37, 000 L mole$^{-1}$ cm$^{-1}$.

The ESI-LC/MS analysis was performed using an Agilent 6530 QTOF mass spectrometer coupled to a 1290 infinity binary LC system operating the electrospray source in positive ionization mode. All samples were chromatographed on an Agilent ZORBAX Bonus-RP $C_{18}$ column (4.6×150 mm; 3.5 um particle size) at 50° C. column temperature. The solvent system consisted of 10 mM ammonium acetate (A) and methanol (B). The HPLC gradient with a flow rate of 1 ml/min starts at 5% B, holds for 2 min and then increases over 12 min to 100% B. Identification of CDNs and cAAG was performed by targeted mass analysis for exact masses and formulae for all possible CDNs and cAAG using Profinder software (Agilent).

f. Crystallization and Structure Determination

CdnE homologs were crystallized in apo form or in complex with nucleotide substrates at 18° C. using hanging drop vapor diffusion. Purified Rm-CdnE and Em-CdnE were diluted on ice to 7-10 mg/ml and used immediately to set trays. Alternatively, co-complex crystals were grown by first incubating Rm-CdnE and Em-CdnE in the presence of ~10 mM total combined nucleotide concentration and 10.5 mM MgCl2 on ice for 30 min.

Following incubation, 2 μl hanging drops were set at a ratio of 1:1 or 1.2:0.8 (protein: reservoir) over 350 μl of reservoir in Easy-Xtal 15-Well trays (Qiagen). Optimized crystallization conditions were as follows: Apo Rm-CdnE $10^{-20}$% ethanol, 100 mM Tris-HCl pH 7.5; Rm-CdnE-Apcpp-Upnpp 24% PEG-3350, 0.24 M sodium malonate; Apo Em-CdnE 16% PEG-5000 MME, 21 mM sodium citrate pH 7.0, 100 mM HEPES-KOH pH 7.5; Em-CdnE-GTP-Apcpp 100 mM tri-sodium citrate pH 6.4, 10% PEG-3350; Em-CdnE-pppApA 100 mM tri-sodium citrate pH 7.0, 8% PEG-3350. Crystals grew in 3-30 days, and all crystals were harvested using reservoir solution supplemented with 10-25% ethylene glycol using a nylon loop except Apo Rm-CdnE crystals were harvested using NVH oil. X-ray diffraction data were collected at the Advanced Light Source (beamlines 8.2.1 and 5.0.1) and the Advanced Photon Source (beamlines 24-ID-C and 24-ID-E).

Data were processed with XDS and AIMLESS32 using the SSRL autoxds script (A. Gonzalez, Stanford SSRL). Experimental phase information for Rm-CdnE was determined using data collected from selenomethionine-substituted crystals. Four sites were identified with HySS in PHENIX (Adams et al. (2010) Acta Crystallogr. D Biol. Crystallogr. 66:213-221), and an initial map was calculated using SOLVE/RESOLVE (Terwilliger (1999) Acta Crystallogr. D Biol. Crystallogr. 55:1863-1871). Model building was completed in Coot (Emsley & Cowtan (2004) Acta Crystallogr. D Biol. Crystallogr. 60:2126-2132) prior to refinement in PHENIX. Following model completion, the Apo Rm-CdnE structure was used for molecular replacement to determine the nucleotide bound structures. Rm-CdnE models were not sufficient to phase Em-CdnE data, but a minimal core Rm-CdnE active-site model was able to successfully determine the substructure and assist experimental phasing with data collected from a native crystal using sulfur single-wavelength anomalous dispersion at a minimal accessible wavelength (~7,235 eV). 16 heavy sites were identified in HySS that correspond to 12 sulfur, and 4 phosphate sites in the Em-CdnE-pppApA structure, and Em-CdnE model building was completed as for Rm-CdnE. X-ray data for refinement were extended according to I/o resolution cut-off of ~1.5 and CC*correlation and Rpim parameters. Final structures were refined to stereochemistry statistics for Ramachandran plot (favored/allowed), rotamer outliers, and MolProbity score as follows: Rm-CdnE Apo, 98.6%/1.4%, 0.4% and 0.98; Rm-CdnE-Apcpp-UpNpp, 98.9%/1.1%, 0.4% and 1.25; Em-CdnE Apo 97.8%/2.2%, 0.8% and 1.08, Em-CdnE-GTP-Apcpp, 97.8%/2.2%, 0.8%, and 1.05, Em-CdnE-pppApA, 98.1%/1.9%, 0.8%, and 1.29.

In the text and in figures side-chains are numbered according to Rm-CdnE sequence. The analogous residues to N166 from Rm-CdnE in *E. coli* CdnE is N174, in Em-CdnE is S169, in DncV is S259, and in human cGAS is S378.

g. Gel Shift Assays

In vitro binding assays were performed as previously described (Stetson & Medzhitov. (2006) Immunity 24:93-103). Briefly, recombinant *Mus musculus* STING or RECON, at 4, 20, or 100 μM was incubated with radiolabeled nucleotide (≤1 μM final concentration) in gel shift buffer for final conditions of 50 mM Tris pH 7.5, 60 mM KCl, 5 mM Mg (OAc) 2, and 1 mM DTT. Experiments were prepared by combining 1 μL of [α-$^{32}$P] labeled nucleotide, 2 uL 5x gel shift buffer, 5 μL of nuclease free water, and started by addition of 2 μL of recombinant protein in storage buffer. [cx-$^{32}$P] labeled nucleotides were produced with 25 μM of each NTP and ~1 uCi of each [x-$^{32}$P] NTP in the following conditions: cGAS (ATP, GTP/[α-$^{32}$P] GTP), DncV (ATP, GTP/[α-$^{32}$P] ATP), DisA (ATP/[α-$^{32}$P] ATP), WspR (GTP/[α-$^{32}$P] GTP), CdnE (ATP, UTP/[α-$^{32}$P] UTP), and Ec-CdnD02 (ATP, GTP/[α-$^{32}$P] GTP).

After 30 min of equilibration, bound and free nucleotide were separated by 6% native PAGE in 0.5x TBE buffer. Gels were dried, and exposed to phosphorscreen prior to detection by Typhoon Trio Variable Mode Imager system (GE Healthcare). Gel shifts were quantified with ImageQuant® 5.2 and the % bound nucleotide was calculated as a proportion of total bound and free nucleotide for each lane, after subtraction of background signal. Gel shift data is representative of ≥2 independent experiments.

H. Cellular Assays for Interferon-β Induction

In-cell assays were performed as previously described29. Briefly, HEK293T cells were transfected using Lipofectamine™ 2000 in 96-well format with: a control plasmid constitutively expressing *Renilla* luciferase (2 ng pRL-TK), a reporter plasmid expressing interferon β inducible firefly luciferase (20 ng), a plasmid expressing *Mus musculus* STING (5 ng), and a 5-fold dilution series of pcDNA4-based plasmids expressing a nucleotidyltransferase (1.2, 6, 30, 150 ng). 2'3' cGAMP was produced from mouse cGAS, 3'3' cGAMP was produced from *V. cholerae* DncV, cyclic di-AMP (cAA) was produced from *Bacillus subtilis* DisA, cyclic di-GMP (cGG) was produced from *P. aeruginosa* WspR *. Luciferase production was quantified after 24 hours and firefly luciferase was normalized to *Renilla*, which was then normalized to empty nucleotidyltransferase vector used at 150 ng. Data are mean+standard error of the mean from 3 replicates and are representative of 3 independent experiments.

i. RECON Enzyme Assay

Activity assays were performed as previously described (McFarland et al. (2017) *Immunity* 46:433-445). Briefly, a 2-fold dilution series of nucleotide from 50-0.05 μM was incubated in 1×PBS with 200 μM NADPH (cosubstrate) and 25 μM 9,10-Phenanthrenequinone (substrate). The reactions were started with the addition of RECON to a final concentration of 0.5 μM and absorbance at 340 nm was monitored at 20 s intervals for 20 min. Slope of each reaction in the linear range (20-250 s) was used to calculate activity (Linear regression/straight Line analysis, Prism 7.0c). Values were normalized to reactions with zero nucleotide added, which defined 100% activity.

j. Bioinformatics and Tree Construction

To bioinformatically map CD-NTase-like enzymes in bacteria, a previous analysis by Burroughs et al. that combined iterative BLAST analysis, secondary structure predictions, and hidden Markov models to collect DncV-like proteins and their genomic context was extended (Burroughs et al. (2015) *Nucleic Acids Res* 43:10633-10654). Homologs of each of these 1300 identified proteins by BLAST analysis of the NCBI non-redundant protein database, then combined these datasets to identify >5600 CD-NTase-like genes. The dataset was then manually curated (Geneious Software). Bacterial genomes and sequences were aligned using MAFFT FFT-NS-2 algorithm v7.388 (Katoh & Standley (2013) *Mol Biol Evol* 30:772-780), a BLOSUM62 scoring matrix, an open gap penalty of 2, and an offset value of 0.123. Proteins with large truncations or lacking the essential DNA polymerase β-like nucleotidyltransferase residues [ie. GS . . . (D/E) X (D/E) . . . (D/E)] were removed. The tree was created from the MAFFT alignment using a Jukes-Cantor genetic distance model, Neighbor-Joining method, no outgroup, and resampled by Bootstrap for 100 replicates sorted by topologies. The unrooted tree is used to represent global CD-NTase diversity and does accurately reflect the specific evolutionary relationship between the major CD-NTase A-H clades. The aligned sequences along with pairwise identity comparisons were extracted and used to define clades and clusters. A cluster was defined as >~10 CD-NTases that share >24.5% identity to the sequence preceding each in the alignment. For clarity, 14 poorly aligned CD-NTases were excluded from the tree and are indicated in Tables 4A-4C. The full dataset organized by order from the alignment and containing pairwise comparison of protein identity to each preceding gene is available in Tables 4A-4C.

Each sequence was identified from the nonredundant database of protein sequences and, at times, represents identical proteins translated from genes found in multiple bacteria. For this reason, additional metadata was extracted for each sequence from the NCBI Identical Protein Groups (IPG) database. Number of "Protein Accessions" in IPG was used as a quantification of the number of isolated bacterial genomes that harbor each NTase and demonstrated >16,000 genomes harbor CD-NTase isolates. At the time of access (02/03/2018) 5,686 nonredundant CD-NTases sequences were identified representing a total of 16,717 genomes. At that time, 130,135 bacterial genomes had been deposited in the NCBI Genome database, leading to the crude approximation of 12.8% of genomes harboring CD-NTase genes. As some of these genomes may harbor more than one CD-NTase and the IPG can overestimate number of genomes encoding a given protein, it has been estimated that >10% of bacterial genomes sequenced encode CD-NTases. Taxanomic analysis was performed using metadata associated with each CD-NTase in NCBI. When multiple bacteria were represented by one identical sequence, the highest common taxonomical group was used. IPG and Taxanomic data are also found in Tables 4A-4C.

Type CD-NTase enzymes were manually selected from clusters based on the relevance of the organism from which they were isolated (i.e., human or plant pathogen/commensal organism), their predicted aptness for in vitro expression (thermophilic organisms or isolates from *E. coli*), the similarity of their operon to the DncV/CdnE operons, and the number of identical protein sequences represented by each unique sequence.

k. CD-NTase Screen

Each type CD-NTase was codon optimized for *E. coli*, synthesized (IDT), cloned as an N-terminal 6xHis-MBP-tag, and purified from a 25 mL culture. *E. coli* growth, protein induction, and bacterial disruption were performed as described above. Lysates were clarified by centrifugation and Ni-NTA affinity purification was performed as described above with gravity columns replaced by spin columns at 100 x g. Buffer exchange of eluted proteins was performed by concentrating the eluate using 0.5 mL 10 kDa cut-off spin column (Ambion) followed by dilution with storage buffer and re-concentration 3x (final imidazole concentration ~0.3 mM). Proteins were analyzed for second messenger synthesis fresh and flash-frozen for storage at −80° C. For biochemical screen, ATP/CTP/GTP/UTP were used at 25 μM each and incubated overnight with the reaction conditions indicated using methods described above. 1 μL of screened protein (~1 μg) was added to the reaction and the same volume was assessed by SDS-PAGE followed by coomassie staining, shown in FIG. 10E.

FIG. 8F was manually constructed based on known TLC migration patterns which helped identify which CDN species to look for in each sample. The quantity of ions detected by MS relative to other CD-NTases was used to determine if projects were a major or minor constituent. On PEI-Cellulose cyclic dipurines migrate similarly, cyclic purine-pyrimidine hybrids migrate similarly, and cyclic dipyrimidines migrate similarly; on Silica c-di-AMP migrates uniquely, cyclic UMP-AMP and cGAMP migrate similarly, c-di-GMP and c-di-UMP migrate similarly, and cGMP-UMP and cUMP-CMP migrate similarly.

l. NMR

All NMR experiments were conducted on a Varian 400-MR spectrometer (9.4 T, 400 MHz). Samples were prepared by re-suspending evaporated nucleotide samples into 500 μL $D_2O$ supplemented with 5 mM TMSP (3-(trimethylsilyl) propionic-2,2,3,3-d4) at 27° C. Data were processed and figures were generated using VnmrJ software. $^1H$ and $^{31}P$ chemical shifts are reported in parts per million (ppm). J coupling constants are reported in units of frequency (Hertz) with multiplicities listed as s (singlet), d (doublet), and m (multiplet). These data appear in the figure legends of each NMR spectra.

m. Phospholipase Assay

Patatin-like lipases were assayed as previously described (Gaspar & Machner (2014) *Proc. Natl. Acad. Sci. U.S.A.* 111:4560-4565). Briefly, CapV and CapE were produced recombinantly and catalytic activity was measured using the EnzChek® Phospholipase $A_1$ Assay Kit (Invitrogen) according to the manufacturer's instructions. Phospholipases (250 nM) were incubated with 2.5, 0.25, or 0.025 μM CDN. c-di-AMP (Invivogen), 3'3' cGAMP (Invivogen), and c-di-GMP (Biolog) were purchased as chemical standards, cUMP-AMP was purified as described above. Assays were monitored fluorometrically Ex=460 nm/Em=515 nm, for 60 min at ~90 s intervals at room temperature using a Biotek Synergy plate reader. Slope of each reaction in the linear range was used to calculate activity (Linear regression/straight line analysis, Prism 7.0c). A PLA1 standard curve from 20-0.02 U was used to interpolate phospholipase activity. Emission was monitored at a gain of 100 and/or 50 in order to extend the linear range of the assay. Data are mean+standard error of the mean (SEM) from 3 replicates and are representative of 3 independent experiments.

n. Western Blot Analyzsis

CD-NTase in-cell expression levels were verified by Western blot of lysed cells. Confluent HEK293T cells were seeded 24 h prior to transfection at a dilution of 1:4 in a 6-well dish. Cells were transfected with 2 μg of plasmid using Lipofectamine® 2000. At 24 h post transfection cells were harvested by washing cells from the dish using Hanks Buffered Saline Solution, pelleted at low speed, and flash frozen. Pelleted cells were lysed by re-suspending the pellet in 400 μL 1x LDS buffer (ThermoFisher Scientific)+5% β-ME, boiling for 5 min, and vigorously vertexing. Samples were separated by SDS-PAGE, transferred to nitrocellulose membrane, and probed with primary antibodies 1: 5k Rabbit anti-MBP (Millipore Cat #AB3596, RRID: AB_91531) and 1: 10k Mouse anti-Tubulin (Millipore Cat #MABT205, RRID: AB_11204167), followed by secondary antibodies at 1: 10k IRDye 680RD Goat anti-Rabbit IgG (LI-COR Biosciences Cat #925-68071, RRID: AB_2721181) and 543 IRDye 800CW Goat anti-Mouse IgG (LI-COR Biosciences Cat #P/N 925-32210, RRID: AB_2687825). Stained membrane was imaged using a LI-COR Odyssey® CLx imager. Blots are representative of two independent experiments.

o. Coexpression of CD-NTases and Effectors in *E. coli*

CD-NTases chosen for in-depth analysis were cloned into an arabinose-inducible, chloramphenicol resistant pBAD33 plasmid. Putative CD-NTase effector genes were selected based on proximity, if they were classified as involved in biological conflict (Burroughs et al. (2015) *Nucleic Acids Res.* 43:10633-10654), and based on analogous operon architecture to known effector phospholipases. Effector genes were codon optimized for *E. coli* and cloned into pETSUMO, a carbenicillin resistant vector that is IPTG inducible in BL21-DE3 *E. coli* (ThermoFisher Scientific). Three pairs of vectors were assessed for each CD-NTase-effector pair: (1) cogant CD-NTase+ effector, (2) CD-NTase+GFP, (3) mCherry+ effector. Flourescence proteins were used as negative controls. Vectors were cotransformed into electrocompetent BL21-DE3 *E. coli*, selected with both relevant antibiotics, and maintained under non-inducing conditions (0.2% glucose). Overnight bacterial cultures were serially diluted into LB and 5 μL was spot plated on selective medium containing 5 μM IPTG and 0.2% arabinose. Colony formation was enumerated and images were taken at ~24 h. Data are the mean±SEM of 3 independent experiments.

Example 2: Discovery of a Pyrimidine-Containing CDN

Cyclic dinucleotides (CDNs) play central roles in bacterial homeostasis and virulence as nucleotide second messengers. Bacterial CDNs also elicit immune responses during infection when they are detected by pattern recognition receptors in animal cells. 3'3' cGAMP is synthesized in *V. cholerae* by the enzyme DncV and controls a signaling network on the *Vibrio* Seventh Pandemic Island$^{-1}$ (VSP-1), a mobile genetic element present in current *V. cholerae* pandemic isolates (Davies et al. (2012) *Cell* 149, 358-370; Dziejman et al. (2002) *Proc. Natl. Acad. Sci. U.S.A.* 99:1556-1561). During the investigation of the homologs of dncV outside the Vibrionales, an unexpected partial operon was identified in *E. coli* where dncV is replaced with a gene of unknown function (WP_001593458, here renamed cdnE) (Schubert et al. (2004) Mol Microbiol 51:837-848).

Figure 1A:
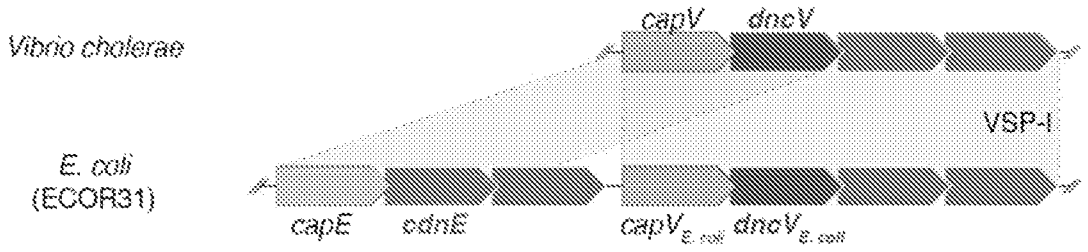
FIG. 1A-FIG. 1F show that bacteria synthesize cyclic UMP-AMP.
Figure 1B:
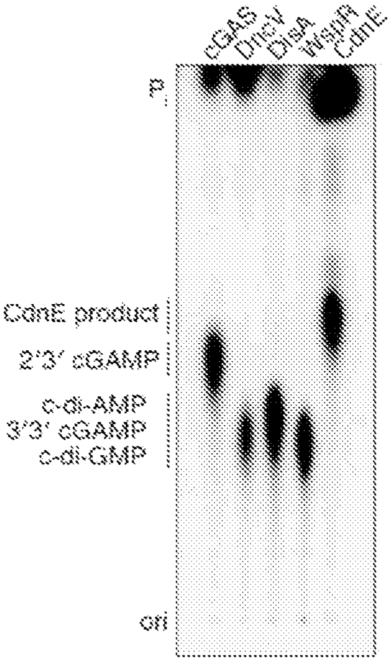
Figure 1C:
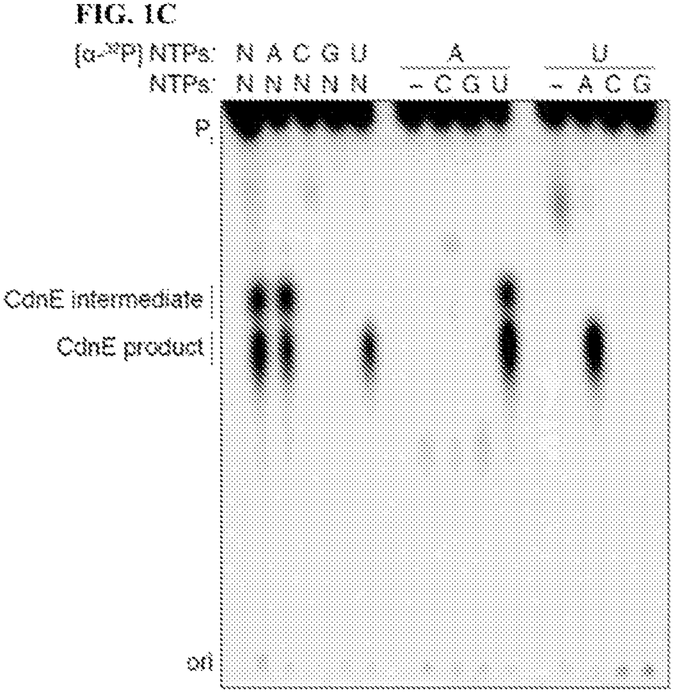
Figure 1D:
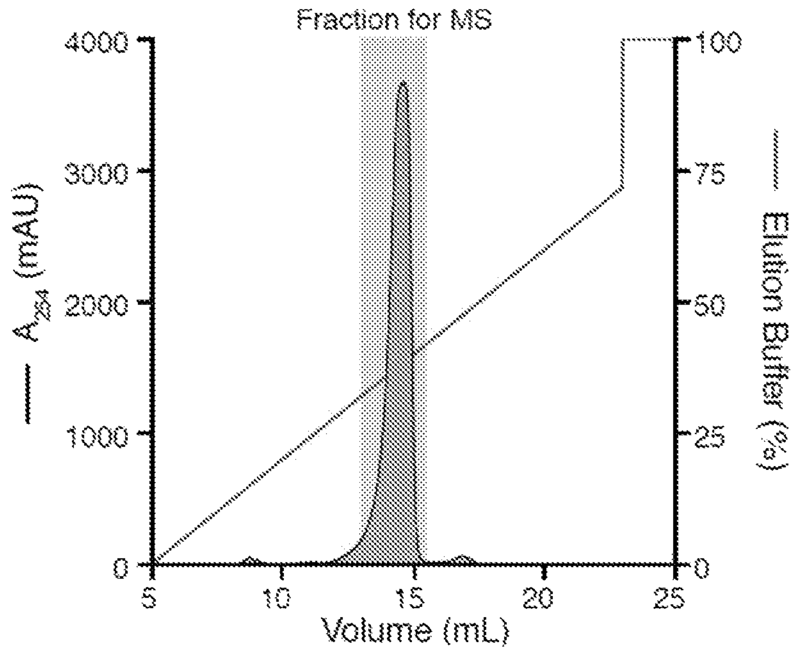
Figure 1E:
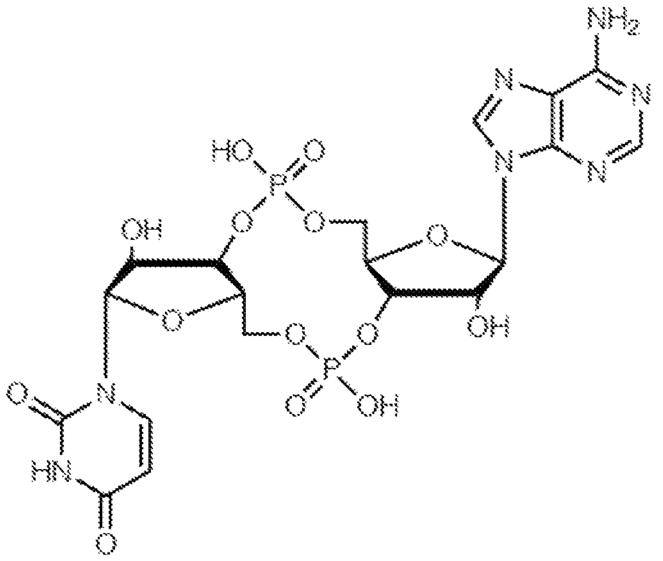
Figure 1F:
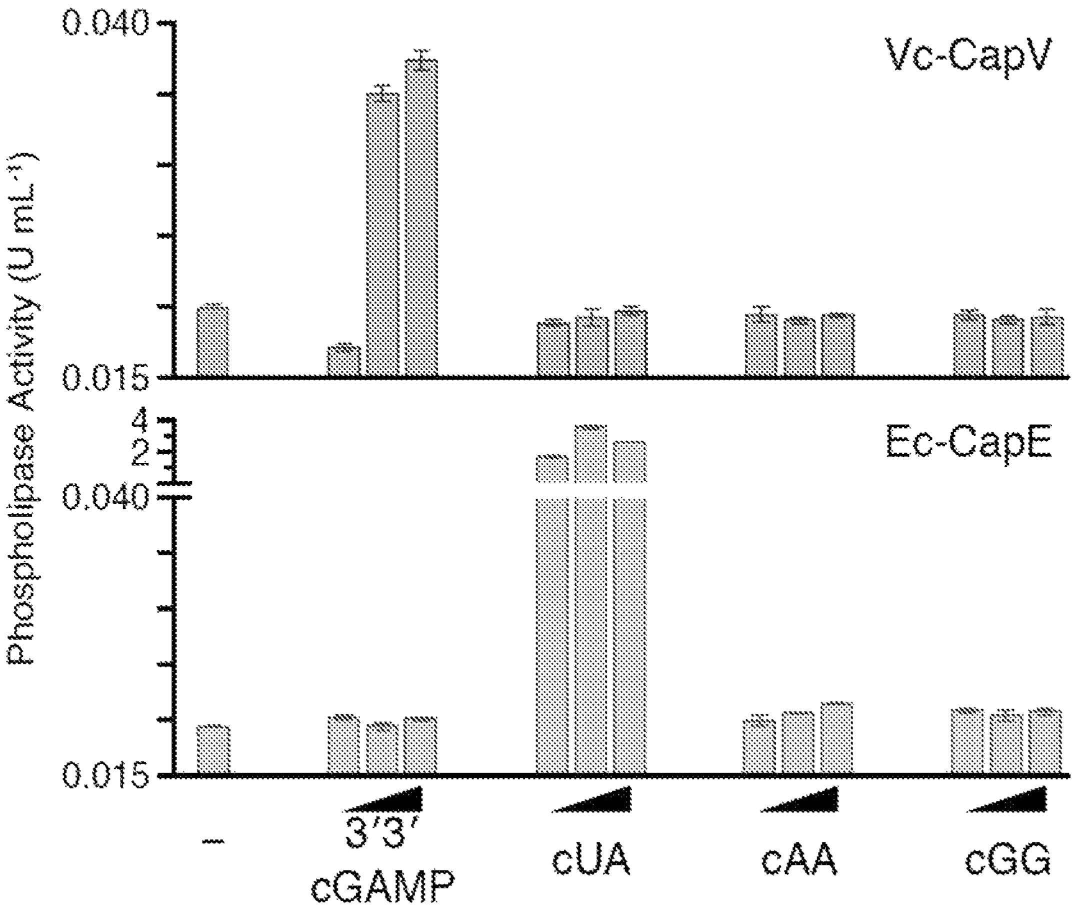
Figure 2A:
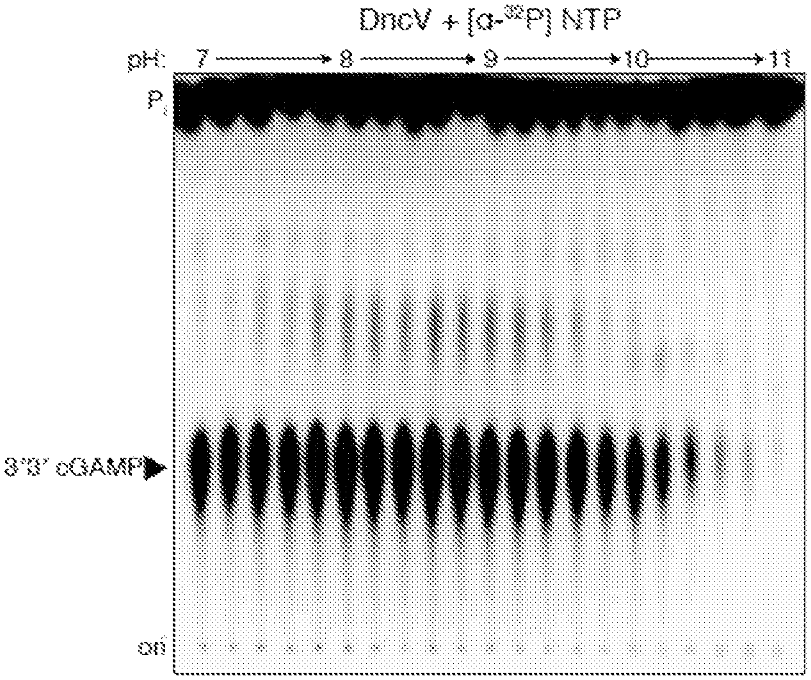
Figure 2B:
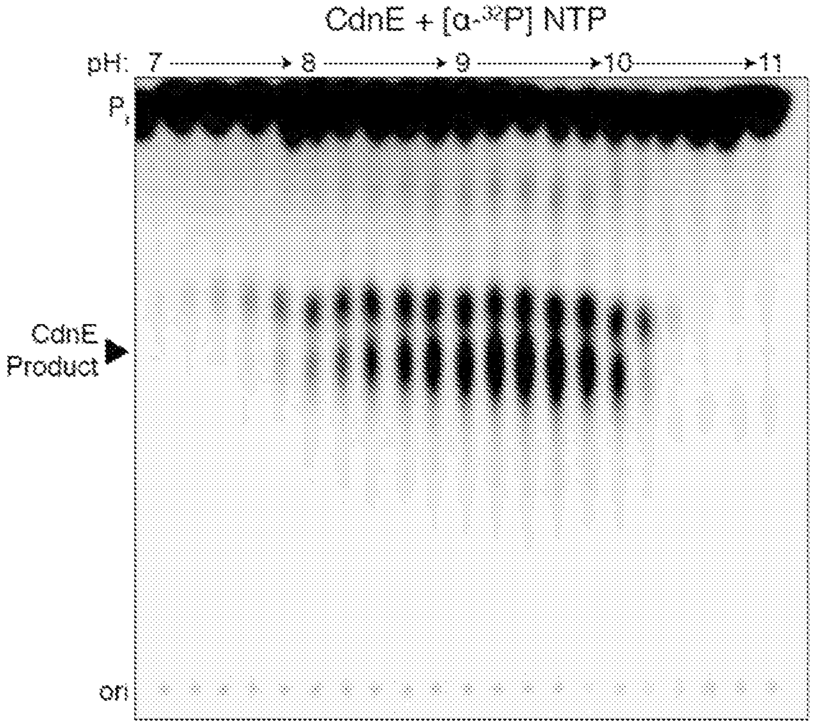
Figure 2C:
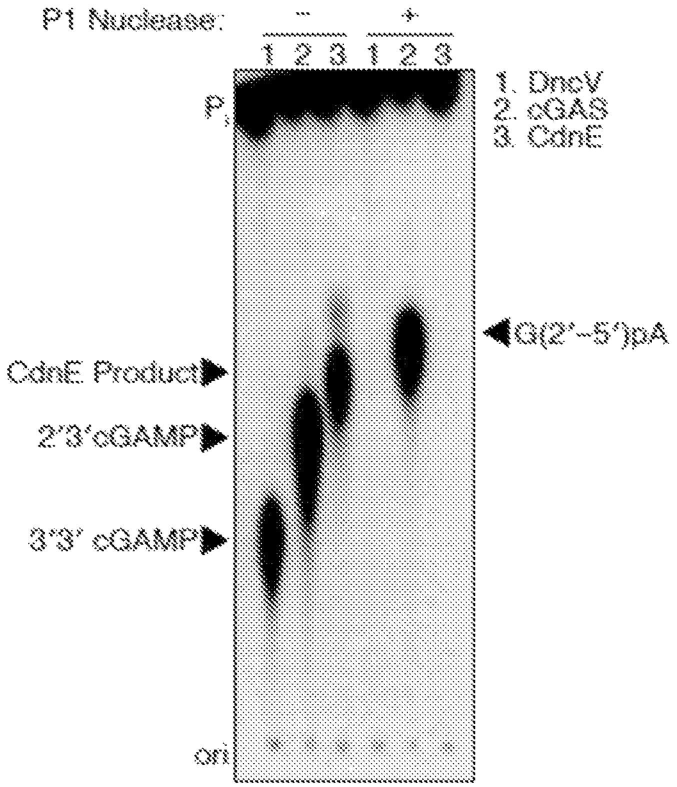
FIG. 2C shows nuclease P1 sensitivity of CDN products. The endonuclease P1 specifically cleaves 3'-5', canonical phosphodiester bonds. DncV and CdnE products were completely digested in the presence of P1 and alkaline phosphate, whereas only one bond of 2'3' cGAMP was susceptible to digestion, producing the linear G (2'-5') pA product.
Figure 2D:
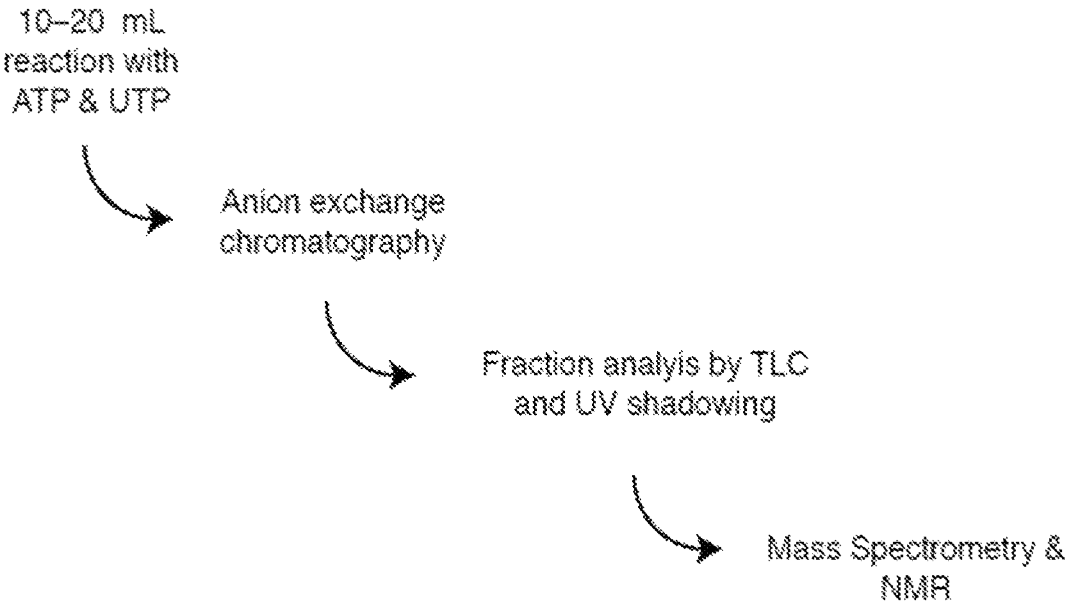
FIG. 2D shows the workflow of nucleotide production for mass spectrometry analysis.
Figure 2E:
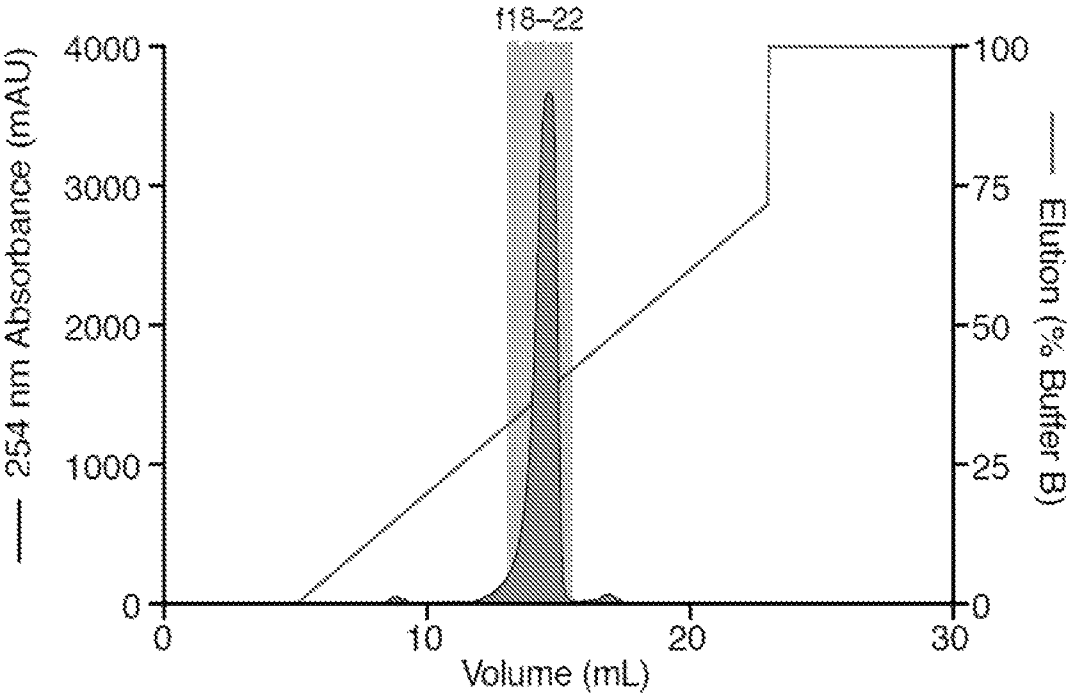
FIG. 2E shows the full graph of data presented in FIG. 1D, which shows anion exchange chromatography of a CdnE reaction with ATP and UTP, eluted with 2 M ammonium acetate by FPLC. Individual fractions were concentrated prior to pooling for further analysis.
Figure 2F:
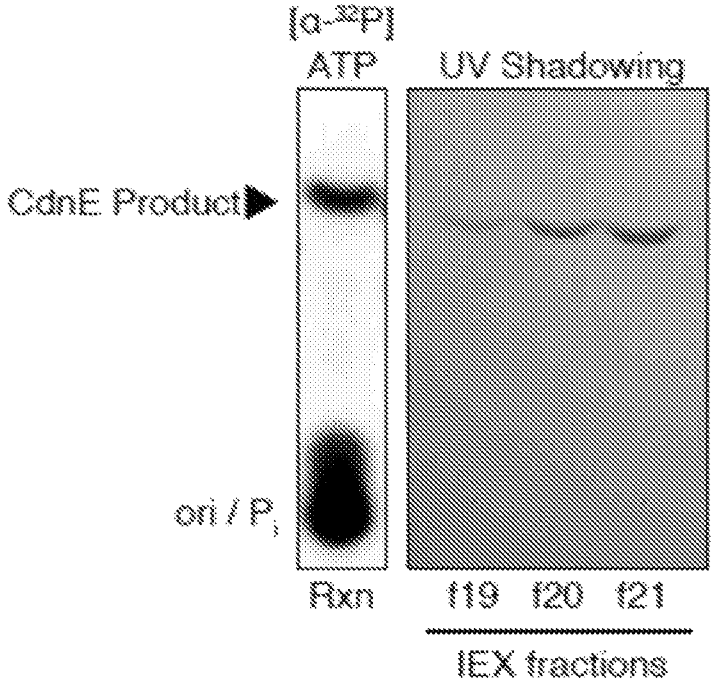
FIG. 2F shows that anion exchange chromatography (IEX) fractions from FIG. 2E were separated by silica TLC, visualized by UV shadowing, and compared to a radiolabeled reaction to confirm the appropriate $A_{254}$ peak. Fractions were pooled and concentrated prior to mass spectrometry and NMR analysis.
Figure 2G:
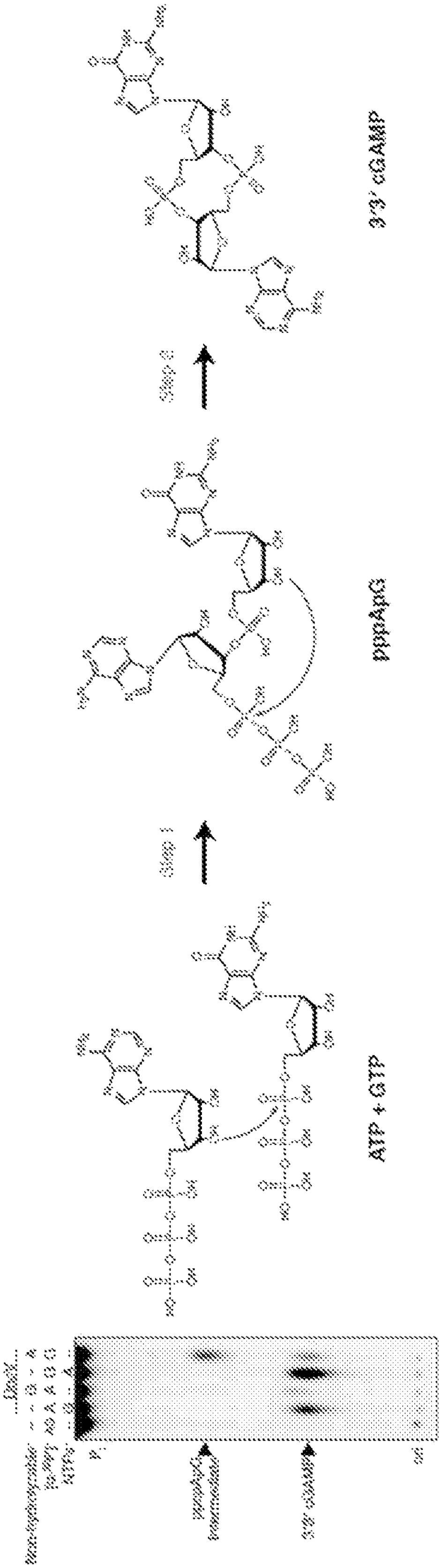
Figure 2H:
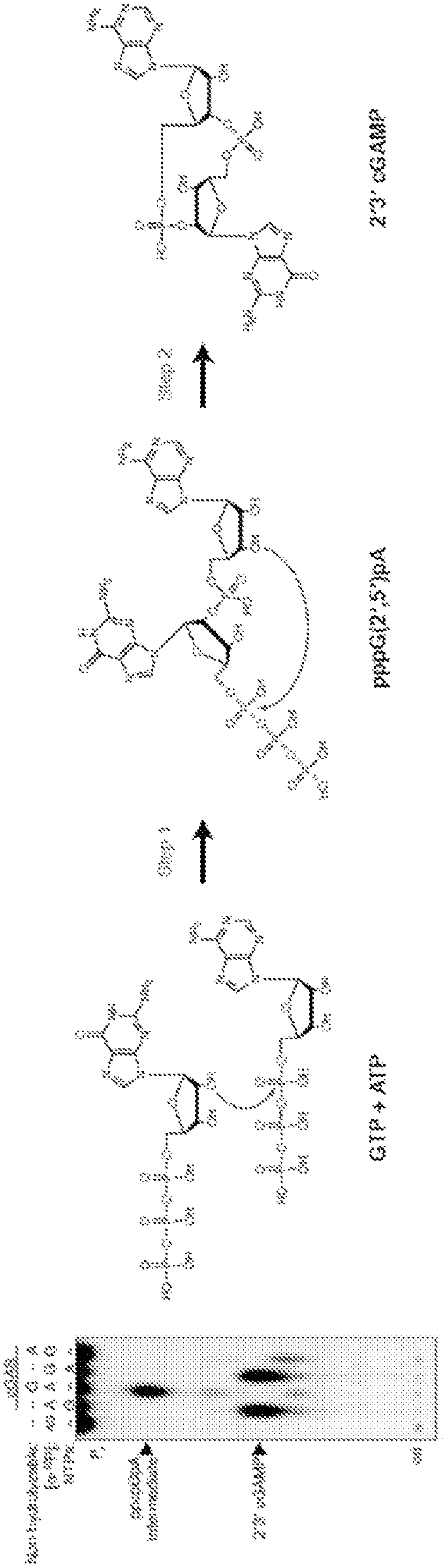
Figure 21:
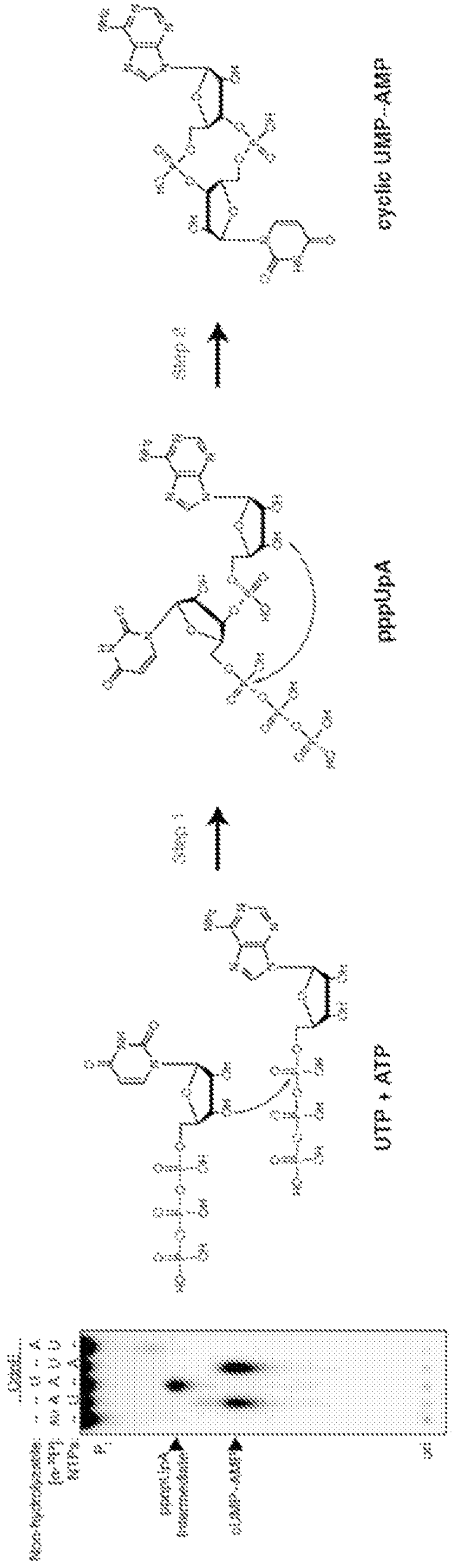
Figure 2J:
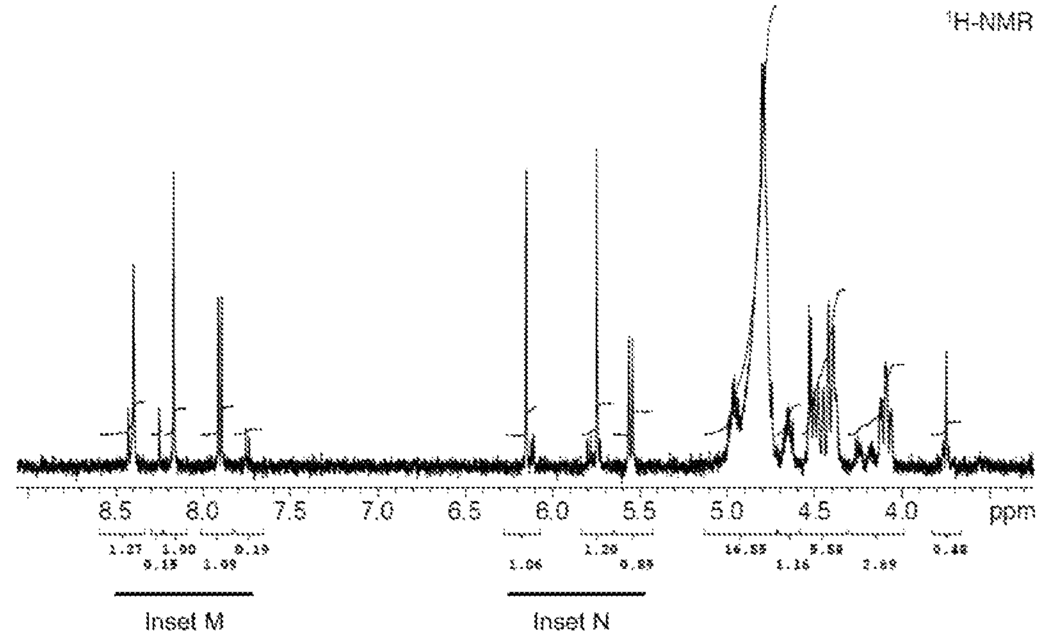
FIGS. 2J, 2M and 2N show 3'3' cyclic uridine monophosphate-adenosine monophosphate proton NMR spectra and associated zoomed-in datasets. $^1$H NMR (400 MHZ): $\delta_H$ 8.40 (s, 1H), 8.17 (s, 1H), 7.90 (d, J=8.2 Hz, 1H), 6.15 (s, 1H), 5.75 (s, 1H), 5.55 (d, J=8.2, 1H), 5.00-4.90 (m, 2H), 4.80 (d, J=4.5 Hz, 1H) 4.70-4.61 (m, 1H), 4.55-4.38 (m, 4H), 4.17-4.02 (m, 2H).
Figure 2K:
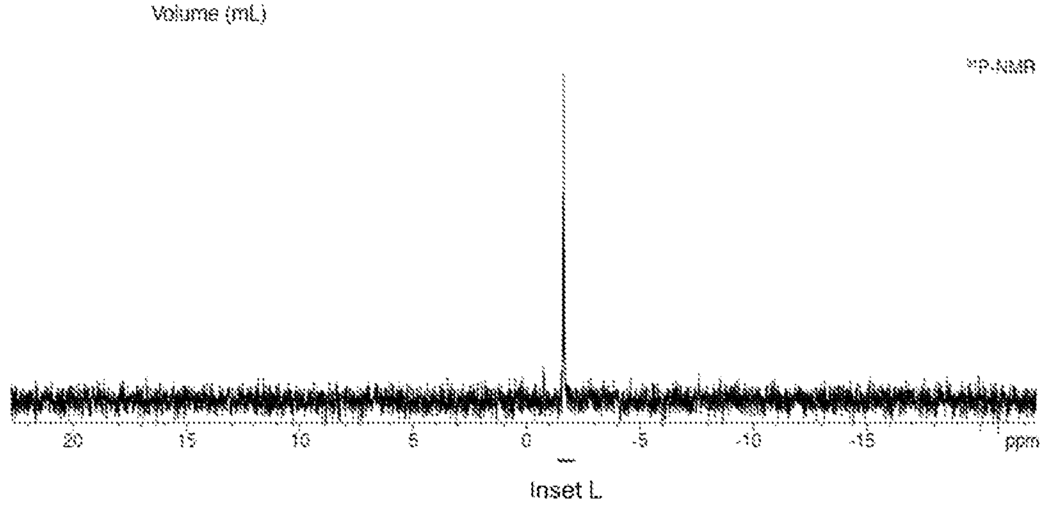
FIGS. 2K and 2L show 3'3' cyclic uridine monophosphate-adenosine monophosphate phosphate NMR spectra and associated zoomed in dataset. 31P {1H} NMR (162 MHZ): 8-1.59 (s, 1P),-1.65 (s, 1P).
Figure 2L:
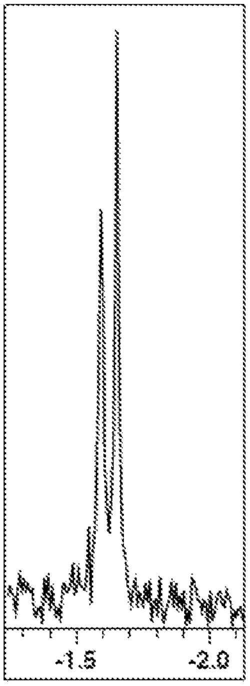
Figure 2M:
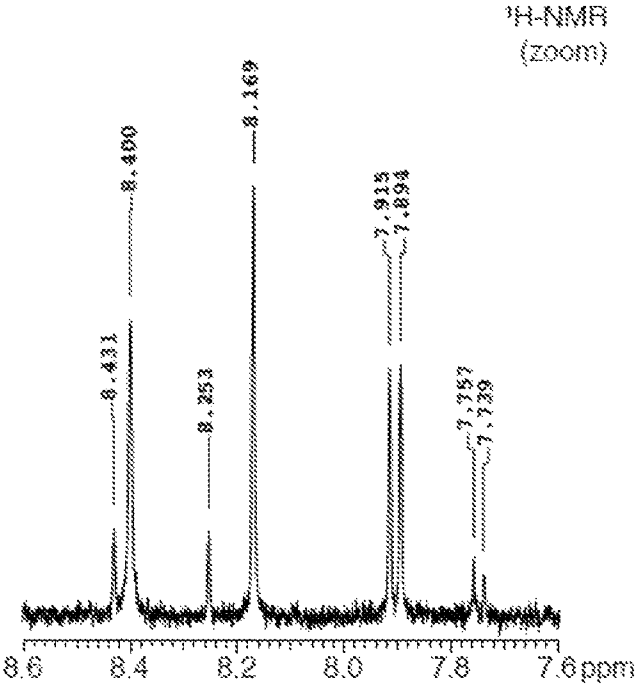
Figure 2N:
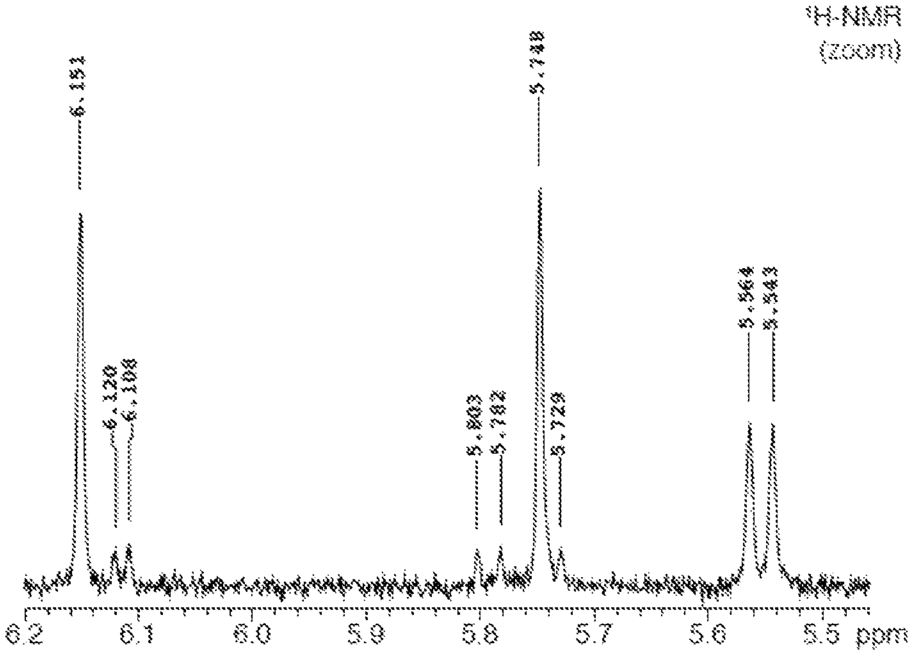
Figure 2O:
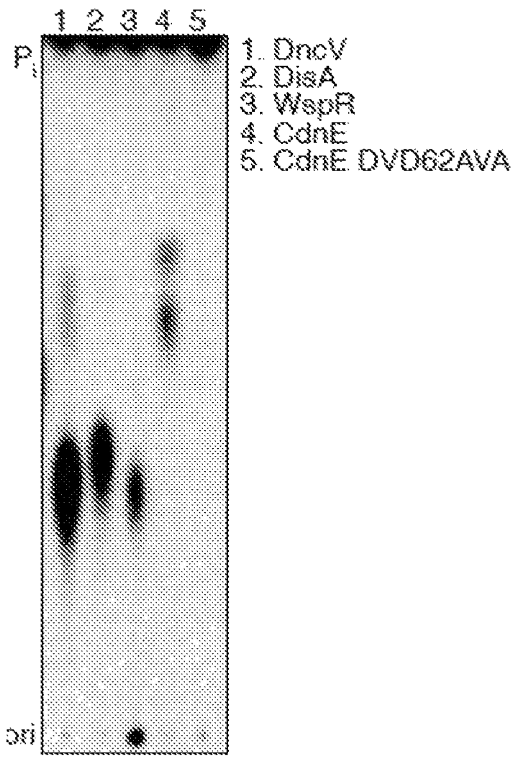

The operon architecture implies that cdnE may be an alternative 3'3' cGAMP synthase (FIG. 1A). To test this, purified CdnE protein was incubated with [«-$^{32}$P]-radiolabeled ATP, CTP, GTP, and UTP, and the reaction products were visualized using thin-layer chromatography (TLC). CdnE synthesized a product distinct from all currently known CDNs. All currently known bacterial CDNs are formed from purine nucleotides and exhibit a comparatively slow migration on PEI-cellulose TLC plates. In contrast, CdnE synthesized a product that migrated rapidly in TLC analysis (FIGS. 1B, 2A, and 2B). Biochemical deconvolution (pairwise assessment of necessary NTPs) revealed that ATP and UTP were necessary and sufficient for product formation (FIG. 1E), indicating that CdnE may synthesize a hybrid purine-pyrimidine cyclic dinucleotide, and that the final product contains only nuclease P1 sensitive, 3'-5' phosphodiester bonds (FIG. 2C). The purified product was analyzed with nuclease digestion, mass spectrometry (MS) and NMR (FIGS. 1E, 2C-2F and 2J-2N), and confirmed that the product of CdnE is cyclic UMP-AMP (cUMP-AMP).

DncV is a structural homolog of human cGAS, and each enzyme uses a single active site to sequentially form two separate phosphodiester bonds and release a CDN product (Kranzusch et al. (2014) *Cell* 158:1011-1021) (FIG. 14). In spite of no overall sequence homology, careful inspection of the CdnE sequence revealed potential cGAS/DncV-like active site residues (GSYX10DVD (SEQ ID NO: 1)), which were essential for catalysis (FIG. 20). Reactions with non-hydrolyzable nucleotides confirmed that CdnE catalyzes synthesis of cUMP-AMP using a sequential path through a pppU (3'-5') pA intermediate (FIGS. 2G-21), and revealed that CdnE is likely a divergent enzyme ancestrally related to cGAS and DncV. The gene was therefore renamed cGAS/DncV-like nucleotidyltransferase in *E. coli* (cdnE).

In *Vibrio*, DncV controls the activity of cGAMP activated phospholipase in *Vibrio* (CapV), a patatin-like lipase that is a direct 3'3' cGAMP receptor encoded in the dncV operon (Severin et al. (2018) *Proc. Natl. Acad. Sci. U.S.A.* 115: E6048-E6055). cdnE is also preceded by a gene encoding a patatin-like phospholipase (here renamed cUMP-AMP activated phospholipase in *E. coli*, capE, FIG. 1A) and it was determined whether this lipase is activated by cUMP-AMP. A fluorometric assay for phospholipase activity showed that CapV and CapE are indeed specific and are only activated in the presence of the nucleotide synthesized by their adjacently encoded nucleotidyltransferase. Importantly, the identification of CapE as a direct cUMP-AMP receptor in *E. coli* confirms that CdnE produces cUMP-AMP to function as a nucleotide second messenger and control downstream signaling. The exquisite specificity of CapE insulates this circuit from 3'3' cGAMP and other parallel CDN signals, explaining a possible driving force for evolution of cUMP-AMP and increased cyclic dinucleotide diversity.

Example 3: Mechanism of pyrimidine discrimination

To determine the mechanism of hybrid purine-pyrimidine CDN formation, and understand the relationship between CdnE, cGAS and DncV, a series of X-ray crystal structures of a CdnE homolog from the thermophilic bacterium Rhodothermus *marinus* were determined (Rm-CdnE, FIG. 3, FIG. 4A, and Table 3). CdnE adopts a Pol-β-like nucleotidyltransferase fold highly similar to cGAS and the core of DncV, confirming a shared structural and evolutionary relationship (FIG. 3E). CdnE is more distantly related to other nucleotidyltranferases including non-templated CCA-adding enzymes (Kuhn et al. (2015) *Cell* 160:644-658), poly(A) polymerases (Yang et al. (2014) *J Mol Biol* 426:43-50), and templated polymerases such as DNA Polymerase β and μ (Freudenthal et al. (2013) *Cell* 154, 157-168; Moon et al. (2015) *Proc. Natl. Acad. Sci. U.S.a.* 112: E4530-E4536). The human innate immune enzymes cGAS and Oligo Adenylate Synthase 1 (OAS1) are activated by binding a cognate nucleic acid, resulting in a conformational change that allows for activation of catalysis (Hornung et al. (2014)

*Nat Rev Immunol* 14:521-528). CdnE, like DncV (Kranzusch et al. (2014) *Cell* 158:1011-1021), is structurally more similar to the "activated" conformation of these two enzymes, which is consistent with biochemistry data that demonstrated that CdnE is constitutively active and does not require a cognate stimulus.

TABLE 3

Summary of data collection, phasing and refinement statistics

| | Rm-CdnE Apo (6E0K) | Rm-CdnE Upnpp, Apcpp (6E0L) | Rm-CdnE Apo (Se-SAD) |
|---|---|---|---|
| Data collection | | | |
| Space group | P $2_12_12_1$ | P $2_12_12_1$ | P $2_12_12_1$ |
| Cell dimensions | | | |
| a, b, c (Å) | 52.53, 66.33, 89.21 | 51.65, 65.65, 88.86 | 52.70, 66.60, 89.37 |
| α, β, γ (°) | 90.0, 90.0, 90.0 | 90.0, 90.0, 90.0 | 90.0, 90.0, 90.0 |
| Wavelength | 1.00001 | 0.97910 | 0.97940 |
| Resolution (Å)[a] | 37.39-1.60 (1.63-1.60) | 36.92-2.25 (2.32-2.25) | 45.40-2.29 (2.37-2.29) |
| $R_{pim}$ | 2.4 (12.1) | 6.8 (30.4) | 2.6 (26.9) |
| I/σ(I) | 18.0 (4.6) | 9.8 (3.0) | 26.1 (2.9) |
| $CC_{1/2}$ | 99.9 (96.0) | 99.2 (81.7) | 99.9 (80.3) |
| Completeness (%) | 99.7 (95.0) | 99.1 (94.7) | 97.5 (79.9) |
| Redundancy | 6.7 (5.4) | 5.3 (4.4) | 81.1 (53.2) |
| Refinement | | | |
| Resolution (Å) | 37.39-1.60 | 36.92-2.25 | |
| No. reflections | | | |
| Total | 282,982 | 78,899 | |
| Unique | 41,925 (1,925) | 14,799 (1,263) | |
| Free (%) | 5 | 5 | |
| $R_{work}/R_{free}$ | 16.4/18.6 | 18.2/21.7 | |
| No. atoms | | | |
| Protein | 2457 | 2426 | |
| Ligand | | 61 | |
| Water | 442 | 177 | |
| B factors | | | |
| Protein | 21.6 | 23.8 | |
| Ligand | | 38.9 | |
| Water | 33.0 | 31.4 | |
| r.m.s deviations | | | |
| Bond lengths (Å) | 0.006 | 0.008 | |
| Bond angles (°) | 0.802 | 1.06 | |

| | Em-CdnE Apo (6E0M) | Em-CdnE GTP, Apcpp (6E0N) | Em-CdnE pppA[3'-5']pA (6E0O) |
|---|---|---|---|
| Data collection | | | |
| Space group | P $2_12_12_1$ | P $2_12_12_1$ | P $2_12_12_1$ |
| Cell dimensions | | | |
| a, b, c (Å) | 57.19, 58.23, 99.45 | 57.02, 58.24, 99.52 | 57.07, 58.61, 99.48 |
| α, β, γ (°) | 90.0, 90.0, 90.0 | 90.0, 90.0, 90.0 | 90.0, 90.0, 90.0 |
| Wavelength | 0.97920 | 0.97918 | 0.97918 |
| Resolution (Å)[a] | 49.58-1.52 (1.54-1.52) | 37.83-1.50 (1.52-1.50) | 37.92-1.25 (1.27-1.25) |
| $R_{pim}$ | 3.3 (62.3) | 4.3 (74.5) | 2.5 (45.7) |
| I/σ(I) | 13.6 (1.4) | 10.6 (1.2) | 13.9 (1.6) |
| $CC_{1/2}$ | 99.9 (54.7) | 99.8 (42.6) | 99.9 (63.1) |
| Completeness (%) | 99.8 (96.1) | 99.7 (95.0) | 99.9 (98.7) |
| Redundancy | 12.9 (8.5) | 6.7 (6.0) | 6.7 (6.4) |
| Refinement | | | |
| Resolution (Å) | 49.58-1.52 | 37.83-1.50 | 37.92-1.25 |
| No. reflections | | | |
| Total | 669,261 | 361,682 | 621,541 |
| Unique | 52,028 (2,474) | 53,857 (2,464) | 92,915 (4,497) |
| Free (%) | 3.9 | 3.9 | 3.9 |
| $R_{work}/R_{free}$ | 13.9/17.6 | 15.5/18.0 | 14.2/16.4 |

TABLE 3-continued

| Summary of data collection, phasing and refinement statistics | | | |
|---|---|---|---|
| No. atoms | | | |
| Protein | 2255 | 2239 | 2328 |
| Ligand | 9 (PPi) | 96 | 63 |
| Water | 326 | 343 | 377 |
| B factors | | | |
| Protein | 19.8 | 19.6 | 17.66 |
| Ligand | 27.8 | 38.9 | 32.54 |
| Water | 34.4 | 33.1 | 31.96 |
| r.m.s deviations | | | |
| Bond lengths (Å) | 0.008 | 0.005 | 0.007 |
| Bond angles (°) | 1.11 | 1.06 | 1.30 |

| | Em-CdnE (S-SAD) |
|---|---|
| Data collection | |
| Space group | $P\ 2_12_12_1$ |
| Cell dimensions | |
| a, b, c (Å) | 56.85, 58.54, 99.60 |
| α, β, γ (°) | 90.0, 90.0, 90.0 |
| Wavelength | 1.71370 |
| Resolution (Å)[a] | 37.93-1.99 (2.05-1.99) |
| $R_{pim}$ | 1.5 (6.1) |
| I/σ(I) | 35.7 (14.3) |
| $CC_{1/2}$ | 99.9 (97.4) |
| Completeness (%) | 95.7 (86.3) |
| Redundancy | 72.8 (62.3) |
| Refinement | |
| Resolution (Å) | |
| No. reflections | |
| Total | |
| Unique | |
| Free (%) | |
| $R_{work}/R_{free}$ | |
| No. atoms | |
| Protein | |
| Ligand | |
| Water | |
| B factors | |
| Protein | |
| Ligand | |
| Water | |
| r.m.s deviations | |
| Bond lengths (Å) | |
| Bond angles (°) | |

Single crystals were used to collect data for each structure.

[a]Values in parentheses are for highest-resolution shell.

TABLE 3.1

Summary of data collection, phasing and refinement statistics

| | RECON cAAG (6M7K) |
|---|---|
| Data collection | |
| Space group | P $2_12_12_1$ |
| Cell dimensions | |
| a, b, c (Å) | 50.60, 57.07, 110.76 |
| α, β, γ (°) | 90.0, 90.0, 90.0 |
| Wavelength | 0.97910 |
| Resolution (Å)[a] | 46.02-1.10 (1.12- |
| $R_{pim}$ | 2.9 (29.8) |
| I/σ(I) | 14.0 (2.6) |
| $CC_{1/2}$ | 99.9 (81.3) |
| Completeness (%) | 99.7 (97.5) |
| Redundancy | 9.1 (8.2) |
| Refinement | |
| Resolution (Å) | 46.02-1.10 |
| No. reflections | |
| Total | 1,185,904 |
| Unique | 130,194 (6242) |
| Free (%) | 2 |
| $R_{work}/R_{free}$ | 14.3/15.7 |
| No. atoms | |
| Protein | 2644 |
| Ligand | 83 (cAAG, EtGl) |
| Water | 537 |
| B factors | |
| Protein | 9.9 |
| Ligand | 12.5 |
| Water | 24.5 |
| r.m.s deviations | |
| Bond lengths (Å) | 0.011 |
| Bond angles (°) | 1.421 |

Single crystals were used to collect data for each structure.
[a]Values in parentheses are for highest-resolution shell.

Figure 3A:
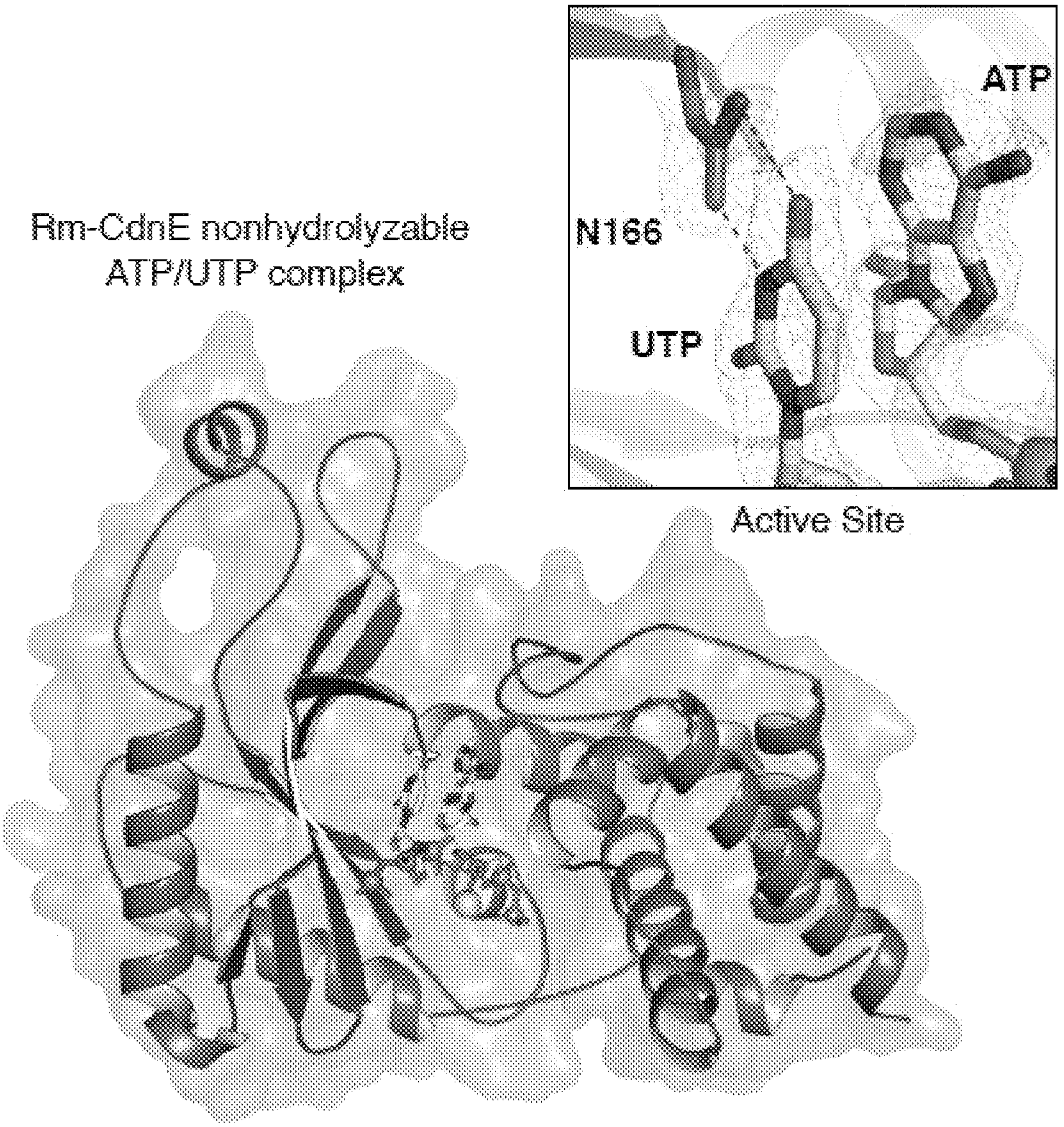
FIG. 3A-FIG. 3E show that conserved active site residues dictated CD-NTase specificity.
Figure 3B:
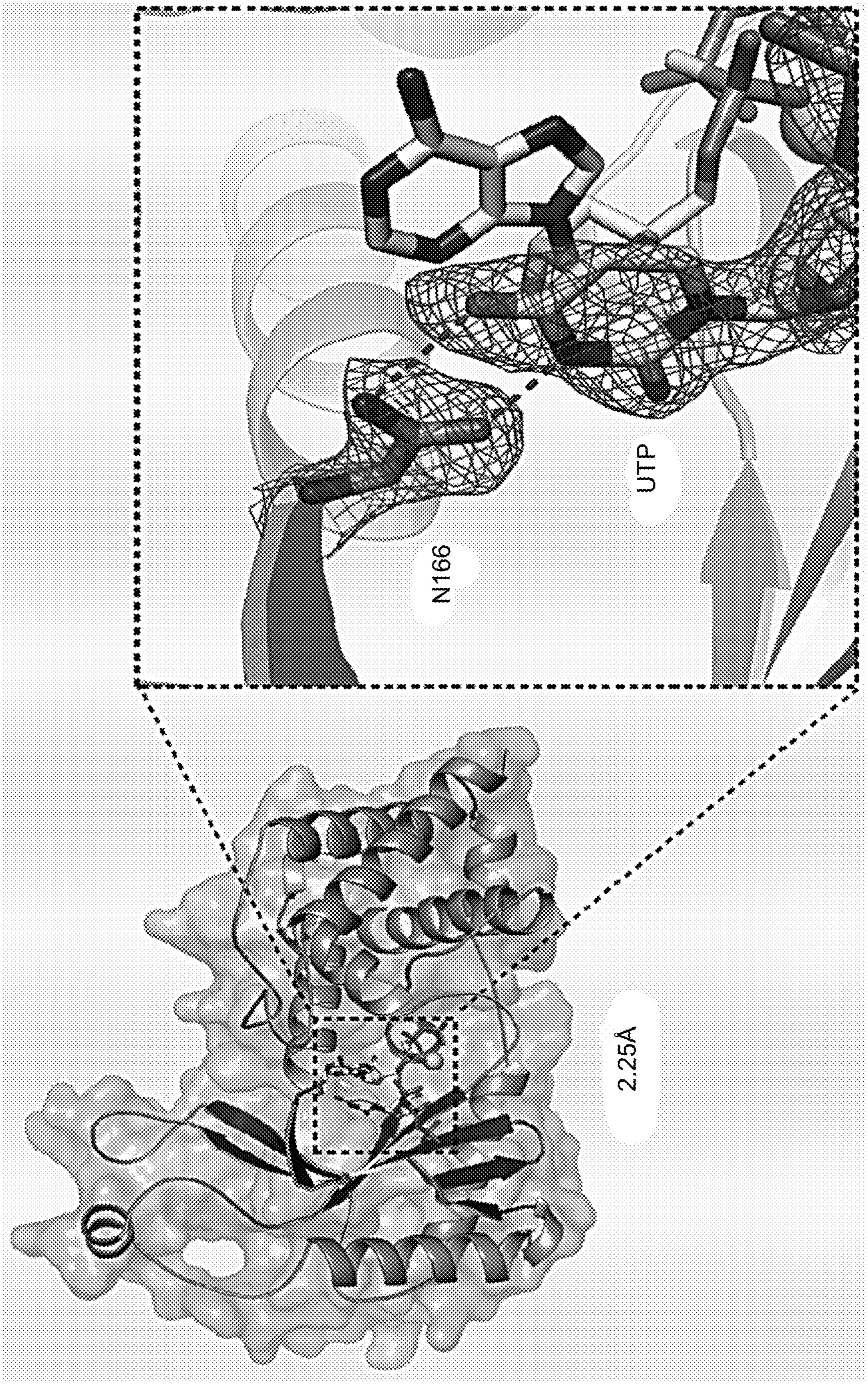

The structure of Rm-CdnE in complex with nonhydrolyzable ATP and UTP reveals an asparagine (N166) side chain that forms hydrogen bonds with the uracil base and positions the UTP α-P for attack by the 3' hydroxyl of ATP (FIGS. 3A and 3B). N166 is located in the same position as a serine residue in the first donor nucleotide pocket of both DncV and cGAS (FIGS. 4B and 4D), and it was determined whether this asparagine substitution is sufficient to dictate CdnE product specificity. Whereas wild-type CdnE robustly synthesized cUMP-AMP, CdnEN166S incorporated almost no UTP and instead synthesized predominantly c-di-AMP (FIGS. 3D and 4C). These results demonstrate that subtle active site changes are sufficient to direct synthesis of an alternative nucleotide product.

Figure 3C:
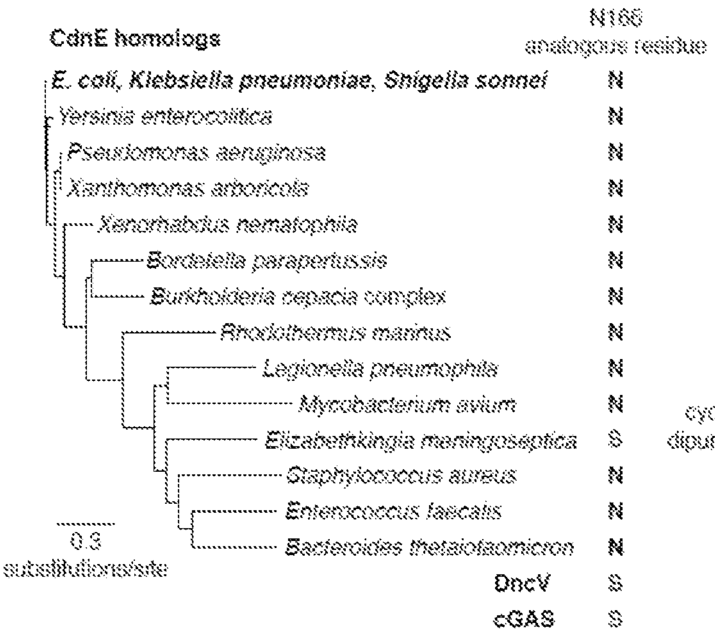
Figure 3D:
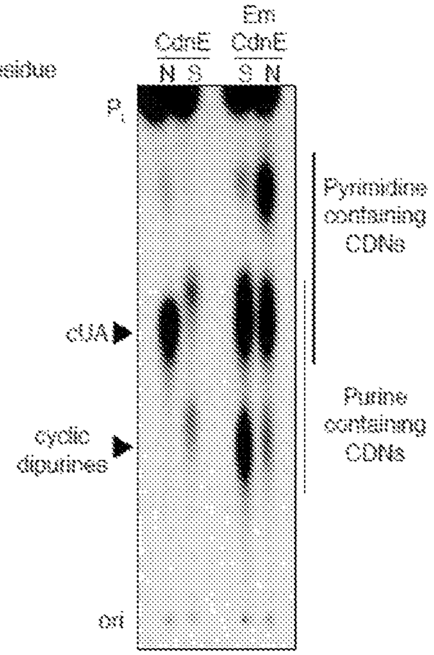

CdnE homologs were surveyed and it was determined that N166 is nearly universally conserved (FIGS. 3C and 5A). An exception is CdnE from the emerging nosocomial pathogen *Elizabethkingia meningoseptica* (Em-CdnE, FIG. 3C) (Jean et al. (2014) *J. Hosp. Infect.* 86:244-249), which encodes a serine at the analogous position to N166. The crystal structure of Em-CdnE bound to its nucleotide substrates were next determined for direct comparison with Rm-CdnE (Table 3). Unlike the other CdnE homologs, Em-CdnE robustly synthesized cyclic dipurines (FIGS. 3D and 5B-5H). Superposition of the CdnE structures demonstrated natural N-to-S reprogramming in the Em-CdnE active-site lid, and re-introduction of the ancestral asparagine at this position reverted this enzyme back to preferential incorporation of pyrimidines (FIGS. 3D and 5F-5I). These data revealed a low barrier for altering specificity of CdnE and demonstrated that organisms like *E. meningoseptica* harbor mutations at N166 that reprogram purine and pyrimidine product specificity.

Figure 3E:
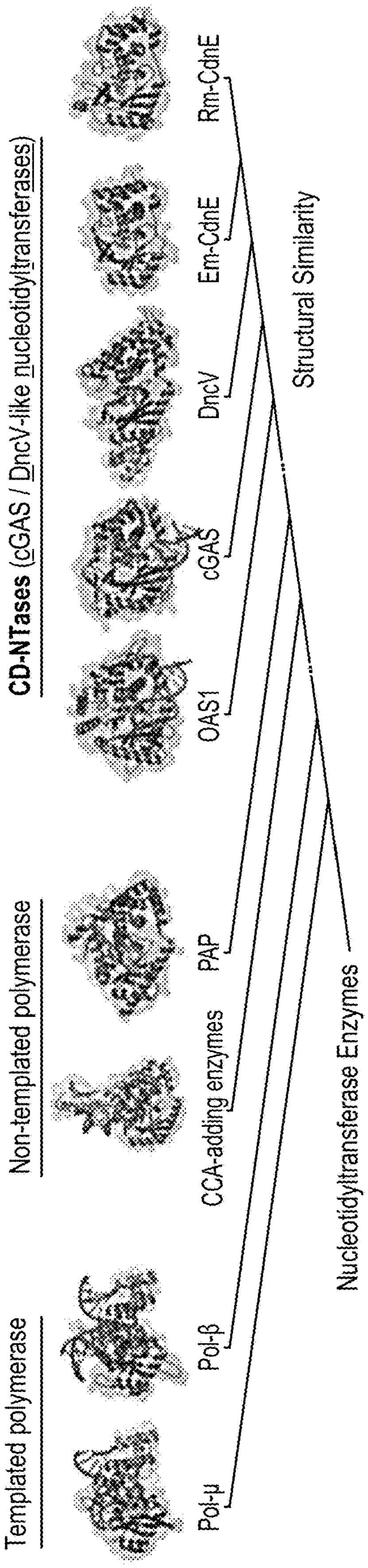

High-resolution structures of cGAS, OAS1, DncV, and two CdnE homologs allowed for the rational definition of shared structural and functional homology. All of these enzymes share three features: (1) a common DNA polymerase β-like nucleotidyltransferase superfamily protein-fold in spite of dramatic sequence divergence, (2) template-independent synthesis of a diffusible molecule through caging of the active site, using a protein scaffold not conserved with more distantly related templated polymerases, and (3) an active site architecture that allows diversification of products and phosphodiester linkage through amino acid substitutions within the active-site lid. This family of enzymes have been designated as CD-NTases (cGAS/DncV-like Nucleotidyltransferases), a structurally and evolutionarily distinct subset of the DNA polymerase β-like nucleotidyltransferase superfamily (FIG. 3E). CD-NTases use distinct enzymatic chemistry and are not structurally related to dimeric GGDEF family ("GGDEF" disclosed as SEQ ID NO: 3) c-di-GMP synthases or DAC/DisA family c-di-AMP synthases (Jenal & Lori (2017) *Nat. Rev. Micro.* 325:279; Corrigan & Grundling (2013) *Nat. Rev. Micro.* 11:513-524), and therefore represent a third class of CDN synthases.

Example 4: CD-NTases and Cross-Kingdom Signaling

Many bacteria that encode CD-NTases thrive in close proximity to eukaryotic hosts, including fungi, plants, and animals such as humans (FIG. 3C). CdnE homologs are found in many human pathogens and commensal organisms. For example, genes encoding CdnE are found in *Klebsiella pneumoniae* and the intracellular pathogen *Shigella sonnei* while genes that encode CdnE orthologs are present in the genomes of commensal bacterial genera such as *Bacteroides* (FIG. 3C). Mammals have evolved a sophisticated surveillance system for detecting and initiating immune responses to bacterial products, including CDNs that are secreted (Woodward et al. (2010) Science 328:1703-1705) or released during bacteriolysis. In mice, STING detects bacterial c-di-AMP, c-di-GMP, and 3'3' cGAMP in addition to endogenously produced 2'3' cGAMP (Wu & Chen (2014) Annu. Rev. Immunol 32:461-488). Because STING is modulated by cyclic dipurine agonists, it was tested whether cUMP-AMP was recognized by STING or other receptors of the innate immune system. STING bound to all four cyclic dipurine molecules with high affinity and activated type I interferon in cells; however, STING was unable to recognize physiological concentrations of cUMP-AMP in vitro and cUMP-AMP failed to activate STING-dependent type I interferon in cells (FIGS. 6A, 6B, and 7A). In contrast, the mammalian CDN sensor reductase controlling NF-κB (RECON) (McFarland et al. (2017) Immunity 46:433-445) bound to cUMP-AMP, and cUMP-AMP inhibited RECON function, albeit with a reduced potency compared to the previously reported inhibition by c-di-AMP and 3'3' cGAMP (FIGS. 6C, 6D, 7B, and 16). RECON bound to cUMP-AMP with a similar Kd to that of STING for c-di-GMP (FIG. 7C) (Burdette et al. (2011) Nature 478:515-518), thereby identifying the first host receptor for a naturally occurring purine-pyrimidine hybrid CDN. Whereas the specificity of STING for CDNs is dependent on the presence of two purine bases, RECON uses an alternative specificity that requires only the minimal presence of an adenosine base in the 3'3' CDN. These results highlighted that the expansion of the understanding of natural bacterial signaling molecules is required to explain host receptor specificity. Further, these findings demonstrated that the host response can be tuned via multiple receptors that compete for CDNs using distinct rules of engagement.

Example 5: CD-NTases Synthesize Diverse Products

Figure 15B:
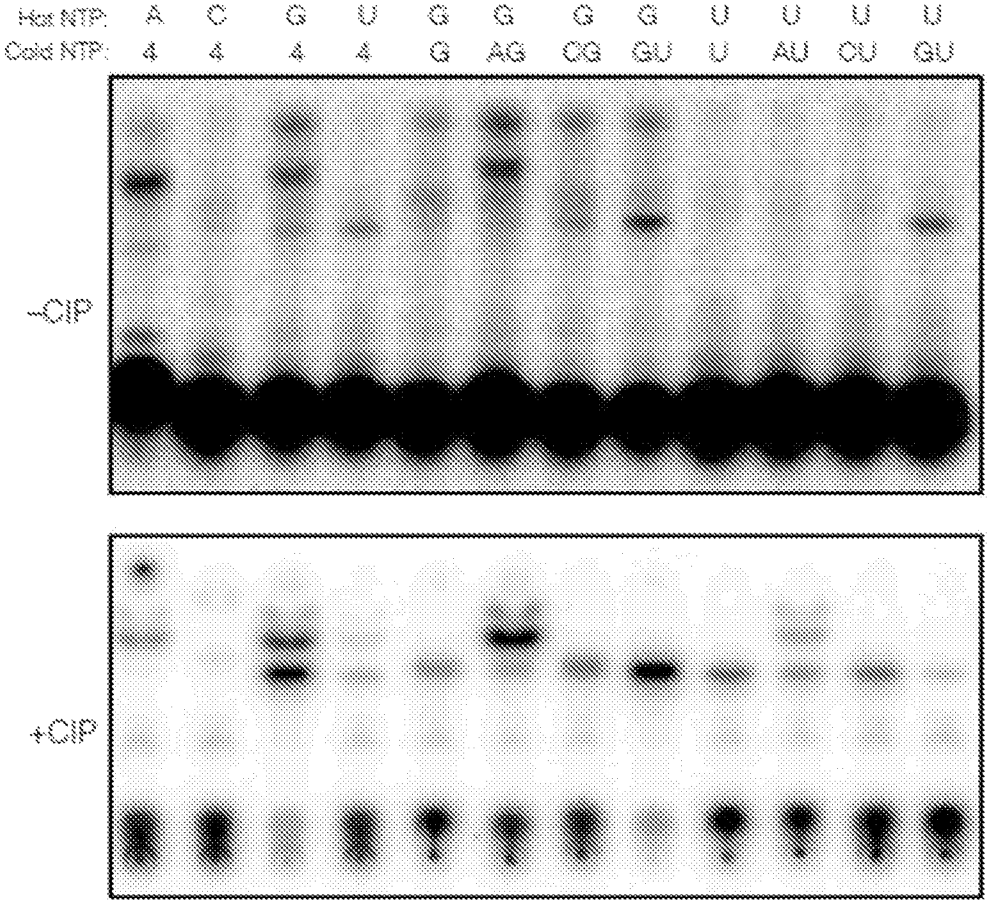
Figure 15C:
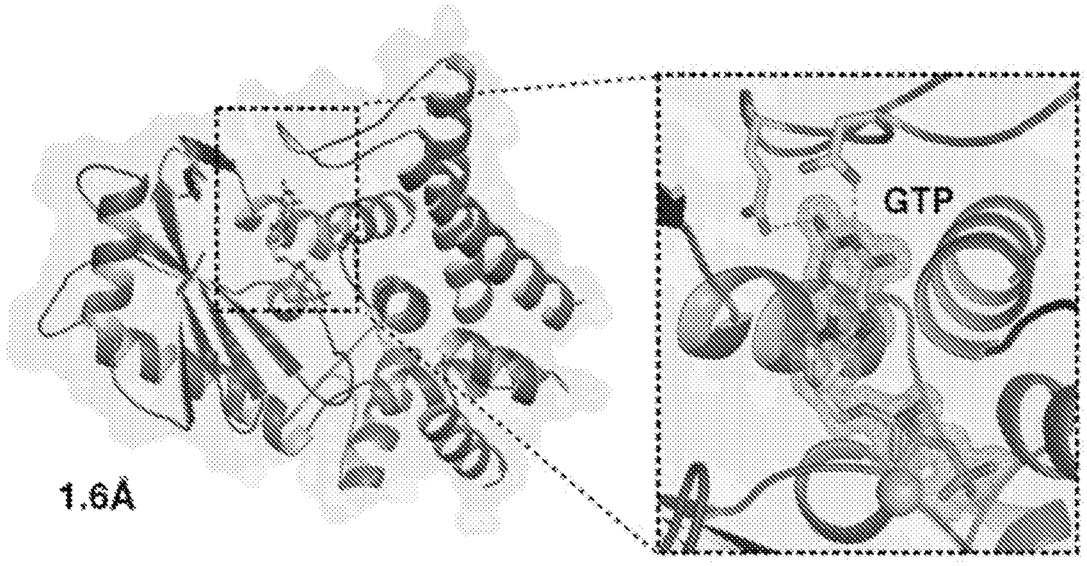

DncV and CdnE evolved from a common ancestor but exhibit dramatic divergence in primary amino acid sequence. It was believed that these enzymes comprise only a small fraction of existing bacterial CD-NTase diversity, and that kingdom-wide analysis of the protein family would allow systematic identification of bacterial second messenger nucleotides as well as agonists/antagonists of the innate immune system. Accordingly, bioinformatic analysis was coupled with a large-scale, forward biochemical screen to directly uncover additional nucleotide second messengers. Previously, Burroughs et al. used a hidden Markov model derived from cGAS and DncV to identify ~1,300 potentially related bacterial proteins (Burroughs et al. (2015) *Nucleic Acids Res* 43:10633-10654). Based on this previous analysis and the CdnE findings, >5,600 unique bacterial enzymes predicted to share common CD-NTase structural features were identified (FIGS. 8A and 9A). CD-NTases were identified in >16,000 bacterial genomes, and within taxa that span nearly every bacterial phylum (FIG. 9B). Bacteria harboring CD-NTase genes include human commensal organisms (e.g., Clostridiales, and Fusobacteria), human pathogens (e.g., *Listeria, Shigella*, and *Salmonella* species), extremophiles, and agriculturally significant bacteria (e.g., *rhizobia* commensals and plant pathogens such as *Xanthomonas*). Sequence alignments revealed that CD-NTases cluster into roughly eight family clades that were designated A-H starting with A for the DncV-harboring clade, E for the CdnE containing clade, and continued to the letter H. The structure and nucleotide products of CD-NTase in clade D are shown in FIGS. 15A-15C. Highly-related sequences were further divided into clusters, and bacterial species that occupy a similar niche were often grouped, such as plant *rhizobia* in cluster G10 (FIG. 8A and Tables 4A-4C). A unifying characteristic of almost all CD-NTase-encoding genes is their location within similar operons in predicted mobile genetic elements (FIG. 9C).

66 CD-NTase proteins were purified and each tested for nucleotide second messenger synthesis (FIGS. 8A and 10A-10D). These proteins were selected as type enzymes from each cluster based on the relevance of the organism from which they were isolated (pathogens, commensals, and bacteria predicted to interact with eukaryotes) and the frequency at which each sequence has been re-isolated from multiple organisms. Recombinant proteins successfully purified were screened using a broad range of reaction conditions to identify robust activity. For some individual CD-NTase clusters, despite encoding an intact active site, no activity was observed from any representative, indicating that these clusters can function similar to human cGAS and OAS1 where a cognate ligand (e.g., dsDNA and dsRNA) is required to stimulate enzyme activity, or that these clusters utilize building blocks other than ribonucleotide triphosphates for second messenger synthesis.

The 16 most active CD-NTases were selected for in-depth analysis (FIGS. 8B and 8C). The previous results established that cyclic dipurine and cyclic purine-pyrimidine hybrid molecules migrate at the bottom and middle of PEI-cellulose TLC plates, respectively. In the collection of active CD-NTase representatives, several enzymes produced products that migrated at the top of the plate, even more rapidly than cUMP-AMP. Further biochemical analysis of CD-NTase057 (renamed Lp-CdnE02) from *Legionella pneumophila* demonstrated that this class of PEI-cellulose TLC species corresponded to dipyrimidine CDNs, and Lp-CdnE02 synthesized predominantly c-di-UMP (FIGS. 8B-8F and 11A-11E). Lp-CdnE02 also harbors an asparagine residue analogous to N166 of Rm-CdnE, a feature found in nearly all CD-NTases in clade E but not found in other clades. Mass spectrometry of each CD-NTase reaction coupled with NTP substrate dependency profile and TLC data helped identify the products produced by different CD-NTases and estimate their abundance (FIG. 8F). The 16 active, representative enzymes produced 7 purine, pyrimidine and purine-pyrimidine hybrid cyclic dinucleotide combinations, demonstrating that CD-NTase enzymes synthesize an extraordinarily diverse array of bacterial second messengers (FIG. 8F).

Example 6: Cyclic Trinucleotides are Second Messengers

Paradoxically, it was unexpected that CDNs would be identified by mass spectrometry in some reactions despite visualizing prominent product formation by PEI-cellulose TLC. Using orthogonal TLC conditions, these unknown products exhibited distinct migration patterns that indicated existence of unique non-CDN second messengers (FIGS. 8C and 8F). An orphan product of Ec-CdnD02 from *Enterobacter cloacae* was focused on for biochemical deconvolution and identification. The Ec-CdnD02 product initially appeared to be a cyclic dipurine by PEI-cellulose TLC, but the majority of the Ec-CdnD02 product displayed a unique migration pattern when analyzed by silica TLC (FIGS. 5A and 13A). ATP and GTP were necessary and sufficient for product formation, however, roughly two thirds of the total [$\alpha$-$^{32}$P] was incorporated from ATP and the remaining third from GTP. Consistent with this pattern, re-evaluation of the mass spectrometry data and subsequent biochemical and NMR validation revealed that cyclic AMP-AMP-GMP (cAAG), a cyclic trinucleotide, is the major product of Ec-CdnD02 (FIGS. 12B and 13B-13J).

Similar to cUMP-AMP, the bacterial cyclic trinucleotide cAAG escaped STING recognition but was detected by RECON, confirming the new definition of STING and RECON ligand specificity (FIGS. 12C-12E and 13E). A 1.1 Å co-crystal structure of RECON in complex with the Ec-CdnD02 cyclic trinucleotide product was next determined (FIG. 12F and FIG. 17). The structure further confirmed that the bacterial cyclic trinucleotide is cAAG and contains exclusively 3'-5' phosphodiester linkages. The two adenine bases are coordinated in the same adenine and nicotinamide pockets observed in the previous structure of RECON bound to bacterial c-di-AMP (McFarland et al. (2017) Immunity 46:433-445), but unexpectedly RECON E28 makes additional contacts with the third guanine base of the cAAG species as part of an extended base platform not required for CDN recognition. E28 is highly conserved, potentially indicating that RECON has evolved to allow recognition of additional bacterial or host cyclic trinucleotide species.

This unexpected class of nucleotide second messenger reveals that CD-NTase active sites are capable of synthesizing larger cyclic oligonucleotide products, and that host immune receptors are capable of recognizing bacterial cyclic trinucleotides species. Recently, cyclic oligoadenylate synthesized by Cas10 was demonstrated to be a key signaling molecule in type III CRISPR immunity (Kazlauskiene et al. (2017) Science 357:605-609; Niewoehner et al. (2017) Nature 548:543-548). Although CD-NTases have no homology with Cas 10, these parallel findings indicate that larger cyclic oligonucleotide products are therefore more common in bacterial signaling and host recognition than previously expected.

Example 7: CD-NTases in health and disease

Data presented here showed that CD-NTases are widely distributed and CD-NTases synthesize nucleotide second messengers with extraordinary biochemical diversity. Along with the GGDEF (SEQ ID NO: 3) and DAC/DisA domains responsible for c-di-GMP and c-di-AMP synthesis in diverse bacterial phyla (Jenal & Lori (2017) *Nat. Rev. Micro.* 325:279; Corrigan & Grundling (2013) *Nat. Rev. Micro.* 11:513-524), CD-NTases now represent a third major enzymatic family responsible for nucleotide second messenger synthesis. Recent evidence indicats divergent GGDEF family ("GGDEF" disclosed as SEQ ID NO: 3) enzymes produce 3'3' cGAMP in addition to c-di-GMP (Hallberg et al. (2016) *Proc. Natl. Acad. Sci. U.S.A.* 113:1790-1795), indicating that the selective pressures that drive CD-NTase product diversity are also in effect for GGDEF (SEQ ID NO: 3) and DAC/DisA-like synthases. In bacteria, CD-NTases are found in similar operons and their shared location in mobile genetic elements indicates a unifying function. CD-NTase products have cognate receptors in mammals, and CD-NTase genes can provide a selective advantage for some bacterium-eukaryote interactions. The data showed that bacteria can take advantage of the limits of host immune receptor specificity, and that a single mutation in a CD-NTase enables incorporation of pyrimidines, and thus evasion or enhancement of STING signaling by modulating enzyme specificity.

Nucleotidyltransferases (such as cGAS, DncV, and CdnE) are a highly diverse superfamily of proteins that share a common fold to catalyze many different chemical reactions that are not limited to cGAMP synthesis, including DNA polymerization, tRNA modification, and nucleotide modification. Based on the results described herein, it was unexpected that DncV homologs, like CdnE, would (1) synthesize a nucleotide second messenger and (2) that messenger would be a molecule other than cGAMP, such as cyclic UMP-AMP (cUMP-AMP). Moreover, despite recognition of CdnE, a major obstacle was systematic identification of other nucleotidyltransferases capable of catalyzing similar reactions. The crystal structure of CdnE was determined to understand the core protein motifs necessary for cUMP-AMP synthesis and compared these data against information for cGAMP synthesis. These observations allowed for the identification of a cGAS/DncV-like nucleotidyltransferase (CD-NTase) family of proteins and unified nucleotidyltransferases capable of second messenger synthesis, such as the surprising finding that a subset of CD-NTases synthesize cyclic trinucleotides, a new class of nucleotide second messenger.

Example 8. CD-NTases are Encoded in Conserved Operons on Mobile Genetic Elements A unifying characteristic of almost all CD-NTase-encoding genes is their location within similar operons in predicted mobile genetic elements (FIG. 9C). Often genes encoding identical CD-NTase proteins are found in unrelated bacterial species, but only in specific strains, reflecting that these genes are members of the "mobilome" and unlikely to be members of core bacterial genomes.

The ordinarily skilled artisan can identify CD-NTases within an organism of interest based on the state of the art and the present disclosure. For example, several methods to locate CD-NTases in a given strain or identify specific strains/organisms that encode a CD-NTase of interest are shown as follows. If a given bacterial strain encodes an already annotated CD-NTase, the CD-NTase can be identified by downloading the Tables 4A-4C. Strain names, organism species, or other database identifiers can be searched in these tables. These tables can also be searched for a specific CD-NTase to identify bacterial strains encoding that gene. Upon locating the bacterial strain/gene, the associated NCBI accession number can be used to further locate sequence, ordered locus, and genomic information. Table 4A provides information on specific enzymes screened in FIGS. 8A-8C and FIGS. 10A-10E. Table 4B provides information on every CD-NTase sequence used for phylogenetic analysis, protein alignment construction, and FIG. 8A. These data represent the total sequence diversity of CD-NTases but each record may represent multiple bacterial isolates encoding identical proteins. The left-most column represents the order of CD-NTases in the alignment/tree and proceeds clockwise from "G". Table 4C provides a list of all records of CD-NTases found within the Identical Protein Groups tool at NCBI. This list is semi-redundant but contains complete strain and organism specific identifiers.

CD-NTases within any given organism can also be identified by conserved domain. For example, one can browse for the conserved domains that describe CD-NTase family proteins using Pfam domains: Mab-21 protein domain (PF03281), PAP_central domain (PF04928), N-terminal Pol-β-like nucleotidyltransferase core domain (PF14792 and PF01909), C-terminal OAS1_C domain (PF10421), and C-terminal tRNA-NucTransf2 domain (PF9249); Eukaryotic Orthologous Groups (KOG) database: KOG3963, KOG2245, KOG3792, and KOG37933; Clusters of Orthologous Groups (COG): COG5186, COG1746, COG1665, and COG1669; and NCBI conserved domain database: CD05402, CD05400, and CD5397.

An additional method of identifying CD-NTase genes encoded by an organism of interest is to BLAST the complete list of type CD-NTases using their NCBI identifiers, found in Table 4A using the following steps. A complete list of type CD-NTase identifiers (WP_001901330.1, WP_001593454.1, WP_023121145.1, WP_016849025.1, WP_020363757.1, WP_031517737.1, KDD27955.1, WP_032579276.1, WP_016268104.1, WP_012995826.1, WP_000058223.1, WP_017897513.1, WP_023633898.1, WP_002302472.1, WP_044727581.1, WP_000995828.1, WP_005836899.1, WP_026109030.1, EFJ98156.1, WP_001534692.1, WP_023223657.1, WP_005110610.1, YP_635404.1, WP_003090158.1, WP_001279388.1, WP_000246637.1, WP_031517014.1, WP_000246636.1, EIQ80517.1, WP_044779457.1, WP_008409465.1, WP_002106335.1, WP_000019626.1, WP_000763718.1, WP_003305997.1, WP_009895113.1, WP_043964485.1, EEH69894.1, WP_032676400.1, NP_766712.1, WP_023727438.1, WP_004556387.1, WP_032942206.1, WP_001056752.1, WP_031656629.1, WP_044359458.1, WP_013858317.1, WP_015376200.1, EKS31071.1, WP_006018769.1, WP_008253492.1, WP_012997810.1, WP_023568228.1, WP_000072410.1, WP_017790128.1, WP_006482377.1, WP_001593458.1, WP_042646516.1, WP_041847730.1, WP_000899483.1, WP_062726309.1, WP_054878246.1, WP_009654824.1, EGH79124.1, WP_009929206.1, WP_000102010.1, WP_002347527.1, WP_014072508.1, WP_016200549.1) is copied and pasted in to the box "Enter accession number" using a BLAST-P search (available on the World Wide Web at blast.ncbi.nlm-.nih.gov/Blast.cgi). The organism and strain to search in the query box is defined as "Organism" and the "BLAST" button is clicked.

Additionally, ordinarily skilled artisan can classify the clade association of a newly described CD-NTase. For example, the CD-NTase amino acid sequence of interest can be aligned to the sequences in Table 4B. A newly described CD-NTase(s) is compared to neighboring proteins based on alignment. A CD-NTase is considered a member of a clade/cluster if it shares >24.5% amino acid identity with other members of that clade/cluster.

The horizontal acquisition of CD-NTases indicates that they provide a selective advantage but do not function to alter species-specific nucleotide signaling networks and instead alter bacterial physiology via receptors adjacently encoded, similar to capV-dncV and capE-cdnE. Burroughs et al. noted that genes adjacent to CD-NTases are generally involved in biological conflict, including phospholipases, nucleases, and pore-forming agents (Burroughs et al. (2015) *Nucleic Acids Res* 43:10633-10654). Coexpression of dncV and capV is toxic to *E. coli* (Severin et al. (2018) *Proc. Natl. Acad. Sci. U.S.a.* 115: E6048-E6055) and it was tested if coexpression of each CD-NTase with its adjacently encoded, putative receptor was also toxic to *E. coli*. Expression of dncV-capV was unique in inhibiting colony formation, and other CD-NTase-predicted receptor pairs, including the active cdnE-capE pair, did not impair bacterial growth (FIGS. 9D and 9E). These findings demonstrate that phenotypes observed with *Vibrio* dncV-capV are not indicative of general CD-NTase function, and that CD-NTase-containing islands perform another function(s) such as mediating bacteriophage resistance or modulating bacterial-host interactions.

Lengthy table referenced here

US12545900-20260210-T00001

Please refer to the end of the specification for access instructions.

Lengthy table referenced here

US12545900-20260210-T00002

Please refer to the end of the specification for access instructions.

Lengthy table referenced here

US12545900-20260210-T00003

Please refer to the end of the specification for access instructions.

Lengthy table referenced here

US12545900-20260210-T00004

Please refer to the end of the specification for access instructions.

INCORPORATION BY REFERENCE

All publications, patents, and patent applications mentioned herein are hereby incorporated by reference in their entirety as if each individual publication, patent or patent application was specifically and individually indicated to be incorporated by reference. In case of conflict, the present application, including any definitions herein, will control.

Also incorporated by reference in their entirety are any polynucleotide and polypeptide sequences which reference an accession number correlating to an entry in a public database, such as those maintained by The Institute for Genomic Research (TIGR) on the World Wide Web at tigr.org and/or the National Center for Biotechnology Information (NCBI) on the World Wide Web at ncbi.nlm.nih.gov.

EQUIVALENTS

Those skilled in the art will recognize, or be able to ascertain using no more than routine experimentation, many equivalents to the specific embodiments of the invention described herein. Such equivalents are intended to be encompassed by the following claims.

LENGTHY TABLES

The patent contains a lengthy table section. A copy of the table is available in electronic form from the USPTO web site (https://seqdata.uspto.gov/docdetail?docId=US12545900B2). An electronic copy of the table will also be available from the USPTO upon request and payment of the fee set forth in 37 CFR 1.19(b)(3).

SEQUENCE LISTING (5884 sequences)

SEQ ID NO: 1 - protein, 16 aa, Artificial Sequence
  Description of Artificial Sequence: Synthetic peptide
  MOD_RES (4)..(13): Any amino acid
GSYXXXXXXXXXXDVD

SEQ ID NO: 2 - protein, 89 aa, Artificial Sequence
  Description of Artificial Sequence: Synthetic polypeptide
  MOD_RES (4)..(13): Any amino acid
  MOD_RES (17)..(88): Any amino acid
GSYXXXXXXXXXXDVDXXXXXXXXXXXXXXXXXXXXXXXXXXXXXXXXXXXXXXXXXXXXXXXXXXXXXXXXXXXXXXXXXXXXXXXXD

SEQ ID NO: 3 - protein, 5 aa, Artificial Sequence
  Description of Artificial Sequence: Synthetic peptide
GGDEF

SEQ ID NO: 4 - protein, 436 aa, Vibrio cholerae
MRMTWNFHQYYTNRNDGLMGKLVLTDEEKNNLKALRKIIRLRTRDVFEEAKGIAKAVKKSALTFEIIQEKVSTTQIKHLSDSEQREVAKLIYEMDDDARDEFLGLTPRFWTQGSFQYDTLNRPFQPGQEMDIDDGTYMPMPIFESEPKIGHSLLILLVDASLKSLVAENHGWKFEAKQTCGRIKIEAEKTHIDVPMYAIPKDEFQKKQIALEANRSFVKGAIFESYVADSITDDSETYELDSENVNLALREGDRKWINSDPKIVEDWFNDSCIRIGKHLRKVCRFMKAWRDAQWDVGGPSSISLMAATVNILDSVAHDASDLGETMKIIAKHLPSEFARGVESPDSTDEKPLFPPSYKHGPREMDIMSKLERLPEILSSAESADSKSEALKKINMAFGNRVTNSELIVLAKALPAFAQEPSSASKPEKISSTMVSG

SEQ ID NO: 5 - DNA, 1311 bp, Vibrio cholerae
gtgagaatgacttggaactttcaccagtactacacaaaccgaaatgatggcttgatgggcaagctagttcttacagacgaggagaagaacaatctaaaggcattgcgtaagatcatccgcttaagaacacgagatgtatttgaagaagctaagggtattgccaaggctgtgaaaaaaagtgctcttacgtttgaaattattcaggaaaaggtgtcaacgacccaaattaagcacctttctgacagcgaacaacgagaagtggctaagcttatttacgagatggatgatgatgctcgtgatgagtttttgggattgacacctcgcttttggactcagggaagctttcagtatgacacgctgaatcgcccgtttcagcctggtcaagaaatggatattgatgatggaacctatatgccaatgcctatttttgagtcagagcctaagattggtcattctttactaattcttcttgttgacgcgtcacttaagtcacttgtagctgaaaatcatggctggaaatttgaagctaagcagacttgtgggaggattaagattgaggcagagaaaacacatattgatgtaccaatgtatgcaatccctaaagatgagttccagaaaaagcaaatagctttagaagcaaatagatcatttgttaaaggtgccatttttgaatcatatgttgcagattcaattactgacgatagtgaaacttatgaattagattcagaaaacgtaaaccttgctcttcgtgaaggtgatcggaagtggatcaatagcgaccccaaaatagttgaagattggttcaacgatagttgtatacgtattggtaaacatcttcgtaaggtttgtcgctttatgaaagcgtggagagatgcgcagtgggatgttggaggtccgtcatcgattagtcttatggctgcaacggtaaatattcttgatagcgttgctcatgatgctagtgatctcggagaaacaatgaagataattgctaagcatttacctagtgagtttgctaggggagtagagagccctgacagtaccgatgaaaagccactcttcccaccctcttataagcatggccctcgggagatggacattatgagcaaactagagcgtttgccagagattctgtcatctgctgagtcagctgactctaagtcagaggccttgaaaaagattaatatggcgtttgggaatcgtgttactaatagcgagcttattgttttggcaaaggctttaccggctttcgctcaagaacctagttcagcctcgaaacctgaaaaaatcagcagcacaatggtaagtggctga

SEQ ID NO: 6 - protein, 432 aa, Escherichia coli
MPWDFNNYYSHNMDGLISKLKLSKTESDKLKALRQIVRERTRDVFQEARQVAIDVRRQALTLESVRLKLEKTNVRYLSPEERADLARLIFEMEDEARDDFIKFQPRFWTQGSFQYDTLNRPFHPGQEMDIDDGTYMPMTVFESEPSIGHTLLLLLVDTSLKSLEAENDGWVFEEKNTCGRIKIYREKTHIDVPMYAIPKEQFQKKQTAADSAHLIKSDSVFESFALNRGGREAYAVESDKVNLALREGVRRWSVSDPKIVEDWFNESCKRIGGHLRSVCRFMKAWRDAQWEVGGPSSISLMTAVVNILDRESHNGSDLTGTMKLIARLLPEEFNRGVESPDDTDEKPLFPAESNHNVHHRAIVETMEGLYGILLAAEQSESREEALRKINEAFGKRVTNALLITSSAAAPAFLNAPSKEPSSKPINKTMVSG

SEQ ID NO: 7 - DNA, 1296 bp, Escherichia coli
atgccttgggattttaacaattactatagtcacaatatggatggcttaatcagtaagctcaaattgagcaagactgaatccgataaactcaaagcacttcgtcagatcgtacgtgaaaggacgagagatgtatttcaggaagctcgccaagtcgcaattgacgtgagaaggcaagcgctgacacttgaaagtgtcagattaaaacttgagaaaacaaacgttcgctacctctcccccgaagaacgtgctgatctagcgcgacttatttttgaaatggaagatgaagcacgcgatgacttcatcaaattccagcctcgtttctggactcaaggaagttttcagtacgatacgttaaacaggccttttcatccggggcaggaaatggatattgatgatggcacctacatgcccatgacggtgtttgaatccgaaccgagcattggacacactctgcttctccttctcgtggatacatcactgaaatcactagaagctgaaaacgatggctgggtatttgaagaaaagaatacctgcggacgcatcaaaatctatcgggagaaaacacacattgatgtaccgatgtatgcgatccctaaagaacaattccagaaaaaacaaacagcagcagattcagcacacctcataaagtcagattcggtgtttgaatcttttgcattgaaccgggggggacgcgaggcttatgccgttgagtccgacaaagtgaacctggcacttcgcgaaggggtcagaagatggtcagtcagcgaccccaaaattgttgaagactggttcaacgaaagctgtaaacgtatcggcgggcatctgcgttcagtttgccggtttatgaaggcttggcgggatgcacaatgggaagttgggggcccttcatcaatcagtctgatgactgcagtcgtcaacatcctcgatagagaatctcataatggctccgacctcaccgggacgatgaaacttattgccaggttgctgcctgaggaattcaatcgcggtgtggaaagtcccgacgatactgacgaaaaaccattgttccctgcggaaagtaaccataacgtgcaccatagagctatcgttgaaactatggaaggtctgtacggtattttacttgccgctgagcaatcagaaagtcgggaagaagcgttacgtaaaatcaacgaagcatttggtaaacgtgtgactaatgccctattaatcacgtcaagtgctgcagctccggcatttctcaatgcaccatccaaagagccatcatctaaaccaatcaacaaaacgatggtaagtggc

SEQ ID NO: 8 - protein, 380 aa, Pseudomonas aeruginosa
MLNLSPLFFTTLDDESCMHDELDLTPGQRAWIASARTDVRDCLRTGIPRVLRANGYTEDVPQPRFFTQGSWAYKTLNAPAQHPQQADVDDGCYLPMSFVSQTKRPSTAATVFFAAAEEALKPLVEERRWKLVTDKPTCIRIVIAAYAHIDIPLYAIPDEEFVTLAKASMERYGYDSLTEAVNMAERDAWTALPADKVLLAHRECNWMSSDPRPVKEWFLGEVEAKGEQFRRVVRYLKAFRDWKWSSGGPASILLMAAAAPLFEKRDRRDDLALLDVVAALPARLRGGVNNPVEESESLTERLGQAGVEDAAKAFEEFEKVLRGATGAGSPSQACIWMRGEFGPRFPNEPDRVKVVSVAATIAAAPATAGPSELVGRTKAG

SEQ ID NO: 9 - DNA, 1143 bp, Pseudomonas aeruginosa
atgctgaacttgagcccactcttcttcaccacccttgatgacgaatcctgcatgcacgacgagctggatctgacgcctgggcagcgcgcctggatcgccagcgcacgcactgacgtcagggactgcctgcgcacaggcatcccccgcgtgcttagggcaaacggatacacggaagacgtgccgcagccgcgcttcttcacgcaagggtcgtgggcatacaagacgctgaacgccccggcacaacaccctcagcaggcggatgtcgatgatggctgctatctgccaatgagtttcgtctcgcagacgaagcgtcccagcactgcggcgacggtgttctttgccgctgcggaagaagcattgaagccgctggtcgaggaaaggcggtggaagcttgtcaccgacaagccgacctgcatccgcatcgtcattgctgcgtatgctcacattgatattcctctgtacgccattcccgacgaggaatttgtcacgctcgcaaaggcttcgatggagcgatatggctacgactcgctgacggaagcggtgaacatggcagagcgcgatgcctggaccgcgctgccggctgacaaggttctcctggcccatcgtgaatgcaattggatgtcctctgacccgaggcccgtgaaggaatggttcctgggcgaagtggaagccaagggggagcaattccgccgcgtggttcgctacttgaaggcgttccgcgattggaagtggtccagcggaggacctgcctcgatcctgttgatggccgccgcggccccgctctttgagaaacgcgataggcgcgacgacctcgctctgctggatgtcgtcgcggcactgccagcccggttgcgtgggggagtgaacaaccccgtggaagagtccgaatcgctcacggagcgacttggccaagcgggtgtcgaagatgcggccaaagcattcgaagagtttgagaaggtgcttcgcggagcaaccggcgccggcagtccttcacaggcctgcatctggatgcgaggcgaattcggcccgcgttttccgaacgagccggatcgggtcaaggtggtatccgttgccgccaccattgccgcagctcccgccaccgccggcccgagcgaacttgtcgggcgaacaaaggctggatga

SEQ ID NO: 10 - DNA, 1140 bp, Artificial Sequence
  Description of Artificial Sequence: Synthetic polynucleotide
atgcttaatttgtcacccttgttttttaccactttagacgatgagagctgtatgcatgatgagttggatttgactcctgggcagcgcgcctggatcgcgtctgcgcgcactgatgtacgtgattgtcttcgtacggggattccacgtgttttacgcgcaaacggttatactgaagacgtgccgcagcctcgctttttcacccagggctcctgggcttacaagaccttgaatgcacctgcacaacatccacaacaggcagatgtggatgacggatgctatttgccaatgtctttcgtctcgcaaaccaaacgtccctcaacggctgctacagtcttcttcgccgcggcagaggaggctttaaagccgcttgttgaagaacgtcgctggaaacttgtgaccgataagcccacctgtatccgtattgtgattgccgcctacgcacacatcgatattcccctttatgccatcccggacgaggagttcgtgacattggcgaaagcatctatggaacgttacgggtatgattctcttactgaagcagtcaatatggctgagcgtgatgcttggaccgcactgccggcggacaaagttttgctggctcaccgtgaatgcaactggatgtcttcggacccccgtccagtaaaggagtggttcttgggcgaagtcgaagcgaagggtgagcaatttcgtcgcgtggttcgctacctgaaagcattccgcgactggaagtggtcgagcggaggtcctgctagtattcttctgatggccgcagcggccccgttgtttgaaaaacgcgaccgccgcgatgacttggctttactggatgtagtagccgcgttgcccgcccgtttacgcgggggtgttaataaccctgtggaagaatctgagagcttgacggaacgtttaggtcaggccggagtggaggacgcagccaaagcgttcgaagaattcgaaaaggtcttacgtggtgcaacgggtgctgggtcaccctctcaggcttgtatctggatgcgcggggagttcgggccccgctttcctaacgaaccggatcgtgtaaaggtagtgtcggtggcagcgaccatcgcggcggctcccgcgaccgcaggcccatcggagttagttgggcgtacaaaggcaggc

SEQ ID NO: 11 - protein, 378 aa, Xanthomonas citri
MLNLSPLFFTTVDNRTCLHGALDLEDAQRTYIAQARLDVRNCLRAGIPAILKAHGYPGQVPTPRFFTQGSWAYKTLNAPAKPPQQADVDDGCYLPMGFVSQSNRPSVAAGVFFQAAEAALQPLVDQNKWQLVTDKDTCIRIVIAKDAHIDIPLYAIPDEEFVTLAKAFESRGIAMDSITFAEEEDVWTKLPRYKVLLAHRQENWKVSDPRPVKEWFLSEVEAKGEQFRRTVRYLKAYRDWHWESGGPSSILLMAAAAPLFEKHDSRDDLALLAVVEKLSDALREGVSNPADTSESLTERLGAVGVEDAAKAYESFAIMLRGAIHASKASQACAWMRHEFGSRFPDDPERVKVVSVASSIASSSAIAGPSELIGRSKAG

SEQ ID NO: 12 - DNA, 1137 bp, Xanthomonas citri
atgctgaacttgagcccgctgttcttcactaccgttgacaatcggacctgtctgcatggtgcgctggacttggaggatgcgcaacgcacctacatcgcccaagcacgcctagatgtccgcaactgtctgcgcgcaggcatcccggcgattctgaaagcacatggctatccaggccaagtgccaacgccccgctttttcacccaagggtcctgggcctacaagaccctcaacgcgcccgccaaaccgccgcagcaagcagatgtcgatgacggctgctatctgccgatgggctttgtctcgcagagcaaccggccaagcgttgcggccggagtcttcttccaagctgcagaagcggcgctccaacccttggtcgaccagaacaagtggcagttggtcactgataaggacacctgcatccggatcgtgatcgccaaggatgcccatatcgacatccccctttacgccattcctgacgaggagttcgtcactctggctaaggcgtttgagagccgtggaatagccatggactcgatcacctttgctgaggaggaggatgtctggacgaagctacctcgttacaaagtgctcctggctcatcgccaagagaactggaaggtctctgatcctcgcccggtcaaggaatggttcttgagtgaagtcgaggcgaagggagagcagttccgccggacagttcgctatctcaaggcttaccgggattggcactgggaaagcggtggcccgtcttcgatccttttgatggcagcggcagccccgttgtttgaaaagcacgatagccgtgatgatttggccttgctcgctgtggtggagaagctttcagacgccttgcgagagggggttagcaatcctgcagataccagtgaatctttgaccgagcgtcttggtgccgtaggtgttgaggatgctgcgaaggcttatgagagtttcgcgatcatgctgcgtggcgcgattcatgcatccaaggcctcgcaggcatgcgcttggatgcgtcatgaatttggatcccgctttccagacgatccggagagggtcaaggttgtctccgtcgcgagcagcatcgcatcgtcctccgctatcgctggcccaagcgaactcatcggacgctccaaggccggatga

SEQ ID NO: 13 - DNA, 1134 bp, Artificial Sequence
  Description of Artificial Sequence: Synthetic polynucleotide
atgcttaacctgagccccttattttttactacagtcgacaaccgtacatgtttacatggagcattggatttagaggacgcgcagcgtacatatatcgcccaggcgcgcttggacgttcgcaactgtttgcgtgcaggcattccagctatcctgaaagcacatggctatccagggcaggtccccacgccacgctttttcacgcaggggtcttgggcttataagactcttaatgccccagcaaaaccaccgcagcaagctgatgtagatgacggatgttatttgccaatgggcttcgtttctcaaagcaatcgcccttcggttgctgctggcgttttttttcaagcagcggaagccgcgttgcaaccactggtggatcaaaataaatggcaacttgttaccgataaagacacatgtattcgtattgttattgctaaggatgcccatattgatatccccttatacgcgattcccgacgaagagttcgtaactcttgccaaggcgtttgagagtcgcggtattgccatggattcaattacgttcgccgaagaagaggatgtgtggacgaagctgccgcgctacaaagtgttgcttgcgcaccgtcaggaaaattggaaagtgagtgatcctcgcccagtcaaagaatggttcttgtctgaggtggaagcaaaaggagagcaattccgtcgcactgttcgctacttgaaagcgtatcgtgactggcactgggagtccggtggtccttcaagcatcctgctgatggccgcagctgctccgctttttgagaagcacgactctcgtgatgatcttgcgctgttggcggtagtcgaaaagttatcagatgcattacgtgagggagtttctaacccggcagatacgagcgaatcacttaccgaacgccttggtgctgtcggggttgaagacgcagctaaggcgtatgagagtttcgccattatgttacgcggggctattcatgcttccaaggcttcacaagcgtgtgcctggatgcgtcacgagtttggctcacgctttcctgatgacccagaacgcgtgaaggtggtctctgtagcatcatcaatcgcctcctcctcggctattgcagggccgtccgaattgattgggcgcagcaaggccggg

SEQ ID NO: 14 - protein, 460 aa, Staphylococcus epidermidis
MYDCSKEFSTFYRKKVVLSAKEQDELRKRRKQNIRRIKDGLNEYNEEKKTSYKISEDRIQGSMAMHTITQNDEKDYDIDVGIVFEADCLNSLGAQATRNMVANALERKTRQFAQPPEVKTSCVRLKYSSLGYHMDFAVFQRSKEYEWDDNYIYEHAGTEWTERHIKALEEWFINRVKYSGDDLRKIVRLSKMFCKSRDSWKNMPSGLVQTILCDSKLKNYYSRLDEKFYYTMQAIVQRLDIHLDVNAPVDNGRELIIRDVDYKRMENWKNRLRASLNKLDILFDKECSREDALQAWALFFNHSYWEELAEQNQRSNISESRFLSFNDTEQFIEELYPIYENYNVSIDCDVSGNGFSVMPIEKFFDKLSPQLKRFIPYNFSIRCRLGDTDCPTYDKILWKVRNIGIEAEKRNCIRGQIVDNRGTEIIENSNFAGLHYIECYLIKNDICVGIGHVDIPIGGI

SEQ ID NO: 15 - DNA, 1383 bp, Staphylococcus epidermidis
atgtatgattgctcaaaggaattcagtactttttatcgtaaaaaagtcgtactttctgctaaagaacaggacgaactaagaaaaagaagaaaacagaatattagaaggattaaagatgggttaaatgaatataatgaagagaaaaaaacaagttataaaatttcagaggaccgtattcaaggtagcatggctatgcataccattacgcagaatgacgagaaggactatgatattgatgtaggtatagtatttgaagcagattgtctaaatagtttgggtgcacaagctactcgtaatatggtagcaaacgctcttgaaagaaaaactaggcaatttgcacaaccacctgaagtaaagactagttgtgtacgtttaaagtatagttctcttggttatcatatggactttgctgtattccaacgtagtaaagaatatgagtgggacgataattatatatatgagcatgcagggacagaatggacagaaagacacattaaggcattagaagagtggttcattaatcgagtaaagtattctggtgatgatttacgtaaaatagtgagattgtccaagatgttctgtaaatcaagggatagttggaaaaatatgccgagtggacttgttcaaacgatattatgtgactcaaagctaaaaaactattattcacgcttagatgagaaattttattacactatgcaagctattgtgcagcgtctggatattcacctcgatgttaacgctcctgtcgataatgggagagagctaataattagagatgttgattataagcgaatggagaattggaaaaatcgattgagagcgagtctaaataagttggacatactttttgataaggaatgctcgcgagaagatgctctgcaagcttgggcattgtttttcaatcattcttattgggaggaattagccgaacaaaatcaaagaagcaatattagtgagagtcgtttcctaagtttcaatgatactgagcaatttatagaagaactatatccgatttatgaaaactataatgtttccatagactgtgatgtttcaggtaatggtttttctgttatgccgattgagaagttttttgataaactctctccacaacttaaaaggtttattccatataatttttctattaggtgtaggctcggggatactgattgtccgacctatgataaaattctttggaaggttaggaatatcggtattgaagctgaaaagcgaaattgtataagaggacagatagtagacaataggggtactgaaattatagagaattcaaattttgcaggattacattatatcgaatgttatttaattaaaaatgacatatgcgtaggtataggtcatgtagatataccaataggaggtatttaa

SEQ ID NO: 16 - DNA, 1380 bp, Artificial Sequence
  Description of Artificial Sequence: Synthetic polynucleotide
atgtacgattgctccaaggaatttagcacgttctatcgtaagaaagttgtgttgtctgccaaagaacaagacgaacttcgcaagcgtcgtaaacaaaatattcgtcgtattaaggatggactgaatgagtataatgaggaaaagaagacgagttacaaaattagtgaagatcgtatccagggaagtatggccatgcatactatcacccaaaacgacgaaaaagattacgatattgacgttggaattgtgtttgaagcagattgtcttaatagtttaggggcccaagcaacacgtaacatggttgcaaatgctcttgaacgcaagacacgtcagtttgctcagcctcctgaagtcaaaacttcttgcgtacgtcttaaatactcctcgttggggtatcacatggattttgccgtgtttcagcgcagtaaggagtatgagtgggatgataattatatttacgaacacgccgggaccgaatggacggagcgtcatattaaggctttggaagaatggtttattaatcgtgtgaaatactcgggtgacgatttgcgtaagattgtacgtttatctaaaatgttttgcaagagtcgtgattcctggaagaatatgccgagtggactggtccaaactatcctttgtgactcgaaacttaaaaattactattcccgcttggacgagaaattctattatacgatgcaagctatcgtacagcgtctggacattcatctggacgtaaatgcccctgtggacaatggacgtgaattaatcatccgcgatgtagattataaacgtatggagaattggaaaaaccgtctgcgcgcttcgcttaataaacttgatattctgttcgataaagagtgtagtcgtgaggatgctttacaggcatgggctttattctttaatcatagctactgggaggagcttgcggaacagaaccaacgcagtaacatctccgaatcacgctttttaagttttaatgacacagaacagtttattgaagagttatacccgatctatgagaattacaacgtttcaatcgattgcgatgtctcggggaatggtttctcagtgatgccaattgagaagttctttgataagctttccccacaactgaagcgtttcattccatacaactttagcatccgctgccgtcttggcgacaccgactgcccaacttatgataaaattctttggaaggtacgcaacatcggaattgaagccgaaaagcgcaactgcattcgtggacagattgtggataaccgcgggacagaaattattgagaacagtaacttcgcaggcttacattatatcgagtgctatcttattaaaaatgacatctgcgttggaatcgggcacgtggacatcccgattggcggaatc

SEQ ID NO: 17 - protein, 455 aa, Desulfotomaculum alkaliphilum
MFDLETEFNIFYRDYVVLSKDEKQNLYNKKDLNLDRLKDGLQEYNEEKKTEYKIKDNVVQGSVAMSTVTQNDKHDYDIDVAVIFDKDNIPSGTTAVKNIVVNSLKKKCKQFKTEPEAKTNCVRVAYEEGYHIDFAVYRRFKNDSDEFEYEHCGSEWSKRDPRTITNWFIENNKAQDYKLRKIVRLLKMFCKSREHWVMPGGLIHTVLVVECFEPNDRIDKSFYNTIKATRDRLKNDKEVKNPVDDSLSLIIKESDKTKVENLYNRLSTYIDKLDILFTDGCTKEQAIEAWNDFFNHSYWSDLLTEDTQKANESAYCATETFPECDETEEFIEHIYPIDIKYDLNINCRVTQDGWRTKLLRSMLRLKEPLRLNKNLEFFIEGTNVPPPYKVFWKVRNIGDVAEQKNCIRGQIVEDKGKNTKKEETSFRGPHFVECYIVRYGVCVARSRIDVPINIL

SEQ ID NO: 18 - DNA, 1368 bp, Desulfotomaculum alkaliphilum
ttgtttgatttagagacagagtttaacatattttatagagattatgttgtgctttcgaaagatgagaaacaaaatctatataataaaaaggatctaaatttagatagacttaaagatggtctacaggagtacaatgaggaaaaaaagacagaatataaaataaaggacaatgtagttcagggtagcgtggcaatgtctacggtaacacagaatgataaacatgattatgatattgatgtagcagtaatttttgataaagataatattccctcaggaactacagctgttaaaaacatagttgtaaactcattaaagaaaaaatgtaaacaatttaaaactgaacctgaggcaaaaactaattgtgtaagggtggcatatgaagagggataccatatagattttgctgtgtatagacggtttaaaaatgattctgatgaatttgaatatgaacactgtggaagcgagtggagtaaaagggacccaagaacaattactaactggtttattgaaaacaataaggctcaggactataaactaagaaaaattgtgagactgttaaagatgttttgcaaatcaagggaacattgggttatgccaggtggcttgattcatacagtattagttgtagaatgttttgaacctaatgatagaatagataaatctttttataatacaataaaagcaacaagagatagattaaaaaatgataaagaagtcaaaaatcctgttgatgatagcttgagtctcattataaaagaaagtgataaaactaaagttgaaaacctttataacagattatcgacatatatagataaattagatattttatttactgatggttgtacaaaggagcaagctattgaggcgtggaatgatttttttaaccactcttattggagtgatttattaaccgaagatactcaaaaagcaaatgagtctgcatattgcgctactgaaacttttcctgaatgtgatgaaacagaagagtttattgaacatatttaccccatcgatattaaatatgacttaaatattaattgtcgtgtcacgcaggatggttggagaacaaaattactaagaagtatgctgagattaaaagaaccactgaggctaaataagaatcttgaattcttcattgaaggaactaatgtgcctcccccatataaagttttttggaaggtgaggaatataggggatgttgcagagcagaaaaactgtattaggggacaaattgtagaggataagggtaagaacactaaaaaggaggaaacctcttttagggggcctcactttgtagaatgctatatagttagatatggggtatgcgtggcaaggagcagaatagatgtaccaataaacatattataa

SEQ ID NO: 19 - DNA, 1365 bp, Artificial Sequence
  Description of Artificial Sequence: Synthetic polynucleotide
atgtttgatctggaaacggagttcaacattttttatcgtgactatgtcgttttatcgaaggatgaaaaacaaaacttatacaacaaaaaagaccttaatctggaccgtttaaaagacggtttacaagagtataatgaggaaaaaaagacggaatataaaatcaaagacaacgttgtccaaggatctgtggcgatgtcgacggtcacccaaaacgataagcacgactacgatatcgacgttgcggttatcttcgataaagacaatatcccgagcgggactaccgcagtcaagaatattgtcgttaattcacttaaaaaaaagtgcaaacaatttaagactgaaccagaagcgaaaactaattgtgtacgtgtagcgtatgaagagggttaccacattgattttgcggtttaccgtcgttttaaaaacgatagcgacgaatttgaatatgaacactgcggctctgagtggagcaaacgcgacccacgcacaatcacaaattggttcattgaaaacaataaggcccaggattacaagctgcgcaaaatcgttcgcttattaaaaatgttttgtaaaagtcgcgagcactgggttatgccgggcggcttgattcacacagtacttgtcgttgagtgttttgaacctaatgaccgtatcgataagtcattctataataccatcaaagcaacacgcgaccgcttgaaaaatgacaaggaagttaaaaacccagtggatgactccttatctctgatcattaaggaatcagacaaaaccaaagtagagaatttatacaaccgtctttctacctatatcgacaaattggacattcttttcacagatggctgtactaaagagcaagccatcgaagcctggaatgacttctttaatcatagttactggtccgatctgttaacggaagatacacagaaagcaaatgaatcggcatattgtgctaccgaaacttttccagagtgtgatgaaactgaagaatttattgagcatatttacccaattgatatcaagtatgatctgaatatcaactgccgtgttacacaggacggatggcgtactaaattacttcgcagtatgctgcgcttaaaggagccgttgcgtttgaataaaaatctggagttttttattgagggaactaatgttcccccaccgtataaagttttttggaaagtccgcaatattggcgatgtagcagaacagaagaactgtattcgcggacaaattgttgaagataaaggcaagaatacgaagaaggaagagacgagttttcgcgggccacacttcgttgagtgctatattgttcgctatggcgtttgtgtcgcacgctcccgtattgatgtgccaattaatatcctg

SEQ ID NO: 20 - protein, 347 aa, Achromobacter xylosoxidans
MADIDCHSEMTNFHRDKVTLSNKQQGEMRTRRDAGRTRLENGLNEAKKPQPNEVRSQGSYQMRTMVQDDANDYDIDDGAYFASDDLKDNAGVALTPKAARERVCNALVWDGRLKQEATVKRNCVRQVYAAGYHIDIPVYRIITTNDENNDPVEHYELASGDEWTRSDARAVTRWFNGLVGELNSGESDGSQMRRVTKLTKKFARRSSWKDETTSGICITKLVVDHFQYSADRDDKALRETWKAIDKKLQKSTEIDHPVLATKLAQAGDAAVTFFHTCLSDALKTLEVLDTSDCTRKKAREAWDDVFDIDFFSMQPDNKDDGGGGKGSAMSVTSVETARRNDGGGRFG

SEQ ID NO: 21 - DNA, 1044 bp, Achromobacter xylosoxidans
atggctgacatcgactgccacagcgagatgacgaacttccatcgggacaaagtcacactctcgaacaagcaacaaggtgagatgcgcacgcgccgagacgcggggcgcacacgcctggagaacggcctcaacgaggccaagaagcctcaacccaatgaggtccggtcgcaggggtcgtaccagatgcgcacgatggtacaggacgatgccaacgactacgacatcgacgacggggcctacttcgcgtctgacgatcttaaggataacgcgggcgttgcgttgacgccgaaggctgcgcgcgagcgggtgtgtaatgcgcttgtgtgggatggccgccttaagcaggaggccaccgtcaagcgcaactgcgtccgccaagtctacgctgcgggctatcatatcgacatcccggtgtaccgcatcatcaccaccaacgacgagaacaacgatccggtggaacactacgaactggcaagcggtgatgagtggacacgctcagacgcacgggcggtgacccgttggttcaacggcctggtgggcgaattgaactccggcgagtcggacggcagccaaatgcggcgcgtcaccaaattgactaagaagttcgcgcgccgttcgagctggaaggacgaaacgaccagtggaatctgtatcaccaaactcgtcgttgaccattttcagtacagcgccgatcgcgatgacaaggcgctgcgcgaaacgtggaaggccatcgacaagaagcttcagaaatcgaccgagatcgatcaccccgtactcgccaccaaactggcgcaagcgggtgacgcggccgttacctttttccatacctgcttgagcgatgcgctcaagacgctggaggtgctggacacgtccgattgcacccgcaaaaaggcacgggaagcgtgggacgacgtgttcgacatcgacttcttcagcatgcagccagacaacaaagacgacggcgggggcggcaaaggctcagccatgtcagtcacgtcggtcgagaccgcccggcgcaacgatggtggcgggaggttcggctga

SEQ ID NO: 22 - DNA, 1041 bp, Artificial Sequence
  Description of Artificial Sequence: Synthetic polynucleotide
atggcagatatcgactgtcactccgagatgacaaacttccatcgcgataaagtgacattaagtaataaacagcagggggagatgcgcacacgtcgtgacgcaggccgtacccgtctggaaaacggcttgaatgaggcaaagaagcctcagcccaatgaggtgcgctcgcagggatcttaccagatgcgtaccatggtgcaggatgatgcaaatgattatgacattgacgacggggcttattttgcgtctgacgatctgaaagacaacgctggcgtcgcgctgacccctaaagccgcgcgcgaacgcgtttgtaacgccttggtgtgggacggccgcttgaaacaagaggctaccgtgaaacgtaattgtgtgcgccaggtttatgccgctggttaccacatcgatattccagtatatcgtatcatcaccacaaatgacgaaaataatgatcctgtagaacattatgagttagcctcaggcgatgaatggactcgctctgacgcgcgcgcagtgacccgttggtttaacggtcttgtcggagaattaaatagcggagaatcggacggctcacaaatgcgccgcgtcaccaaattaactaagaagttcgcacgtcgctcgagctggaaggatgaaacgacttctgggatctgtatcaccaagttagttgtggaccacttccaatactctgcggaccgtgatgacaaggcccttcgtgaaacgtggaaagctatcgataaaaagttgcagaaatcgactgaaatcgatcaccccgtactggcgactaaactggcacaagcgggcgatgcggccgtaacgttcttccatacgtgcttatcagatgcgctgaaaactcttgaagtcttagatacaagtgactgcacacgtaaaaaagcccgtgaagcctgggatgacgtgttcgatattgattttttttcaatgcaaccggataataaagacgacggaggagggggcaaggggagcgctatgtcagtgacatcagttgaaacggctcgtcgcaacgacggtggcggccgttttggt

SEQ ID NO: 23 - protein, 341 aa, Bacteroides fragilis
MANLDTQFQEFYGELQITVTKKQALITSHNNLRTKIQKYFAKNHPEYVPSFYIQGSYKMGTTIRTRDDECDLDDGCYFIPKPEVKGITLQNWVMDAVNGTVGATPVHKNKCIRVNYAAGYHIDLPVYRKERCNDNTEHPELAVRDGEYELSDPREIVQWFNSKKKDNPVLIRLVSYLKSWCDTVRGFMPPGLAMTILASKYQKKHEGRDDIALRDTLKSIRTALQANFSCVVPGTPYDDLFESYDSNRQEKFMSELNGFIEDADRAVNEKNKLKASKLWKKHLGNRFHLAPDENDAEMSKLDKLRDIGNKVLTGIATTAHNGYIHAAEGVKNVSHRNYGNE

SEQ ID NO: 24 - DNA, 1026 bp, Bacteroides fragilis
atggcaaatttagatacacaattccaagagttttatggtgaactccaaatcaccgttactaagaagcaggctttgattacttctcacaataatcttcgtacgaagatacaaaagtatttcgccaaaaatcatcctgagtacgtgccttcgttttacatacagggctcttataagatgggaactactatccgtacacgtgatgatgaatgtgaccttgatgacggatgctatttcattcccaaacctgaagtgaaaggtatcacattacaaaattgggtaatggacgctgtcaatggtacagtcggtgcaactccggtgcataagaacaagtgtatccgtgtcaattatgctgccggttatcatattgatttgcctgtatatcgtaaggaaagatgcaatgataacactgaacatccggaattggcagttcgtgatggcgagtatgaattaagcgaccctcgagaaattgtccaatggttcaatagcaaaaagaaagacaatcctgttctaattcggttggtatcctatctgaaatcgtggtgcgatacagtgaggggctttatgcctcctggactggctatgacaattctggcaagtaaatatcagaagaaacatgaaggacgcgacgatatagctttgcgtgatactctaaaatctatccgtactgcgcttcaagcaaactttagttgcgtagtacctggaactccttatgatgacttgtttgagagttatgacagcaatcgacaagaaaaatttatgagtgaattaaacggattcattgaagatgccgacagagccgtcaatgagaaaaataagctgaaagcaagtaaattatggaaaaagcatcttggtaaccgctttcatttagctccagatgaaaatgacgcagaaatgagtaaactcgataagttgcgcgatatagggaacaaagtacttactggcatagcgacaacagcccataacggttatatccatgctgcggaaggcgtaaagaatgtttcacatcgtaattatggtaatgaatag

SEQ ID NO: 25 - DNA, 1023 bp, Artificial Sequence
  Description of Artificial Sequence: Synthetic polynucleotide
atggcaaacctggatactcagtttcaagagttttatggagaattacagatcacggtcaccaaaaaacaagctctgatcacgtcgcacaacaatttgcgcaccaaaatccaaaagtattttgctaaaaatcatcctgagtatgtaccctctttctacattcaaggcagctacaaaatgggtaccactatccgtacccgtgacgatgaatgtgatctggatgatggttgctactttatccctaaaccagaggtgaaggggattactcttcagaattgggtcatggacgccgtaaacggtactgtaggcgctacccctgtccataagaataaatgcatccgtgtcaactacgcggccgggtatcatattgacctgccggtttatcgcaaggagcgctgtaatgacaacaccgagcacccagagttggcagtgcgtgacggggaatatgagttaagcgatccgcgcgaaatcgttcaatggtttaactcaaaaaagaaggacaatcccgttcttatccgtttggtgagttacctgaagagctggtgcgataccgtgcgtgggtttatgccaccagggctggccatgacaattttagcatcgaaatatcagaagaaacatgaggggcgcgacgacatcgcattgcgtgacacattaaagtctatccgcaccgcgttgcaggctaacttctcgtgtgttgtccctgggacaccctacgatgacttatttgaatcgtatgacagcaaccgtcaagagaagtttatgtctgaacttaacggcttcatcgaagacgctgaccgcgctgttaatgaaaagaacaaactgaaagcctctaagctgtggaaaaaacacctgggtaatcgtttccacttggctccagacgaaaacgacgccgaaatgtctaaacttgacaaacttcgtgatattggtaacaaagtgctgacggggattgctacaactgcgcacaacggatatattcatgctgcggaaggtgtgaaaaatgtttctcatcgtaactatggaaacgaa

SEQ ID NO: 26 - protein, 322 aa, Bacteroides thetaiotaomicron
MANNHEQFIAFNKTINSNKRATLKKNRDALRERIKNYFSREYPDEIQPKFHWQGSYAMHTILNPLKDENNLGVYDLDDGVYFIGKSEDERHSVQWYHDRIYEAVDGHTSIKPDDNKPCITVNYGDGHHIDLPIYFMVEGDKHPLLAHKTKSWLDTDPRELLNWFNGRDEHPQLRRIVRYLKAWCEYIRFKKEIKMPTGCSLTMLAVKNFKSNERDDIAMKNILVAIHNSLSSKFECLRPTFPKNEDLFEEYSETRKNNFMQELKSFREDAERAIESKNPHEACMKWQKHLGDRFSCSTAKDEDEDAQTKSFSGTINTNSRFA

SEQ ID NO: 27 - DNA, 969 bp, Bacteroides thetaiotaomicron
atggcaaataatcatgaacaatttattgcattcaacaaaacgatcaattcaaacaaaagagctacgttgaaaaagaaccgtgacgcattacgcgagagaataaaaaattattttagtagagaatatccagatgaaattcaaccaaaatttcattggcaagggtcttatgctatgcatactattcttaatcctctaaaagatgaaaacaatttgggggtttatgaccttgatgatggtgtttattttattggaaaatcagaagatgaacgtcatagtgtacaatggtatcatgatcgtatatatgaagcggtagatggccatacatctattaaaccagatgataataaaccatgtattacagtaaattacggagacgggcatcacattgaccttcctatctattttatggtggaaggtgataagcatccactattagcacataagacgaagtcatggttggatactgacccccgtgaattacttaattggtttaatggtcgggatgaacatccacaattacgtcgtattgtacgctatttgaaagcttggtgcgagtatattagatttaaaaaagagataaagatgcctacaggatgtagtctaacaatgctcgctgttaaaaatttcaagagtaatgaacgcgatgatattgccatgaagaatattcttgtagccatacataatagtctttcttctaaatttgagtgtcttcgtcctacatttcccaaaaatgaagatttatttgaagaatattcagaaacacgtaagaataactttatgcaagaacttaaatcatttcgtgaagatgctgaacgtgctattgaaagcaaaaatccacatgaagcttgcatgaagtggcagaagcatttgggtgatagattttcttgtagcacggcaaaagatgaggatgaagacgcacagacaaagtcattttcaggaacaataaacactaatagtcgctttgcataa

SEQ ID NO: 28 - DNA, 966 bp, Artificial Sequence
  Description of Artificial Sequence: Synthetic polynucleotide
atggcaaacaaccatgagcaattcatcgcatttaacaaaacgattaactcgaacaaacgtgccacgttgaagaagaaccgcgatgctcttcgtgaacgtatcaagaattacttctctcgtgaataccccgacgagatccagccaaaatttcattggcaaggttcttacgctatgcacacaattttgaatccgcttaaggatgaaaacaatttgggagtctatgatttggatgacggagtgtatttcatcgggaaatccgaggatgaacgccacagcgtacaatggtaccatgaccgtatttatgaggccgtagacgggcatacgagcattaaacctgacgacaacaagccgtgtatcacagtcaattatggcgatggtcaccacatcgacttgccaatctatttcatggtggagggtgacaagcaccctcttctggcgcacaagacgaaatcttggctggacactgacccgcgcgagctgcttaattggtttaatggtcgtgatgaacacccacagttgcgccgcattgttcgttaccttaaggcttggtgcgagtatatccgtttcaaaaaggaaattaaaatgccgaccggctgctctttgacgatgcttgctgtcaagaatttcaagagcaatgaacgcgatgatatcgcgatgaaaaatatcttggtagcgatccataacagtctgtcctcaaaatttgaatgtcttcgcccaacgttccccaaaaatgaagatttgtttgaagagtacagcgagacccgtaagaataacttcatgcaggaattaaagtccttccgcgaagacgcagaacgcgcaatcgaatccaagaatccacatgaggcgtgcatgaagtggcaaaaacatctgggggaccgtttttcctgtagtactgcgaaggacgaggatgaagacgcccaaactaagagctttagcggtactattaacaccaactcccgcttcgct

SEQ ID NO: 29 - protein, 346 aa, Thermoanaerobacter italicus
MANVQKYFEEFHEAIRLSDTDENEELREKRDIILNRLNEKKADNVPKYTPFNQGSYAMGTGVKPIDGEYDIDVGIRFDISKDDYPDPVEVKKWVYDALQDHTSEVKMRRSCVTVTYFKDGEPEFHVDLAIYAANNDDGKLYLAKGKLYSDDENKYWEVSNPLELITKIRNKYEDADDRNQFRRVIRYLKRWKDVNFTTDGSAAPTGIGLTVAAYNFLTISKQYDFATGKYKYNDLSALKNLVQSILSSFRLEYNQEEGKGVERLRISLPTEPYNDLFEKMSDSQMADFKVKLEELKTTLNNAEVEPDPHEACKILKKVFGKDFPVPPKEETGQRKNLAFFGTSASA

SEQ ID NO: 30 - DNA, 1041 bp, Thermoanaerobacter italicus
atggccaatgtccaaaaatattttgaagagtttcatgaagccattagactttcagatactgatgaaaatgaagaactacgtgaaaaaagagatattatacttaatagattaaatgagaaaaaagctgataatgtaccaaagtataccccctttaatcaaggaagttatgcgatggggacaggagttaaacctatcgatggagaatatgatatcgatgtaggaattcgttttgatatatctaaagacgattatcctgatccagttgaagttaaaaagtgggtgtacgatgctttgcaagatcatacaagcgaagttaaaatgaggagatcatgtgtaactgtaacatattttaaagacggagaaccagaatttcatgtagatttagcaatatatgctgcaaataacgacgatgggaaactgtatttagcgaaagggaagctatattctgatgatgagaataaatattgggaagtgtcaaaccctttagaactgattacgaaaattcgaaacaaatacgaagatgcggatgatagaaatcaatttagacgtgtaattagatatctaaaaagatggaaagatgtgaattttactacagacggaagtgcagctccgactggaatcggcttaacagtggctgcctacaattttcttacaatttccaaacagtatgattttgcaacggggaaatataaatataatgatctaagtgctcttaaaaatttagtacagagcatattaagcagttttagactggaatataatcaagaagaaggaaaaggggtagaaagattgcgtataagcttacccactgagccgtataatgatttatttgaaaagatgtctgatagtcaaatggcagattttaaggtaaagctggaagaactaaagacgacattaaacaatgcagaggttgaacctgacccacatgaggcttgcaagatattaaaaaaggtatttggtaaggattttcctgtaccacctaaagaagagactggacagagaaaaaatcttgcattttttgggacaagtgcatcggcttag

SEQ ID NO: 31 - DNA, 1038 bp, Artificial Sequence
  Description of Artificial Sequence: Synthetic polynucleotide
atggccaacgtacagaaatactttgaggagtttcatgaagcgatccgcttgagcgacaccgacgaaaacgaagaactgcgtgaaaagcgcgatattattctgaaccgcttaaacgaaaagaaggctgacaacgtgcctaagtacactccgtttaatcagggtagttacgcgatggggacgggtgttaagcctattgatggggagtacgatatcgacgtaggtattcgctttgacatttctaaagacgactaccccgacccagtagaggtcaaaaaatgggtatatgatgcgctgcaggaccacacatccgaggttaagatgcgccgtagttgcgtgactgtgacctacttcaaagacggtgagcccgaatttcacgttgatctggcgatttacgccgctaacaacgatgacggcaaactttatttggcgaagggaaaattgtattctgacgatgaaaacaagtattgggaagtatccaaccccttggaattgatcacaaaaattcgtaacaagtacgaggacgcggatgaccgtaatcagttccgtcgcgtcatccgttacctgaaacgttggaaggatgtgaacttcactacggatggaagcgccgccccaacaggaattggattgaccgtcgctgcctacaatttcctgacgatcagcaagcagtatgattttgctactgggaagtataagtacaacgacctgtcggcattgaagaacttagttcaatccatcctttcaagtttccgcttggaatacaaccaagaagaagggaaaggggtggagcgtctgcgtattagtttgccaacggaaccatacaatgacttgtttgaaaaaatgtcagattcgcaaatggccgactttaaagtgaaattggaagagctgaagacgactctgaataacgctgaggtggagcccgacccgcatgaagcatgtaaaatcttaaaaaaagtgtttggcaaagatttcccagtgcccccaaaggaagagaccgggcagcgtaaaaatctggcgttttttgggacatctgcttcagcg

SEQ ID NO: 32 - protein, 347 aa, Escherichia coli
MSLQNKFKNFHDAIKLGRKDLEYTTARLKDDSITADIVERFKEDGYPVVEDFIQGSLATFTGIREKGQDFDIDRAIVIEAELAPENPITPKLAVLEVLEGRGFKNAKIKKPCVTADYKADDLHIDIPIYRKYNNGEYELAVGKRHSTEDNREWARAAPRELIDWVNNYDADETYGSNKHDQFRRIVRYLKRWRNFTFGDDVRRKVYSIGIAVMVKESFDSSINDEGFPDDLTALRKTINHMLNYRSYFTQVGVDKYSVNVTLPVSPYRDIFHSSSIVTGTQFRNKLSALLKTLNKVADEEQESKQCELLRSVFGEDFPECAETSSASSTAVKTVFASAGVVGTSQGA

SEQ ID NO: 33 - DNA, 1044 bp, Escherichia coli
atgagtcttcaaaacaaatttaagaattttcatgatgctatcaagttaggaaggaaggacctggagtacacgacggcccgcctcaaggacgatagcattactgccgatatcgttgaacgattcaaagaagatggatatccggttgttgaggatttcattcaagggtctttggcgaccttcacagggatccgggaaaaagggcaggatttcgatattgaccgtgcaatcgtaatcgaagcggagctggctccggaaaacccaataacgcctaaactcgctgtacttgaagtgctggaaggccgaggttttaaaaatgctaagatcaaaaaaccttgtgtgactgctgattacaaggctgatgaccttcatatcgatatcccaatttaccgcaagtacaataacggcgaatacgaattggccgttggcaagagacattcaactgaggataatcgtgagtgggccagagcagcgccacgtgagcttatcgactgggtgaataattatgacgctgatgaaacttatggttcgaataagcatgaccagtttcggcgtattgtcagatacctcaagcgctggagaaattttacatttggcgatgatgtgcgtcgtaaagtctactcaattggtatcgcggtcatggtcaaggaatccttcgactcctccatcaacgatgaaggcttcccggatgacctcactgcactgagaaagacaatcaaccacatgcttaactatcgtagctatttcactcaggttggtgtagataaatatagtgttaatgttacgcttccagtgagcccctacagagatatttttcatagcagcagtatcgttacgggaacacagtttcgcaataagctgagcgcactgttgaaaaccctgaataaggttgctgatgaagagcaagagtccaaacagtgcgagttgctacgaagtgtattcggtgaagattttcctgagtgcgcagaaacatcatctgcatcgtcaactgctgttaaaactgttttcgcatctgccggagtagtggggacatcgcaaggcgcatga

SEQ ID NO: 34 - DNA, 1041 bp, Artificial Sequence
  Description of Artificial Sequence: Synthetic polynucleotide
atgtctcttcagaacaaatttaagaacttccatgatgctatcaaattgggtcgtaaagatcttgaatatactactgcacgcctgaaggacgactccatcaccgcggacattgtagaacgcttcaaagaagacggttaccctgttgttgaagacttcattcaagggtctttggccacgttcaccgggattcgtgaaaaaggtcaagactttgatattgaccgcgccatcgtgattgaagctgaattggctcctgagaacccaattacccctaaacttgccgtgcttgaagtgttagagggccgtggattcaagaatgccaaaattaaaaaaccatgcgtgactgctgattacaaggcggacgatctgcatattgatattcccatttatcgcaagtacaataatggtgaatacgaattagccgtgggaaagcgtcactccacagaggataaccgcgaatgggcacgtgccgccccacgtgagttaatcgactgggtcaacaactatgatgccgatgagacgtacgggtccaataaacatgatcaatttcgtcgcattgttcgctatctgaagcgctggcgcaattttacgttcggggatgacgtccgtcgcaaagtatattccatcgggatcgctgtaatggttaaggaatccttcgactcatccattaatgatgaaggctttccagatgatctgacagcgttgcgtaagactatcaaccacatgttaaactatcgctcgtattttacacaagttggcgtggacaagtattctgtaaatgtcaccttacctgttagtccgtaccgtgacatttttcattcatcctccatcgtgactggcacacagtttcgtaataagctgtctgcccttttaaaaacacttaacaaggtggctgacgaggaacaagaaagtaagcagtgcgagctgcttcgcagcgtgttcggggaggatttccccgaatgtgccgaaacaagcagcgcatcatccaccgctgtaaaaacagtgtttgcatcagctggcgtcgttggtacgtctcagggggcg

SEQ ID NO: 35 - protein, 346 aa, Acinetobacter baumannii
MSLQNKFNTFNQRIYLTRHDSEYSNAREKDDSITAAIKAKFKEKGYPVIDNFVQGSLATYTTIKEPGKDFDIDRAIVIDYEESPSDPLVPKKVILEILEDRGFQNAKIKKPCVTADYKFKNLHIDIPVYRKNSWGGYELAVGKKDSADEHKIWSESSPKELIDWVNDSSQYGVYATEKLHQFRRLVRYLKRWRNLKFSPDVCRKIYSIGLTVMIKQNFKPSIDEDGFPNDLLALKATVDSILDWSCYFQLHSDDQWKVKVELPVYPSRDIFHGSSLNTGTRFRNQFTNLRSTLQDVIDTSDEAEQCSLLVKVFGDDFPNNVNTNSASNAQKVQFATSGAVGTSQGA

SEQ ID NO: 36 - DNA, 1041 bp, Acinetobacter baumannii
atgagtttgcaaaataaatttaatacgtttaatcaacgaatctatttaacccgtcatgattccgagtattcaaatgctcgtgaaaaagacgatagcattacagctgcaatcaaggctaaatttaaagaaaaaggttatccagttattgataactttgttcaagggtcacttgctacttatacgacaatcaaagaacctggcaaagattttgatattgaccgtgccatagtcattgattatgaagaatctccatcagatccattagttcctaaaaaagtcattttagaaattctggaagatcgtggatttcaaaatgctaaaatcaaaaaaccttgtgttactgctgattataaatttaagaatctacatattgatatcccagtgtatagaaagaattcctggggaggatatgaattagcagtggggaaaaaagactcagctgatgaacataaaatttggtcagaatcctcgccaaaagaactcattgactgggtcaatgactcatctcaatatggcgtatacgccacagaaaaactacatcaatttcgcagattggtaaggtacctcaaacgttggagaaacctgaagtttagtcctgatgtgtgtagaaagatctattcaataggtctaactgtaatgattaaacagaactttaaaccaagtattgatgaagacggatttccaaatgatttactcgcactaaaagctacagttgattcaattctggattggtcttgttattttcaattgcactctgatgatcaatggaaagtaaaagtagaacttcctgtttatccatctagagatatttttcatggtagtagcctaaatacgggcactagatttagaaatcaattcactaatttgcgatcaacattgcaggatgtaattgatacatcagatgaagctgaacaatgctctttactggtcaaagtatttggtgatgactttccaaataatgtaaataccaatagtgcaagcaatgctcaaaaagtgcaattcgctacctctggagctgtagggacatctcaaggcgcatga

SEQ ID NO: 37 - DNA, 1038 bp, Artificial Sequence
  Description of Artificial Sequence: Synthetic polynucleotide
atgtcattgcaaaacaaattcaacactttcaaccagcgcatctacttaacacgtcatgattctgaatacagtaacgcccgcgagaaagacgattcgattaccgccgctatcaaggcaaagtttaaagagaaaggttatccagtaattgataattttgtgcaaggttcgttggcgacttatactacaattaaagaaccggggaaggatttcgatattgatcgcgcgatcgttatcgattatgaggagtcgccgagcgacccgttggtcccgaaaaaggtgattcttgagatccttgaggatcgcgggttccaaaatgccaaaatcaagaagccctgtgtaactgcagattacaagttcaagaatttacatatcgacatccccgtctatcgcaagaatagctgggggggatacgagttggcagttggaaagaaggattcggctgacgagcacaagatttggtctgaatcttctcccaaggagttgatcgattgggtaaacgactcttctcaatatggcgtttatgccacggagaaattgcatcaatttcgtcgtttggtccgttatcttaaacgttggcgtaatctgaagtttagtcccgatgtttgccgtaagatttactctatcggtcttacggtcatgatcaaacagaattttaagccgtcaatcgacgaggatggtttcccaaacgaccttcttgcgttaaaagcaactgtagatagcattctggactggtcttgctacttccaacttcactccgacgaccaatggaaagtgaaggtggaactgccagtctacccttcacgtgatattttccatggtagttcgttaaatactgggacacgtttccgtaaccagttcaccaatttacgttcgacgctgcaggacgtaattgatacctcagacgaggcagaacagtgtagtttattagttaaggtatttggcgatgattttccgaacaatgttaatactaattcggccagcaacgcacagaaggttcaatttgctaccagcggagcggttggtacaagccaaggggcc

SEQ ID NO: 38 - protein, 346 aa, Geobacillus sp.
MANLQSYFNSFHDAIKLDYDDNKELRDKRDELLEILKANMPSDAGSFEIFHQGSYAMYTGVKPLDDGDYDIDVGLLFNISKDDYPNPVTVKKWVYDALTKNYEDVEMKKPCVTVKFKAEGEDERNYHVDFAVYADYESDEKTYLAKGKLNSNAENRYWEESDPKTLVNDIKNHFTDSEDRKQFRRVIRYLKRWKDIKFKGQVNRPSGIGLTVAGLTHFQPKYTYDGFTNTKNYKDLDAIESFVQSMLNAFAWVFNEENELEERLQVYLPTPPYNDIYEKMTGKQMTDFKEKLQCLLDKLQQAKNEADPVVACKLLQEEFGDDFPVPEESTTAQKRGPAIIVDHSSA

SEQ ID NO: 39 - DNA, 1041 bp, Geobacillus sp.
atggcaaatttacaatcatattttaatagtttccatgatgcaattaaacttgattatgacgacaacaaagaattaagagacaaacgggatgaattattagaaatattaaaggcgaatatgccttcagatgctggatcttttgaaatctttcatcaaggtagttatgccatgtacacaggagtcaagccattggatgacggcgactatgacattgacgtggggctgctgttcaatatttctaaagatgattaccctaaccctgttactgtaaaaaaatgggtttatgatgctctaaccaaaaattatgaagatgtcgaaatgaaaaagccttgcgttacagtgaagtttaaagcggaaggcgaagatgaacggaattaccatgtagattttgctgtttacgcagactatgaatctgatgaaaaaacttatctggcaaaaggcaagttaaacagcaacgctgaaaatcgttattgggaagagtctgacccgaaaacattggtaaatgacattaagaatcattttacagatagtgaagacagaaagcagttcagacgggttattcgatatttaaaaagatggaaggacatcaaatttaaaggacaggtaaatcgtccatcggggattggattaaccgttgctgggttaacgcacttccaaccaaaatatacctatgatggttttactaatacaaagaattataaggatttggacgctatagaatcatttgttcaaagtatgttgaatgctttcgcttgggttttcaacgaggaaaatgagcttgaagaaagattgcaagtttatcttcctacaccaccttacaacgatatttacgaaaaaatgaccgggaaacagatgaccgattttaaagagaagcttcaatgtttattggacaagctccaacaagcgaaaaatgaagcggatccagtagtagcctgcaagttattacaagaggaatttggggatgacttcccagttcctgaagagtcaactaccgctcaaaaaagaggaccagcaatcattgtagaccattcttctgcatga

SEQ ID NO: 40 - DNA, 1038 bp, Artificial Sequence
  Description of Artificial Sequence: Synthetic polynucleotide
atggcgaacctgcagtcttattttaattcgtttcacgacgccatcaaattggattacgatgataataaggagctgcgcgataagcgtgacgaattactggaaattttgaaggcaaatatgccgtccgacgctggaagctttgaaattttccaccaggggtcgtatgctatgtacacaggtgttaagcctctggatgacggtgactatgacatcgatgtcggtcttttgtttaacatcagcaaggatgattatccgaaccctgtaaccgtcaaaaagtgggtgtacgacgcccttactaagaattacgaagacgtagagatgaagaaaccttgtgttacagtaaagtttaaagccgagggcgaagatgaacgcaattaccacgttgactttgcggtttatgcggattacgagtctgatgaaaaaacataccttgctaaggggaagttaaactcaaatgctgagaaccgctattgggaggaaagcgatcccaaaaccttagtgaatgacatcaagaaccatttcactgactctgaggatcgtaagcaatttcgccgtgttatccgttaccttaaacgttggaaggatattaagttcaagggacaagtgaatcgtccaagcggtattgggcttactgtagccggcctgacccattttcagcccaagtatacatacgacgggtttacgaacacgaagaactacaaggacttggacgccatcgagtcctttgtacagtcaatgttaaatgcttttgcgtgggtgttcaacgaggaaaacgagcttgaggaacgcttgcaggtttaccttccgacgccgccatacaatgacatttatgagaaaatgacgggtaagcagatgaccgattttaaggaaaaattgcagtgtctgcttgataaacttcagcaagcaaagaacgaggcagacccagtagtcgcctgtaaacttttacaggaagaatttggcgatgactttcccgtgccagaagagagtaccaccgctcagaaacgtgggccagccattatcgtggatcatagctctgca

SEQ ID NO: 41 - protein, 345 aa, Enterococcus sp.
MANIQTSFIDFHNSIRLDVEDNTLLKDYKDQVIDGLKDYLPDDVKFETFLQGSYSVYTGIKSCDEKIDFDIDIAVAFEIDHTVYEDPREPKLWVKEALVEIFPNAQVNLKVPCVTATFTGKKTKKNVHVDVAVYAKEDENYFLAKAKEFSAPENRCWEEADPKVLKEKINSHVADSDDRKQFRRCIRYLKRWKDNNFNQEYKPTGIGLTINVMDTFLVNKSTDFLTRKVQYNDMECMKQIVSSLKDSFVYEYSETDGWHYRLHAYLPVKPNSDTYSKMTVNQMSDFKNKLSKLYDDLIFAIDTEDEYEATKRLNNQFGEDFLIISEEEVTEKNLRNAFVTDYPSA

SEQ ID NO: 42 - DNA, 1038 bp, Enterococcus sp.
atggcaaatattcaaacaagttttattgatttccataattcaattagattggacgtagaagacaatacgctacttaaggactataaagaccaagtaattgatggattaaaagattacttacctgatgatgtgaagtttgaaacttttttacagggaagctattctgtttataccggaataaaaagctgtgatgaaaaaattgattttgacatcgatattgcagttgctttcgaaattgatcatactgtttatgaagatccaagggagcctaaactgtgggtaaaagaggcgctagttgaaatttttcctaatgctcaagttaatttaaaagtaccttgtgtaactgctacatttactggaaaaaagacaaaaaaaaatgtgcacgttgatgttgcggtttatgctaaagaagatgaaaattatttcttagcaaaagcaaaagaattcagtgctcccgaaaaccgatgctgggaggaagcggatcccaaagtattaaaagagaaaattaatagtcatgtagcagattcagatgatcgaaaacaatttcgaagatgtattcgctatttaaaaagatggaaagataacaattttaaccaagaatataaaccaacaggaattggacttacaattaatgtgatggatacgttcctagttaataagtccactgattttttaactagaaaagttcagtataatgatatggaatgtatgaagcagattgtttcttcgctgaaagattcatttgtgtatgagtacagtgaaacagatggttggcattatcgtctacatgcatatcttccagtgaagcctaacagtgacacctattcaaaaatgacagtgaatcagatgagtgattttaaaaacaaactttctaaattatatgatgatttgattttcgctatcgatactgaagatgagtatgaagctacaaaacgattaaataatcaatttggggaggattttttaattatttcagaagaagaagttacagaaaaaaacttaagaaatgcatttgttacagactatccgagtgcttag

SEQ ID NO: 43 - DNA, 1035 bp, Artificial Sequence
  Description of Artificial Sequence: Synthetic polynucleotide
atggcgaacatccagacctctttcatcgatttccacaacagcattcgcctggatgtcgaggataataccttactgaaggactataaagaccaagttatcgacgggctgaaagactatttgcctgacgacgtgaagttcgagacattcttgcagggcagctactcagtctacacaggaattaaatcttgcgacgagaagattgattttgatattgatatcgctgtggcattcgaaatcgaccatacagtttacgaggacccgcgtgagcctaaattgtgggtaaaagaggcactggttgaaatttttcccaacgcacaggttaaccttaaggtcccatgcgtgacggcaacgtttacggggaagaagactaagaagaatgtacatgtagacgtagctgtctacgccaaggaggacgaaaactattttcttgctaaggcaaaagaattttcagcgccggagaatcgctgttgggaagaggctgatcctaaagtgcttaaggaaaaaatcaattctcacgtagcggactcagacgaccgtaaacagttccgtcgctgcatccgctatctgaagcgctggaaagataacaacttcaatcaagaatacaaaccaactggaatcggcttgacaattaatgtcatggatacattcttggtgaataaatcgacagatttcttaacccgcaaggtacaatacaacgatatggagtgcatgaaacaaatcgtctccagcctgaaggactcgtttgtctacgagtactctgagacagacgggtggcattaccgtttgcacgcctatttgcctgtaaaaccaaattcagatacctattcaaagatgacagttaatcaaatgtcggactttaaaaacaagttatcgaaactttatgatgacctgatcttcgccattgataccgaggatgaatatgaggccactaagcgtcttaataatcaattcggagaggattttttaattatctcagaagaggaagtgactgaaaaaaacttgcgcaatgctttcgtgacagactaccccagcgca

SEQ ID NO: 44 - protein, 340 aa, Streptococcus agalactiae
MPTLQSQFIKFHDTIKLDADDKKVLIDKRKELEEVINNGVSEFEKSFFNQGSYSTYTGILPIDEGDYDLDRGLKIDVDRHSNSPKEVKKFIFDALVSEFGENRVKVKNPCVTVSFPEDNVHIDIAVYCTENDNYFLARGKLNSIYENIKWEEADPVELTKKINNAMENSEDRNQFRRVIRYLKRWKDLKFKNQDNRPTGIGISVFAVSNFSVSKKVDYLSGNTTYDDISALRNLVNTMINSFSDTYDVDRNLFYPRLEVYLPVKPYTDVYERVSNIQMEAFKNKLEKLRDSLDEAINSTDLSESTKVLSKQFGDDFPIIEQKETAENFGTRAIISDYPSA

SEQ ID NO: 45 - DNA, 1023 bp, Streptococcus agalactiae
atgccaactttacagtcacagtttattaaatttcacgacacaattaagctagatgctgatgataaaaaggttttaatcgacaaacgtaaagagcttgaagaagtaattaacaatggtgtttcagaatttgaaaaaagctttttcaaccaaggaagctactcaacttacacaggtattttgccaatcgatgaaggagattatgacttagatagaggtttaaaaatcgatgttgatagacattcgaattctcctaaagaagtaaagaaatttatttttgatgcactagtctccgaatttggtgaaaatagagtcaaagtaaaaaatccatgtgtgacagtatcatttcctgaagataatgttcacattgatatagcggtgtattgtactgaaaatgataactattttttagccagaggaaaacttaatagtatttatgaaaatattaagtgggaggaagcagaccctgtagaattaacgaaaaaaattaataatgctatggagaactcagaagacagaaaccaatttcggagagtaattcgttacttaaaaagatggaaagatctcaaatttaaaaatcaagataatagaccgacaggaattggaatttcagtttttgctgtcagtaatttttctgtaagcaaaaaagtagactatttatcaggaaacactacttatgatgatatttcagctttaagaaatttagtaaatactatgattaattcattttcggatacatatgatgttgatagaaacttattttatccgagattagaggtttatttaccggttaagccatatactgatgtatatgaaagggtatcaaatatacaaatggaagcctttaagaataaattagaaaaattaagagactcactagatgaagcaataaattctactgatttaagtgagtctacaaaagtattgagtaaacagtttggtgatgattttcctattattgaacaaaaagagacagcagaaaactttggaactcgggctataatcagtgattatccaagtgcttag

SEQ ID NO: 46 - DNA, 1020 bp, Artificial Sequence
  Description of Artificial Sequence: Synthetic polynucleotide
atgcccaccttgcagtctcaattcatcaaattccatgacactatcaagctggatgcagacgataaaaaggttcttattgacaaacgcaaggaacttgaagaagttattaataatggggtttcagagtttgagaaatcattttttaaccagggttcgtactcgacgtatacaggcatccttcccattgatgaaggcgattacgacttagatcgcggtttgaaaattgacgttgatcgccactctaatagcccgaaagaggtaaaaaagttcatcttcgatgctttggtgtcagagtttggcgagaatcgtgtgaaagtgaagaatccctgcgtgactgtcagctttcctgaagataatgtgcatattgacatcgctgtgtattgtactgaaaatgataattatttccttgcacgtgggaaattaaactcgatttacgagaacatcaagtgggaagaagccgatcccgttgaattaacgaaaaagatcaataatgctatggagaactcagaagaccgcaaccaattccgtcgcgtgattcgttacctgaagcgctggaaagatttgaaatttaagaaccaagacaaccgccctacgggtatcggtatcagtgtgttcgctgtaagcaacttttcggtgtcgaaaaaagtagattaccttagtggaaacaccacctacgatgatatctctgcattgcgtaatttagtcaatactatgatcaactcatttagcgatacctatgatgttgatcgcaaccttttttacccgcgccttgaagtttatttacctgttaagccttatacggacgtatacgaacgcgtctctaacattcagatggaagcctttaaaaacaagttagagaaacttcgcgactccttagatgaggctattaatagcactgacctgtcggaatctaccaaagtgttgagtaagcaattcggtgacgactttcctatcatcgagcaaaaagaaacggctgagaatttcgggacccgtgcgattatttcggattacccttcagcc

SEQ ID NO: 47 - protein, 443 aa, Escherichia albertii
MNCSDLFYADTNTENTLHQRTQLSEVILSKGIAKKNELIEFLRQELKEAFDCDVRFWLQGSYKSHTLIKPVDKFSSYDIDIGVYLFFDAENEGVDSKDVKETLRDALLSYCSINNEAKLQESKNACEGLKFSTFLTVDTPIYYKTDTKIKLATDKGWSDSDPKAIQDWITNYYKDKSDRALMKRLVRYFKAWVNVKWQNTGFKKIPSLAINVLVAQHMKQHVREDDCFIYTALSICEELESTLIVRNPLNNSNLISMPQDAECFAHQKLDELKQVCLSCIKSDDIKRGAHFSNLFQHYFPQISLDSATGSTGLPTVVNVPEISVCRYDKNGNHVETIITDRLTVNKGDSLTFTIRNHYDFNIYSSAQWTVRNIGSQANDANDIGHSVTGKPSESHKRGTSYTGSHTMECMILHNGAIIGFKTIHVIVKPARTVRRKTLKFWRA

SEQ ID NO: 48 - DNA, 1332 bp, Escherichia albertii
atgaattgcagtgaccttttttatgctgatacaaatacagaaaacacacttcatcagagaactcaattatctgaagttatattatctaaaggtattgcaaagaaaaatgagttaatagaatttctaagacaagagttaaaggaagcgtttgactgtgatgtgcgattttggttacaaggttcatataaaagccatacgctgataaaaccggtagataagttttcatcatatgatatcgatatcggcgtatatttatttttcgatgctgaaaatgagggggttgattctaaagatgttaaggaaacgctgagggatgcactattgtcttattgttccattaataatgaagcaaaactgcaagagtcaaaaaatgcttgtgaaggactaaagttctctacttttcttactgttgatactcctatttattataaaacagatactaagataaaattagcgacagacaaaggctggagtgacagtgatccaaaagctattcaggattggattacaaattattataaagacaaatctgacagagctttaatgaagcgactcgttcgatacttcaaagcttgggtaaatgtaaagtggcaaaacaccgggtttaaaaaaataccctcattagctattaatgttttggtagcccagcatatgaaacagcatgtgcgagaagatgattgttttatatatacggcgttaagtatttgcgaggaactagaatctacattaatagttagaaaccctttaaataatagcaacttaatttccatgcctcaagatgctgagtgctttgcacatcaaaaacttgatgaattaaagcaagtatgccttagctgcattaagtccgatgatattaaaaggggagcccatttttcaaatcttttccaacattacttcccacaaatatcattagattctgctacaggtagcactggtctgcctacggtagttaatgttcctgaaatctcagtttgtagatatgataaaaatggtaatcatgttgaaacaataattactgatagattgactgttaataaaggggattcactaacttttacaatccgtaatcattatgattttaatatctattctagtgcgcaatggacagtcagaaatattggctcacaagcaaatgatgctaatgatattggacactcagtcacaggtaaacctagtgaaagtcataaacgaggcacttcgtatacggggtctcatactatggaatgtatgattttacataatggggcaataataggatttaaaactatacatgtaatagtaaaacctgcgcgtacagtaagaagaaaaacacttaaattctggagggcatga

SEQ ID NO: 49 - DNA, 1329 bp, Artificial Sequence
  Description of Artificial Sequence: Synthetic polynucleotide
atgaattgcagtgatcttttttacgctgacactaacaccgaaaacacgctgcaccagcgtacacaattatctgaagtcatcctttcaaagggcattgcgaagaaaaatgaacttattgagttcttgcgccaagaattaaaagaagcgtttgactgcgatgtccgtttctggttacagggaagctataaatcacacacccttattaaacccgtggataaattttctagctacgacatcgacattggtgtatatttgttttttgacgcagagaatgaaggtgtcgacagtaaagacgtgaaagaaactttacgcgatgcattgctgtcttactgctcgatcaataacgaggccaagcttcaggaatcgaagaacgcctgtgaagggttaaaattctccactttcttaacagtagatacgcccatttactacaagactgatacgaagattaaactggcaacagacaagggctggtcggatagcgacccaaaggcaattcaggactggattacgaattactacaaggacaaaagtgaccgcgcgttgatgaaacgcctggtgcgctatttcaaagcttgggttaacgttaagtggcagaatactggatttaaaaaaattccgagccttgcaatcaatgtacttgtagcccagcacatgaaacagcacgttcgcgaagatgattgttttatctataccgccttatctatttgcgaggaacttgaaagcaccttaattgtccgcaatcctttgaacaattcaaatttgatctcgatgccgcaagatgcagagtgctttgcccatcaaaagttggatgaacttaagcaggtgtgtctgtcgtgtattaaaagcgacgacatcaagcgcggggcgcatttctctaatttgtttcagcactatttcccgcaaatctccttggacagtgcaactggctccaccggtttgcctactgtcgtaaatgtccctgagatctctgtctgccgttatgataagaatgggaaccacgttgagactattattacagatcgccttacggttaataaaggcgattcccttacttttacgattcgcaatcattatgattttaacatttactcctccgcgcaatggactgtgcgcaatatcggatcgcaggcaaatgacgcgaatgatattgggcattccgtcaccggcaaaccatccgagtcccacaagcgcggtacgagttatacaggttctcatactatggagtgcatgattttacacaacggtgctattatcgggttcaagactattcacgtcatcgtgaagccagcccgtaccgtgcgccgtaagacattaaagttttggcgtgcg

SEQ ID NO: 50 - protein, 313 aa, Bacteroides sp.
MSFDKNKHLREVLDTHKMCHVQDFVNKVKKRREEIKAKMHDHYGCDKYSSFGSGSFAKHTATNVKFDLDLVEPFKRNSFGTLQEMFDSVHDFLAEEYKNTGVTIRRQKVSIGVSFPIEEGDEKPVELDVVPGRELSDDNYLDSHDLNLCFNEDHWGFQKGSSQKTNIQKQISHIEGKSSERQIIRLLKIWKKQKDKKYKSFVIELAVIRALDGYNGDMGLWPRLKYTMEYLRDHIAESSFHLFDPGNTNNDVVGTMQDYDRQSFKSDMESMLNNIDSNPDLYLPYYFKVNEKYCGYKEKDTGAAYPTSTKRFG

SEQ ID NO: 51 - DNA, 942 bp, Bacteroides sp.
atgagttttgacaaaaacaaacatttaagagaagtgttagatacacacaaaatgtgccacgtgcaggatttcgtgaataaagtaaaaaaacgtagagaggagattaaggccaaaatgcacgaccattatggttgcgacaagtattcttcgtttggctctggcagttttgctaagcatactgccactaatgtgaaattcgaccttgatttggtggaaccgttcaagcgtaattctttcggaacattacaggagatgtttgatagcgtacacgatttccttgcagaggaatataagaatactggtgtgactattcgcaggcaaaaggtttcaatcggtgtaagtttccctattgaagagggagatgaaaagccggttgaacttgatgtggtgcctggtagagaactaagcgatgataactatcttgattcgcatgatttgaacctatgttttaatgaagaccattggggattccaaaagggatcaagccagaaaacgaatatccagaagcagatttcgcatatcgaaggtaagtcgagtgaacgtcaaattattcgtctgcttaaaatatggaaaaagcaaaaagataagaaatataagtctttcgttattgaactggccgtaattagagccttagatggttataatggtgatatgggtctttggccaagattaaaatacacgatggagtatctacgtgaccacatcgcggaaagtagtttccacctttttgacccaggtaacacgaataacgatgtcgtggggactatgcaggactacgatagacaatcgtttaaatctgatatggaaagcatgctcaacaacatagacagtaatcctgatttatatttgccctactacttcaaggtaaacgaaaaatattgcggatataaagagaaagatacaggtgctgcttatcctacaagtacaaaacggttcggatag

SEQ ID NO: 52 - DNA, 939 bp, Artificial Sequence
  Description of Artificial Sequence: Synthetic polynucleotide
atgtctttcgataagaataaacacctgcgtgaggtgcttgatacgcataagatgtgtcacgtccaagactttgttaacaaagtaaaaaagcgtcgtgaagaaattaaggcaaagatgcatgaccattacggatgcgacaagtactcttccttcgggtcaggctcctttgcgaagcatactgctacgaacgttaagttcgacttagatcttgtcgaaccgttcaaacgcaattcctttggaacgttacaagaaatgttcgatagcgtccacgatttcttggcggaagaatataaaaataccggggttacgattcgccgtcaaaaggtatctattggcgttagttttccaattgaagaaggggacgagaagccagttgagttagacgtggtgccgggacgcgagttgtctgacgacaactacctggattcgcacgatctgaacctgtgtttcaatgaggatcactgggggttccaaaagggaagctctcaaaagacgaatattcaaaagcagatcagtcatatcgaggggaagtcctcggaacgccagatcattcgcttattaaaaatctggaaaaaacagaaagacaaaaaatacaaatcatttgtaattgaactggccgtaatccgcgccttagacggatataatggagacatgggtctgtggccccgtctgaaatacacgatggaatatttacgtgaccacattgcggaatcatcgttccatcttttcgatccgggtaacacaaataatgacgtagttggcacaatgcaggactatgaccgccagtcattcaaaagtgatatggaatcaatgttaaacaacatcgactccaaccccgacctgtaccttccgtactatttcaaagtaaatgagaaatattgtgggtataaagaaaaagacaccggagccgcctatccgacttccacgaaacgcttcggg

SEQ ID NO: 53 - protein, 251 aa, Bacteroides uniformis
MSSAYLNAILAREAVDTSAFSPVRQVQTIIAPVLQQWANRFLLSISPSGSFAKGTANRSGTDIDLFISLHEDTPETLKDIYGSLFNAIAGAGYVPKRQNASINATIGGFDVDLVPGKRQSAWTTDHSLYRRTADTWTKTNVTTHINTVVMAGHQRESRLLKLWRNQKRLEFPSFYLELTVIAALSGRTSPDLAENVVTVLEYLRDKFTAARVIDPANGNNVISDDLTGTEKQAVRRLAEAALGGNWSGFVQ

SEQ ID NO: 54 - DNA, 756 bp, Bacteroides uniformis
atgagcagcgcctacttaaacgcgattctggctagggaggccgttgataccagcgcgttctcacctgttcggcaggtccagacaataatcgcgcctgtgcttcagcaatgggcaaaccgtttcttactgtcgatttctccgagcggctcgtttgccaaaggcacggccaaccgaagcggcactgacatcgaccttttcatttcgctgcacgaagacacgcccgagactttgaaggatatttacggctcgctcttcaacgccattgcaggcgccggctatgtgccaaagcggcagaatgcgtcgatcaacgcgacgatcggcggcttcgatgtcgatctcgtccccggcaagcggcagtccgcctggacgacggatcacagcctctaccggcgcacggccgatacctggacgaagacaaatgtgacgacacatatcaacaccgtcgtcatggcgggccatcagcgcgagtcgcggctcctgaaactgtggcgcaaccagaagcggctcgaattcccatctttctatcttgagctgaccgtgatcgcagccttgagcgggaggacatcgcctgacttggcggagaatgtcgtgacggtgctggagtatctcagggacaagttcactgcagcacgggtgatcgatcccgccaatggaaacaatgtcatatcggatgatctcaccggcacggagaagcaagcggtgcggcggttggcggaagctgcgctgggcggcaattggagcggcttcgtgcaatga

SEQ ID NO: 55 - DNA, 753 bp, Artificial Sequence
  Description of Artificial Sequence: Synthetic polynucleotide
atgtcaagcgcctatctgaacgcgatcttggcacgcgaggcggttgatacctcagcctttagtcctgttcgccaagtacagacgattatcgctccggtcctgcagcaatgggccaaccgctttttgttatctatctctccgtcggggtctttcgccaagggcactgctaaccgttcaggtacagacattgatttgttcatttccctgcacgaggacacaccggagacactgaaggatatttacgggtcgttatttaatgcgatcgccggcgcagggtatgtgccgaaacgtcagaacgcctcaattaacgcgacaatcggtgggtttgacgtagatttagtgccaggcaagcgtcagagcgcctggactaccgatcactctctttaccgccgcacagccgacacttggacaaaaacgaacgtgacgacccacattaacacggtagttatggctgggcaccagcgcgagagtcgcctgctgaaattatggcgcaaccaaaaacgcttagaatttccatcgttctaccttgagcttacagtaattgctgcactttcaggacgtacctctcccgacttggctgaaaacgtagtcaccgttctggaatatttacgcgacaaattcaccgccgcccgcgtcattgatccagccaatggcaataatgtaattagtgacgatttgacagggacagaaaaacaggcagtccgtcgcttggcagaggccgcgcttggaggaaattggtcaggtttcgtacag

SEQ ID NO: 56 - protein, 336 aa, Escherichia coli
MSSGLDRVKTSSEDEMSTEHVDHKTIARFAEDKVNLPKVKADDFREQAKRLQNKLEGYLSDHPDFSLKRMIPSGSLAKGTALRSLNDIDVAVYISGSDAPQDLRGLLDYLADRLRKAFPNFSPDQVKPQTYSVTVSFRGSGLDVDIVPVLYSGLPDWRGHLISQEDGSFLETSIPLHLDFIKARKRAAPKHFAQVVRLAKYWARLMKQERPNFRFKSFMIELILAKLLDNGVDFSNYPEALQAFFSYLVSTELRERIVFEDNYPASKIGTLSDLVQIIDPVNPVNNVARLYTQSNVDAIIDAAMDAGDAIDAAFYAPTKQLTVTYWQKVFGSSFQG

SEQ ID NO: 57 - DNA, 1011 bp, Escherichia coli
atgtcgtccggcttggatagagtgaagacttctagtgaggatgagatgtcaacagaacatgtcgaccataaaactatagcgcgatttgccgaagataaggtaaatcttccaaaagtaaaggctgatgatttcagggaacaggccaagcgattacagaacaaactggaagggtatctttctgatcatcctgacttttcattaaagcgaatgattccatcaggtagtctggctaaaggaactgctcttcgctcgttaaacgatattgatgtggctgtgtatatcagcggctctgatgcaccacaggatttacgtgggttgcttgactatcttgctgatagattgcgtaaagcatttcctaattttagccctgatcaggttaaaccccagacatactctgtaacggtttccttccggggctctggcttagatgtcgatattgtccctgtattgtattcggggttacctgactggcgaggtcatttgataagccaggaagatggctcgttccttgaaaccagtattcctctgcaccttgatttcatcaaagcccgcaagcgtgctgccccgaagcattttgctcaggttgttcgtttagcgaaatattgggctcgtttgatgaagcaagagcgaccgaattttcgctttaaatcgttcatgattgaattgattcttgcaaaattactggataatggtgtggatttctcgaattatccggaagctttacaggcatttttttcctatctggtgagcaccgaattacgtgaacgcattgtcttcgaagataattatcctgcgtcaaaaataggcacgttgtcagacttagtgcagatcatcgatcccgttaatcctgttaataatgttgctcgtttatatacgcagtctaatgtggacgccatcattgacgccgcaatggatgccggtgacgctattgatgctgcattctatgcaccaaccaagcaattaaccgtaacctattggcagaaagttttcggttcttcattccaggggtga

SEQ ID NO: 58 - DNA, 1008 bp, Artificial Sequence
  Description of Artificial Sequence: Synthetic polynucleotide
atgtcctcgggactggatcgcgtaaaaacctcatcggaagacgaaatgagcacggaacatgttgaccataagacgatcgctcgcttcgcagaggacaaggtaaacttacctaaggtcaaagcagatgattttcgtgagcaggcaaagcgtttgcaaaacaagttagaggggtatctgtctgatcaccccgactttagtttgaaacgcatgattccgtctggctccctggcaaaggggactgcgttacgtagccttaacgatatcgatgtagccgtatacatcagcgggtcggatgctccgcaggatctgcgtggattgcttgattacctggcggatcgtttgcgtaaggcattccccaacttttcccccgaccaagttaaaccccagacatacagcgtgactgtcagctttcgcggttcgggccttgacgtggacattgtgccggttctgtattcaggattgcccgattggcgtgggcatctgatcagccaggaagacgggagcttcttagagacgagtattccgttacatttggactttattaaagcacgcaagcgcgcagccccaaagcacttcgcccaggttgtgcgtttggctaagtattgggcgcgtttaatgaagcaggagcgccccaatttccgtttcaagtcgtttatgatcgaattgattttagcaaaacttttagataatggagtcgacttctctaactatcccgaggcattgcaggcttttttcagctaccttgttagtacagagttacgtgaacgtatcgtctttgaagataactacccagcttcgaagatcgggacattaagtgatttggttcaaatcattgaccctgttaatcccgtcaataatgtggctcgcctttatactcagagtaatgtggatgccattatcgatgctgctatggatgccggagacgccatcgatgctgcgttctacgcgccaacgaagcagctgacagttacatattggcagaaggtgtttggatcgagttttcagggt

SEQ ID NO: 59 - protein, 314 aa, Escherichia coli
MPLTNTQIRYYDSNVLRLPKDKRETYNAQVDRLITALRKKLKDQDKITIKRVVKAGSFAKHTILRKTSDSQVDVDVVFYVSGEKVAEETFASLSEKIYEALLKMYPNKAVEDFEIQRKAATVSFVGTGLDVDIVPVIENPDKEGYGWQFDRIDGSKTETCAPCQIKFVKERKDQDPDFRTLVRLAKRWRTNMECPLKSFHIELIMAHVLEVNGKDGSLEKRFRDFLLYIAESGLKEVITFPENSTIPAFSHPVVILDPVCDTNNVTSRITEDERKEIVRIAEKSWATANFASVEGDYDIWKELFGRSFKVEDAA

SEQ ID NO: 60 - DNA, 945 bp, Escherichia coli
atgccactcactaatactcagatccgatactacgacagcaatgtactgcgtttgcctaaggataagcgtgaaacctacaatgcccaagtagatcggcttattacagcgttacgtaagaaactgaaagatcaggataaaataacaataaaacgtgtcgtcaaagctggttcgtttgctaaacacactattctacgcaaaacctcagacagtcaggtcgatgtagatgttgtgttttacgttagtggagagaaagttgctgaggaaaccttcgcaagcctgagcgaaaaaatttacgaagccttacttaaaatgtatcccaacaaagctgtagaagatttcgagattcaacgtaaggctgctactgtttcttttgtcgggactggattagatgttgatattgttcccgtcatcgaaaatccggacaaagaaggctatggatggcagtttgaccgtatcgatggttcgaagacagagacttgtgctccttgccagatcaaatttgtgaaagagcgcaaagaccaagacccggactttcgtactttagtacgcttagctaaacgttggcgtaccaacatggaatgcccacttaagtcatttcatatagaactaatcatggctcatgtactagaagtcaatggaaaagatggttcgttggagaagcgatttcgggattttctactgtacattgctgaatcaggattaaaagaagttatcaccttccctgaaaatagcactataccagcattttcccatccagttgtcatactggatcctgtttgcgatacgaacaacgttaccagccgtattaccgaggatgagcgaaaagagatcgtccggattgctgagaaaagttgggcgacggcaaattttgcgtcggtagaaggagactatgatatctggaaggagctgtttggtcgttcatttaaagtggaggatgcagcatga

SEQ ID NO: 61 - DNA, 942 bp, Artificial Sequence
  Description of Artificial Sequence: Synthetic polynucleotide
atgcctttaactaacacgcagatccgttattatgactccaacgtcctgcgtctgccaaaagacaagcgcgaaacgtacaatgcccaagtagatcgtttgattaccgccctgcgcaagaagttgaaagatcaggataaaatcacaatcaaacgtgttgtcaaagctggtagctttgcgaaacacaccatccttcgcaagacatctgattcgcaggttgatgtagacgttgtcttttacgtatccggggagaaggtggctgaagagacgttcgcgtccctgagtgaaaaaatttacgaggctttactgaagatgtatcctaacaaggccgtcgaggactttgaaattcaacgcaaagcagccaccgtttcatttgtgggcaccggacttgatgtagatattgtacctgtaattgagaacccagacaaggaagggtatggctggcaatttgatcgcatcgacggttctaaaactgaaacctgcgccccttgtcagatcaagttcgttaaggagcgcaaggatcaagacccagatttccgcacattagttcgcttagcgaagcgctggcgcacgaacatggaatgtcctctgaagtcctttcatatcgaactgatcatggcgcacgtacttgaagtaaacggaaaagatgggtccttagagaagcgtttccgcgattttcttttatatatcgccgagtcaggtctgaaagaggtgatcacgtttccggaaaactccactattccagcgttctcacatcctgtagttatccttgatcccgtttgcgacacgaacaacgttacgagtcgtatcaccgaggatgaacgtaaggaaatcgttcgtattgccgaaaagagctgggcaacggcgaacttcgcttcagtcgaaggtgactacgacatctggaaggaattattcggacgctcgtttaaggtggaagacgctgcg

SEQ ID NO: 62 - protein, 315 aa, Salmonella enterica
MSLSNTALEYFDHNVLRLPGEKRKEYHAQVDNLVSELKKRITDKSKLKVKKVVKAGSFAKYTILRKIDDYPTDVDVVFYITGVEENSKSYEVLCNRIYDLLIEIYPTKKVEDFEIQRRAAKVTFVKSGLEVDVVPVLQHSTLADHGWQYDIQSGARNLTCAPCHIQFIRTRKDKDKHFRTLVRLAKRWKHFHDIPGLKSFHIELILAHLVDTDGAAENIEKRFREFLVYIARTKLGERIDFPENEGKTSVSFSDPVVIIDPASPENNVASRITKDEQEQIAKAAEAAWEAATYASTKNDDDLWKEIFGGRFKTKD

SEQ ID NO: 63 - DNA, 948 bp, Salmonella enterica
atgtctctatcaaatacggctcttgaatattttgaccataacgtgctgcgcctccctggagagaaacgcaaggaatatcacgcacaggtcgacaacctcgtaagcgagctaaaaaaacgcattaccgataagtcaaaactcaaagtcaagaaggtagtgaaagcgggttcattcgctaaatacactattctgcgcaaaattgacgactatccaacggatgttgatgttgttttttacatcaccggtgttgaagaaaacagcaagtcctacgaagttctgtgcaacaggatctacgatttgttgatagagatctacccaaccaaaaaagttgaggacttcgaaatccagcgtcgtgcagcaaaggtaacattcgtcaagagtggtcttgaagtagatgttgtccctgttctgcaacacagcactctggcagaccacggttggcaatacgatatccaaagcggagccaggaaccttacctgcgcaccgtgccacatccaatttatccgtacaagaaaggataaggataagcactttcgcacgttagtgcgtttggcaaaacgctggaagcatttccacgatatcccgggtctgaagtccttccacatcgaactgattctggcccatttagttgatacggatggcgcagcagaaaatatcgagaaacgtttccgggaattcttagtttatattgcccgtaccaaactgggcgaacgtatcgacttcccagaaaacgaaggcaagacatctgttagcttcagtgaccctgttgtgatcattgacccggctagtccagaaaacaatgtggcatctcgtataacgaaagacgaacaagaacaaatagctaaagctgctgaagctgcctgggaagcagcaacatatgcatctactaaaaacgatgatgatctctggaaagaaattttcggtggccgtttcaagaccaaggattaa

SEQ ID NO: 64 - DNA, 945 bp, Artificial Sequence
  Description of Artificial Sequence: Synthetic polynucleotide
atgtccttgagcaacacagccttagaatacttcgatcataatgtgttgcgccttcccggcgagaaacgtaaagagtatcatgcccaggtagataatttagtatctgagttgaaaaaacgcattacggataaaagcaaattgaaagtgaagaaggtagtaaaggctggaagctttgccaagtacaccattttacgtaagatcgacgactatccgacggacgtagatgtggtcttctatatcactggggtggaagagaactctaaatcctatgaggttctttgcaaccgtatttacgacctgttaattgaaatttacccaaccaaaaaggtcgaggacttcgagattcaacgtcgcgcagcaaaggtgactttcgttaagagtggtttagaagtggacgtagtgcctgtcttgcagcattcgacattggcagatcatggttggcagtatgatattcagtcaggcgcccgcaacttgacatgcgcgccctgtcacattcagttcatccgcactcgcaaggacaaagacaaacactttcgtacattagttcgccttgcgaaacgctggaagcattttcacgatattcctggcttgaagagcttccacattgaattgattctggcccatttagtagataccgacggggcagcagagaatatcgaaaagcgttttcgtgaatttttggtttacatcgcacgtaccaagctgggcgaacgcatcgacttcccggaaaatgagggcaaaacgtctgtctcgttcagcgaccccgtggttattattgacccagcgtcgcccgaaaataatgtggctagtcgcattaccaaggacgagcaggaacagattgccaaagcagccgaagctgcttgggaggctgcaacctatgcgtcgacgaagaatgacgatgatctttggaaagaaatcttcggcggacgctttaaaaccaaagat

SEQ ID NO: 65 - protein, 337 aa, Mycobacterium sp.
MQLADHFNVLLKDTVNLSQFKLDLLNQRVEAIYKALKADVEIGALITGKTPQGSWAHRTIINPVGDNEFDADFMLDMSQNPDWADNPKTYIDEVYAALHRHSTYGTMPHSRKCRCARLVYANSMHVDIVPHLNLADGREVIVNRDDNEWELTNPQGFTDWMKKQDSIASGNLRKVIRLMKYLRDHKNSFTGTRSVLLTTMLGEQVTDLRKLLDPSYYSNVPTTLLHVVQDLDTWLQANPIKPSIADPSGSGVTFDHRWGPDPESAQATYSYFRDRIHVHAADIEAAYEEKDKDRSVQLWQNIFGDGFKAPATTTASAKFPAATSAADSTVGRSGRAG

SEQ ID NO: 66 - DNA, 1014 bp, Mycobacterium sp.
atgcaactcgctgaccacttcaacgtcttgctgaaagacacggtcaatctcagccagttcaaactggacctactcaaccagcgcgtcgaagccatctataaggcactcaaagccgacgtcgaaatcggtgcgctgatcaccggcaagacgccgcaaggctcctgggcacaccgcacgatcatcaaccccgtcggtgacaacgagttcgacgccgacttcatgctcgacatgagccagaacccggactgggccgacaaccccaagacctacatcgatgaggtctacgcagccctgcatcggcacagcacctacggcaccatgccgcactcacgtaagtgccgctgcgcgcggctcgtctacgccaactccatgcacgtcgacatcgtccctcacctcaacctggccgacggtcgagaggtcatcgtcaaccgcgacgacaacgagtgggagctgaccaacccgcagggtttcaccgattggatgaagaaacaggactctatcgccagcgggaacttacgcaaagtgatcagactcatgaaataccttcgtgatcacaagaattcgttcaccggcacacgttcagtcctgctgaccaccatgctgggggagcaggtaacagacttgcgcaagctcctggacccgagttactacagcaacgtccccacaactcttcttcatgtcgtgcaagacctcgacacctggttgcaagcgaacccgatcaagccctccatcgccgacccgtccggttccggcgtgacgttcgaccaccggtggggaccagaccccgagagcgctcaggcgacctacagctacttccgtgaccgaatccacgtgcatgccgccgacatcgaagcggcctacgaggagaaagacaaagaccgcagtgtccagctgtggcagaacatcttcggcgacggattcaaggcgccggccacaacaaccgctagcgcgaagtttccagcagccacctctgccgcggactcaacagtggggcgctctggtcgggcagggtga

SEQ ID NO: 67 - DNA, 1011 bp, Artificial Sequence
  Description of Artificial Sequence: Synthetic polynucleotide
atgcagttggccgatcacttcaatgtattacttaaagacacagtgaatttaagtcaattcaaattggatttattgaatcagcgcgttgaggcaatttacaaagcattgaaagctgatgttgagattggagctttaattactggcaaaaccccccaaggttcttgggctcaccgcacaattatcaatcctgttggagacaatgagtttgacgcggactttatgcttgatatgtcgcaaaaccctgattgggcggacaatcccaaaacatacatcgatgaagtctacgctgctttacatcgtcactctacatacggcacgatgccccactcgcgtaagtgccgctgcgcccgcttagtttacgcaaactctatgcacgtagatatcgtcccgcatttgaaccttgctgacggtcgtgaagtcatcgtaaaccgtgacgacaatgagtgggagttgacgaatcctcagggctttacggactggatgaagaaacaagactcgatcgcatcaggtaatttgcgcaaggtgatccgccttatgaaatatcttcgcgaccacaagaatagtttcacaggaacccgttccgtactgttaacaacaatgttaggcgaacaggtcacagatctgcgcaaactgctggacccctcttattacagtaatgtgccaaccacattacttcacgtagttcaggatttagatacctggttgcaggccaatcctatcaagccatcaattgctgatccgtctggctctggagtaacattcgaccatcgctggggtccagatcccgaaagcgctcaagcgacatatagttacttccgcgatcgcattcacgtccacgcagcagatattgaagcagcatacgaagaaaaagacaaggatcgtagtgtacagttatggcagaacattttcggagatggattcaaagcacccgcaactaccactgctagcgctaagtttcctgcggctacttccgctgctgatagtacagtcggacgcagcggtcgcgccgga

SEQ ID NO: 68 - protein, 289 aa, Myxococcus xanthus
MPMLTVAQAFETFMNSLRLHDGEARDATRQEQYVFNAMRRQLRPTESFISGSYGRNTAIRPLHDIDLFLVLADDGRNPPEPEDALARVQWALRAEFHDKETRLQNRSVNINFTGTEIGFDVVPALYDPWEQGGYLIPDRRAGQWIRSNPRKHQEACDDANDVAKKKLKPWIKAIKRWNFRHDKPVPSFLLEVLACRGVTHSLGDKSYAEGLAQLFDYMCANILNQCPVPGSSGPTITSWIPQGRLVQAHQRLTQAVRVSKRALELEYSGYTVEALDLWRELLGTDFPVR

SEQ ID NO: 69 - DNA, 870 bp, Myxococcus xanthus
ttgcccatgctgacggttgctcaggcattcgagacgttcatgaactccctgcgtctccatgatggagaagcacgagatgcaacgcgacaagagcagtacgtcttcaacgcaatgcgccgacagttgcggcccaccgagtcctttatttcagggtcctatggtcggaacacggcgattcgaccactccacgatatcgatctcttcctcgttcttgcagatgatggaaggaatccacctgaacctgaggatgcgctagcccgcgtgcaatgggcgctccgtgcggagttccatgataaggaaacgcgactccagaatcgctcggtcaatatcaacttcactgggaccgagatcggcttcgatgttgttcctgcgctctacgacccgtgggaacagggtggctacctgattccagataggcgagccggtcagtggattcgcagtaatcctcgcaagcatcaggaagcgtgcgacgatgcgaatgacgtggcgaagaagaagctgaaaccttggataaaggccatcaagcgctggaattttcgccacgacaagccggtgccttcatttctcctagaagtcttggcctgccgaggagtgacccactcgctaggggataagagctacgcggagggactggcgcagttgtttgattatatgtgcgccaatattctgaatcagtgccctgtccctggaagctctggaccaaccattaccagttggattcctcagggacgcctcgttcaagcgcaccagcggttgacgcaagccgtgcgtgtgtccaagcgagcactggaattggagtattcgggatacacggtcgaagcacttgatctctggcgagaactcctgggaacggacttcccggttcggtag

SEQ ID NO: 70 - DNA, 867 bp, Artificial Sequence
  Description of Artificial Sequence: Synthetic polynucleotide
atgccgatgcttacggtcgcacaggcattcgaaaccttcatgaactctctgcgcttgcacgacggggaggcgcgcgacgctacacgtcaagaacagtatgtgtttaatgccatgcgccgccagttacgtccaacggaatcatttatctcaggttcatacggacgtaacactgcgatccgtccattgcacgacattgatctgttcctggtcttagcggacgatggacgcaacccgcccgagcctgaggatgcgttagcgcgtgtccagtgggctttacgcgcagagttccatgataaagaaacccgtcttcagaatcgctcagtgaacattaactttaccgggacggagatcgggtttgatgttgttccggcgttgtatgatccttgggagcaaggcgggtatttgattccggaccgccgcgctggtcaatggatccgtagcaacccgcgtaagcaccaagaggcttgtgacgacgccaatgatgtagccaaaaagaaattgaagccgtggatcaaggcaattaaacgctggaactttcgccacgacaaacccgtaccgtcattcttgctggaggttttagcctgccgtggggttactcactccttaggcgataaatcgtatgccgaagggcttgctcaattattcgattacatgtgcgccaatatcctgaaccagtgcccggtgccgggaagcagtggtccgaccatcacatcctggatcccccaaggtcgtttagtacaagcgcaccaacgcttaacccaggccgtgcgcgtaagcaagcgcgctttagagttggaatattcaggctatacggtcgaggcattggacttatggcgtgagttactgggaacggatttccctgttcgt

SEQ ID NO: 71 - protein, 300 aa, Pseudomonas aeruginosa
MLSIDEAFRKFKSRLELNEREQKNASQRQNEVRDYLQTKFGIARSFLTGSYARYTKTKPLKDIDIFFVLKDSEKHYHGKAASVVLDDFHSALVEKYGSAAVRKQARSINVDFGVHIDAEDNTDYRVVSVDAVPAFDTGDQYEIPDTASGKWIKTDPEIHKDKATAAHQAYANEWKGLVRMVKYWNNNPKHGDLKPVKPSFLIEVMALECLYGGWGGSFDREIQSFFATLADRVHDEWPDPAGLGPAISNDMDAARKQRAQQLLFQASQDASIAIDHARRGRNIEALRAWRALFGPKFPLS

SEQ ID NO: 72 - DNA, 903 bp, Pseudomonas aeruginosa
atgctgtcgatcgatgaagcttttcgcaagttcaagtcgcgtctggaactcaacgaacgcgaacagaagaatgcctcgcaacgccagaacgaagtgcgggactacctgcagaccaagttcggcattgcgcgcagcttcctgaccggttcctatgctcgatacacgaagacgaagccgctcaaggatatcgacatcttcttcgtgctgaaggactcggagaagcattaccacggcaaggccgcatcggtagtgctggatgatttccactctgcattggtggagaaatacggttcggcggccgtgcgcaaacaggcgcgctcgatcaacgtggatttcggtgttcacatcgacgcggaggacaacacggactaccgggtggtcagcgtggatgcggtgcccgcattcgacaccggcgaccagtatgagatccccgatacggcgtccggaaagtggatcaagacggacccggagatccataaggacaaggcgaccgcagcgcaccaagcctatgccaatgagtggaaaggtctcgtgcgcatggtgaagtactggaacaacaatcccaagcacggcgatctgaagccggtgaagccctcgttcctgatcgaggtaatggcccttgagtgtctttacggcggctggggaggatcgttcgatcgcgagatccagtcgttctttgccacgcttgccgatcgagttcatgacgagtggccggatcccgccggacttggcccggcgatcagcaacgatatggatgccgcgcgcaagcagcgcgcgcagcagctgctgttccaggcgagccaggacgcaagcatcgccatcgaccacgcgcgtcgtggtcgcaatatcgaagcgcttcgcgcctggcgcgcactgtttggccccaagttcccactgtcctga

SEQ ID NO: 73 - DNA, 900 bp, Artificial Sequence
  Description of Artificial Sequence: Synthetic polynucleotide
atgctgtccattgatgaggcattccgtaaatttaagtcccgcttagaattgaacgaacgcgaacaaaagaatgcatcccagcgtcagaatgaggtgcgtgactacctgcaaacaaaattcggcatcgcgcgttcatttttgaccggttcgtatgctcgttatacgaagaccaagccactgaaggacattgatattttttttgtgttgaaagacagtgaaaaacattaccacggcaaagccgccagcgtcgtgttggatgacttccatagcgctttggttgagaaatatggcagcgcagccgttcgtaaacaggcacgttctattaacgtcgattttggagtgcacatcgatgccgaggataacactgactaccgcgtagttagcgtggacgcagttcctgctttcgacactggtgatcaatatgaaattccagatacagcgtcgggcaagtggatcaaaactgaccccgagatccacaaggataaggcgacggcggcacaccaagcgtacgctaatgagtggaagggcctggtgcgtatggtcaaatactggaataataaccccaaacatggcgacttgaaaccagtcaaacccagttttctgatcgaggttatggcccttgagtgtctttacggaggttggggtggcagtttcgaccgcgagatccagagcttctttgcgacgcttgctgatcgcgtccatgatgagtggccagacccggctggccttggtccagccatcagcaacgatatggacgcggcccgtaaacagcgtgcccaacagttacttttccaagcaagccaggatgccagcatcgctatcgatcatgcgcgccgtggtcgcaacattgaagctttacgtgcgtggcgcgcattatttggccccaaatttcccttgtcc

SEQ ID NO: 74 - protein, 331 aa, Vibrio cholerae
MSDFRINKAINAFVAEHIDLHKDTVQKGRNSRNWLLDQLESMAQKAEHFPPRYTDRHKGFGSFHRSTKKQPLDDIDQLFCFSARGDMYYSEVGSTVYINIAGDNEIYGHLTSTNDNTKLSSIKMVNLMVSSLDSIGQYKNTPHRNGEAATLQAAAYDWNFDIVPCFFTAADANGKDYYLIPDGSGNWKKTDPREDKNRSARINQSHRGQILQLIRIIKYWNKRQTMATMGSYLLENMVLDYFENNKPSEEYIEFSIRAIFDYIANAVYCPVNDPKGIQGNLNNLDFDKMKSISERAKLDSLRLHNADQYEFSNPDKAINELKAIFGSDFVG

SEQ ID NO: 75 - DNA, 996 bp, Vibrio cholerae
atgtcggattttagaatcaataaggcgattaatgcatttgtagccgagcacattgacttgcataaagacactgttcaaaaaggacgaaacagtcgaaattggctgcttgatcaacttgagtcgatggctcagaaagcggagcattttcctcctagatacacagatagacacaaaggatttggttcatttcatagaagcacaaaaaaacaacctttagacgatatagatcagctgttttgcttttcagcacgaggagatatgtattactcggaggtgggaagtactgtttatatcaatatagctggtgataatgagatatatgggcatctaaccagtaccaatgacaatacaaaattaagttctatcaaaatggttaaccttatggttagctctttagatagtattggtcaatataaaaatacacctcacaggaatggtgaagccgcgactttacaagctgctgcttacgattggaactttgatatcgtgccttgcttctttacagcggcagatgcaaacggtaaagactactacttgattccggatggaagtggtaattggaaaaaaactgaccctagggaagataaaaaccgttctgctcggattaatcagtctcatagaggacaaatattacagctaatccgaataataaaatattggaataaacgacaaacgatggcgactatgggctcttaccttttagagaatatggttctcgattactttgaaaacaataaaccttctgaggaatatattgagttttcaatacgtgcaatttttgactacattgcaaatgctgtctattgccctgtaaatgaccccaaaggtattcaaggaaacttaaacaatcttgacttcgacaaaatgaagtcgatcagcgagagagctaaacttgactctttaaggctacataatgctgatcaatatgagttttctaatccggataaagcaatcaacgaactaaaagccatttttggctctgactttgttgggtag

SEQ ID NO: 76 - protein, 331 aa, Escherichia coli
MATTVISAFNEFLKESVNLDSNKTITARSSRDWLISKINNFDNNQSFPYIYQDIHINFGSFARRTKIRPLDDIDIMIGIKSDYCTYYENNEDIKILIDSNTARLNNYTHDNTTYVNSRKIINLFVSELSKIEQYSSSEINRRQEAATLKLKSYDWNFDIVPCFITVPDIYDRTFYLIPDGNGHWKKTDPRIDKNRTTDINVKHDGNMLNVIRIVKYWQKRKTMPTMSSYLLETILLNYYDNKSYCSPYVDIELEGVFRHISDVIYNTVNDHKNIQGDINNLPWDDRVKISNKALSDAEKVNLARDLEEKYDYQKSINVWREIFGDAFPQYG

SEQ ID NO: 77 - DNA, 996 bp, Escherichia coli
atggctacgacagttatctcagcatttaatgaatttctcaaagagagcgtaaatttagattcaaataaaacaataactgctcgcagtagtagagattggttaattagtaagattaataacttcgataataatcaaagttttccttacatatatcaagatattcatattaactttggttcttttgctcgaaggaccaagataagacctcttgatgatatagatatcatgattggtataaaaagtgattattgtacttactatgaaaataatgaagacataaaaatattaatagattcaaacacagcaagattaaataattatactcatgataatactacatatgtaaattcaagaaaaataataaatctttttgtttctgagttgtcgaaaatagaacaatattcatcttcggagatcaacaggagacaagaggctgctacactaaagttgaaatcttatgattggaattttgatatagtaccttgttttataacagtgccagatatttatgacagaactttttatcttattcctgatgggaacggtcactggaaaaaaacagatccaagaatagataaaaacagaacaactgacataaatgttaaacatgacggaaatatgttaaatgtaataagaatcgttaaatactggcaaaaaagaaaaacaatgcccacgatgagttcatatttattagaaactattttacttaattattatgataataaatcatattgttcaccatatgttgatattgagttagagggggtttttagacacatatctgatgtaatatacaatactgtaaatgatcataaaaacatccaaggtgatattaataacctaccttgggatgatcgagtgaaaatatccaataaagcattatcagatgctgaaaaagtaaatttagctagagatttagaagaaaaatatgattatcagaagtcgataaatgtttggcgtgaaatttttggtgatgcatttccacaatatggataa

SEQ ID NO: 78 - protein, 334 aa, Desulfotomaculum alkaliphilum
MATTVNNAFKEFMRDKVNLDPDKTKTARKSRDNLIDNIHSLGSNEDFFNLYHDIDIAFGSFARKTKIRPLDDIDIMIGINGDGSTYYDSGYEVKIYVNDDNSPQKSCCNDNTNILNSTKVINKFIKELKNLNDYKKAETHKNGAAATLQLKSYEWNFDIVPCFRTTKESDGRDYYLIPDGKGNWQKTDPRKDRDKVTTLNQKHNGLMLETIRLVKYWNRRPTMPLMPSYALECLLLQYFDSVDSVSDYIDLRFRDVLYYIKDNIWYSINDPKEIQGDLNTLTYDEKLKISNKAESDYEKAKEAISAEIDDKDHEKAIKKWAEIFGSEFPEYSED

SEQ ID NO: 79 - DNA, 1005 bp, Desulfotomaculum alkaliphilum
atggcgacaactgtaaataatgcatttaaagagtttatgcgagataaggtcaacttggatccggacaaaacaaaaactgcaagaaaaagcagggacaatcttatagataatatacatagtttgggttctaatgaagattttttcaatttatatcatgacattgatattgcatttggctcatttgcaagaaaaacaaaaataagacccttagatgatattgatataatgattgggattaacggtgacggtagcacttattatgattcaggctatgaggttaaaatttatgtaaatgatgataattctccacaaaagagttgttgcaatgacaatactaacatactcaattcaacaaaagttattaacaaatttataaaagaacttaaaaatttaaacgattataagaaagcggagacccataagaatggtgcggcagccacccttcaactaaaatcttatgaatggaattttgatattgtaccatgttttcgaacaactaaagaatctgatggccgagattattatttaataccagatggaaagggaaattggcaaaaaacagatccacgcaaagatagggataaagtaactactttgaaccaaaaacataatggattaatgttagagactataagattggtaaagtattggaatagaagacctacaatgccattgatgccatcttatgcattagaatgtttattactacaatattttgatagcgtagatagtgtaagtgattatattgatttaagatttagagatgttttatattatatcaaagataacatttggtattccattaatgatccaaaagaaattcaaggagatttaaacacacttacatatgatgaaaaactgaaaatttcaaacaaagcagaaagtgattatgaaaaagcaaaagaagcgatttctgcagaaatagatgataaagatcatgagaaagccattaaaaaatgggctgaaatattcggaagcgaatttccagaatatagcgaggattag

SEQ ID NO: 80 - DNA, 1002 bp, Artificial Sequence
  Description of Artificial Sequence: Synthetic polynucleotide
atggccactacggtaaataatgcgtttaaggagtttatgcgcgataaagtcaacctggacccggacaaaactaagacggcccgcaagtcgcgtgataatttgatcgacaatatccattcgttggggtcgaacgaggatttttttaatttgtatcacgacatcgatatcgcgtttggaagttttgcccgcaaaaccaaaattcgccccttggatgacatcgacattatgattggcattaacggtgacggttcaacatactacgattcggggtacgaggtaaagatctatgttaacgatgataattccccacagaaaagttgctgcaacgacaacaccaacattttaaattccacaaaagttattaacaagttcattaaggagctgaagaaccttaacgactacaagaaagcggaaacgcataagaatggggccgccgcaactcttcagttaaaaagttatgagtggaatttcgacattgttccatgttttcgcaccacgaaagagtctgacggtcgtgactattaccttattccagatggtaagggcaattggcaaaaaaccgatccacgtaaagatcgcgacaaggtcacgacactgaaccaaaaacataatgggttgatgcttgagaccattcgcttagtcaaatactggaatcgccgtcctactatgcccttaatgccttcttacgccttagaatgcttacttcttcagtatttcgattcagtggactcggtttccgactatattgacttacgttttcgcgacgtactgtattatatcaaagacaacatttggtacagcattaatgacccaaaagaaattcagggcgacttgaacacgttaacctatgacgaaaagctgaaaattagcaataaggcggagtctgactacgaaaaggccaaggaggcaatctcagcggagatcgacgacaaggatcacgagaaagcgatcaagaaatgggctgaaatcttcggatctgaatttccagagtatagtgaagac

SEQ ID NO: 81 - protein, 331 aa, Shigella sonnei
MATTVIAAFNEFMKDTVNLKKADTDDARASRDWLIGKMNDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWQRRPTMPSMSSYLLETLILDYYAGRTSCSSFVDMELEALFRHLGQSVRYSVNDPKGIQGDINSLSAEARKAISDRCYLDAQKVSEARWFENNKEYEKSINKWRDVFGPFFPVYG

SEQ ID NO: 82 - DNA, 996 bp, Shigella sonnei
atggcgaccacagtaatagctgcctttaacgaatttatgaaagataccgtgaatctcaaaaaggcagataccgatgacgcgcgtgcaagtcgcgactggcttatcggtaagatgaatgattttgagaaggacgataaatttccggtgagttttccagcgatccatattgcctttggctcctttgccagaagaaccaaaatccgtccgcttgatgatatcgatctgatgtttggcttaaccgggcaaggtgccacctataccatcctgagtgaccggataactgtaacctcctccggagaggggtcacgtctgcacagttaccgccattccggagctgacaccgtctgctccgtcagaattctgaatgcctttaaaaaccgcctgcaggacattgcccagtacgcccaggctgatatcaggcgtaaccaggaagctgtcacgctgaaactggtcagcaaggactggaattttgacatcgtcccctgctttattaccagcgaagatgcctttggacggacttactacctgatccccgatggcaacggccactggaagtttaccgacccccgtaaagacagggacagagtcactactatcaatgtgcagaataacggcaatgtgctcaatgtcatcagagcagtcaaatactggcagcggcgaccgacgatgccatccatgagttcctacctgctggaaacgctgattctggactattacgctggcaggacatcctgctcatcgtttgttgacatggagctggaagcgcttttccgccaccttggtcaatccgtgcggtactctgtcaacgatcccaaaggcatacagggtgatatcaactcactttcagccgaggcacgtaaggcgatatcggacagatgttatctcgatgcgcaaaaggtatcggaggcgagatggtttgaaaataataaagagtatgaaaaatccatcaataaatggcgcgatgtgttcgggccattctttcctgtttacgggtga

SEQ ID NO: 83 - DNA, 993 bp, Artificial Sequence
  Description of Artificial Sequence: Synthetic polynucleotide
atggcaacaactgtcattgccgctttcaatgagttcatgaaggatacggtcaacttgaagaaggcagatactgacgatgcccgcgcttctcgtgactggttaatcggtaagatgaatgacttcgaaaaggatgataagttccctgtttcgtttcccgccatccatatcgcgtttgggtcattcgcgcgccgcaccaagattcgcccccttgacgacatcgaccttatgttcggcttaacaggacaaggggcaacttacacgatcctttcggatcgtatcaccgtaacatccagtggggaaggctcacgtttacactcatatcgccacagtggggctgacaccgtatgtagcgtccgcattttgaatgcgtttaagaaccgtttgcaggacatcgcccagtatgcacaggccgatatccgccgtaatcaagaagcagtgactcttaaacttgtatcaaaagactggaattttgatatcgtcccatgttttatcacttcagaggacgccttcggacgtacttattaccttatcccagacggaaacggccattggaaatttaccgacccacgcaaggatcgtgatcgtgtaactaccatcaacgttcagaacaatggtaacgtcctgaatgtaatccgtgcggttaaatattggcagcgtcgccctaccatgccttccatgtcctcatatctgctggagacccttattctggactattacgctggacgcacctcctgcagctcgtttgtagatatggagttagaagctttatttcgtcacctgggtcagtctgtccgttatagtgttaacgatcccaaaggcatccaaggcgacattaactctctttcagcagaggcacgcaaagcaattagtgatcgttgctacttggatgcccagaaagtgagtgaggcgcgttggtttgagaataataaggagtatgagaaatcgatcaataagtggcgcgacgtatttggaccgtttttccctgtgtatgga

SEQ ID NO: 84 - protein, 331 aa, Shigella flexneri
MTMTVNAAFNEFMRDTVNLLKADTDDARASRDWLIGKVNDFEKDGTFPVNHPGIHIAFGSFARRTKIRPLDDIDLMFGLSAESATHTIYSGHITLNSSGENSRLHQYRHPGENTICSVRILNAFKNRLQGISQYAQAEIRRNQEAVTLNLSSKDWNFDIVPCFISTADAFGKNYYLIPDGKGHWKKTDPRIDRNRVTDINVKNDGNVLNVIRAVKYWQRRPTMPAMSSYLLETMILDYYANKTDCSEFIDIELRALFNHLGLFVRYSVNDPKGIQGDINTLSMEDRQKISDRCYLDAQRAAEARQFERDNDHEKSINRWRDVFGPQFPAYG

SEQ ID NO: 85 - DNA, 996 bp, Shigella flexneri
atgaccatgaccgtaaatgctgcctttaacgagtttatgagggataccgtgaacctcttaaaggcagataccgacgacgcacgtgcaagtcgcgactggcttatcggtaaggtaaatgattttgagaaggacggaacatttccggttaaccatccgggcatacacattgcattcggctctttcgccagaaggactaaaatacgcccgcttgacgatatcgatctgatgttcgggttatctgctgaatcggcgacacacacgatatacagcggtcacataacgctgaattcttccggagaaaactcgcggctgcaccagtacaggcatcctggagaaaataccatctgttctgtaaggatcctgaacgcctttaagaaccgactgcaaggtatttctcagtacgcacaggctgaaatcaggcgtaatcaggaggccgttacgctcaatctgagcagtaaggactggaattttgacatcgtgccttgctttatttctaccgcagatgcgtttggtaagaattattacctgatacctgacggcaaagggcactggaagaaaaccgatccccggattgaccggaacagggttacggatatcaatgttaaaaatgacgggaatgtccttaacgtcatcagagcagttaaatactggcagcggcggcccacgatgcccgcgatgagctcctatctgcttgaaacaatgatactggactattatgcaaacaagactgactgctcagagtttattgatatcgagctgcgggcccttttcaatcatttaggcctgtttgttcggtattctgttaacgacccgaagggtattcagggcgatatcaataccctatcaatggaagatcgtcagaaaatttcggacagatgctatctcgatgctcagagggctgcagaagccagacagtttgaaagggataatgatcatgaaaaatccattaacaggtggcgggacgtgtttggccctcaatttccggcttacgggtga

SEQ ID NO: 86 - DNA, 993 bp, Artificial Sequence
  Description of Artificial Sequence: Synthetic polynucleotide
atgacgatgactgtaaacgccgccttcaatgagtttatgcgcgacactgtcaaccttctgaaagcggatactgatgatgcgcgcgcctcccgtgactggttgatcgggaaggtcaacgacttcgagaaggatgggacgttcccagtgaaccaccccggtattcacatcgcgtttggtagttttgcgcgtcgtaccaagattcgtcctttggacgacattgatttgatgttcggtttgagcgccgaaagcgccacccacacgatttatagtgggcacattacgttaaattcctccggcgaaaacagccgcttacatcaataccgccacccgggtgagaataccatttgtagcgtccgtattttgaacgctttcaagaatcgtcttcaagggatctctcagtatgctcaggcggagattcgccgcaaccaggaagccgtgacgctgaatttgtcatcgaaagactggaactttgacatcgtcccttgttttatctcgactgcagatgcctttgggaagaattactacttaatccccgatgggaaaggacactggaagaagactgatccccgtatcgaccgtaaccgtgtcacagacatcaatgtcaaaaatgacggaaatgtcttaaatgtgattcgcgcggtaaaatactggcaacgccgtccgaccatgcccgccatgagtagctatttattggaaacaatgattctggattattacgcaaataaaactgactgctcagaatttattgatatcgagttgcgcgcattatttaatcatttgggtttgtttgttcgttattcagttaatgacccaaagggtatccaaggggatattaatacactttcaatggaggatcgtcaaaagatttccgatcgctgttatttagatgctcagcgcgctgcggaagcacgccaatttgagcgtgataatgatcacgagaagtctatcaatcgctggcgtgacgtctttggaccccagttccctgcgtacggg

SEQ ID NO: 87 - protein, 431 aa, Campylobacter jejuni
MNVSNTFQEFLQNLAIDNKEEISNRYKEITKVLNIKYRNTESKISNSLQVGSYGRFTAIKGISDLDMIYILPRTEYKRFKDHGQSALLQEVKKTIQSRYPKTDMRRDGQVVVISFTNYQIEVLPAFECKNGSFLYPDTNDGGSWKNTNPRLEIKAISDLHEKNKNLRNLCKMIRSWKNYHSVAMGGLLIDSLAYNFLNSTTYYNDKSFAHYDQLIKDFFKYLSDLQNTNYVFAPGSYQKVYIKSKFQTKAKKAHKLVLEAIEAQKNKNANQKWKKIFGRGFPSAVQLATEAMNESISAWTNTEEFIEDKYNVDIRYDLSIDCEVTQIGFRTDKLSNILAKNIRLLPNKELKFQIIHNDTKGDFEIYWKVLNRGDEAQKRNMIRGQIVKGTKIKKETTNFRGDHIVECYIVQNNTVVAKDRIHVPISEGIYS

SEQ ID NO: 88 - DNA, 1296 bp, Campylobacter jejuni
atgaatgtatcaaatacttttcaagagtttcttcaaaatctagcgatagataataaagaagaaattagtaacagatataaagaaattacaaaagtacttaatattaaatatagaaatactgaatctaaaatatcaaatagtctgcaagtaggttcctatggtagatttactgcaattaaaggcatttctgatttagatatgatttatattttaccgcggacagaatataaaagatttaaagatcatggacaatcagcattacttcaagaagttaaaaaaactattcaatcaagatatccaaaaacagatatgcgaagagatgggcaagttgtagtcatatcttttactaattatcaaatagaagtactaccagcttttgaatgcaagaatggaagttttttatatccagatacaaacgatggaggtagttggaaaaatactaatccacgactcgaaataaaagccatatctgatttacatgaaaaaaataaaaatttgagaaatttatgtaaaatgattagatcttggaaaaactaccatagtgtggcaatgggtggacttttaattgatagtttagcttataattttttaaattcaactacatattataatgacaaaagttttgcacattacgatcagttaattaaagatttttttaaatatttatcagacttacaaaatacaaactatgtttttgcacctggtagctatcaaaaagtttatattaaaagtaaatttcaaacaaaagcaaaaaaagcacataagttggttttggaggctattgaagcacaaaaaaataaaaatgctaatcagaagtggaaaaagatatttggaagaggatttccatcagctgttcagttagctacagaagctatgaatgaatctatatcagcttggacaaatacagaagaatttatagaagataagtacaatgttgatattagatatgatttatcaatcgactgtgaagtaactcaaataggatttagaacagataagctttcgaatattcttgctaaaaatattagattgttaccaaataaagagttgaaatttcaaataattcataatgacacaaaaggagattttgaaatttattggaaagtcttgaataggggtgatgaggcacaaaaaagaaatatgattagaggacagattgttaagggaaccaagataaaaaaagaaacaacaaattttcgtggagatcatatagttgagtgttatattgtacaaaataatacagtagttgctaaagacagaattcatgtaccaatcagtgaaggaatatattcatga

SEQ ID NO: 89 - DNA, 1293 bp, Artificial Sequence
  Description of Artificial Sequence: Synthetic polynucleotide
atgaatgtatctaatacttttcaagaatttcttcagaatttagccatcgacaacaaagaggaaatctccaaccgttataaggaaatcactaaagtactgaatattaagtaccgtaacaccgaatcaaagatcagtaactcattgcaggtcggcagttatggacgtttcactgcaattaagggcatctccgaccttgatatgatctacatccttccccgcacggaatacaaacgtttcaaggaccatggtcagtcggctttgttgcaggaggtaaaaaagactatccaatcacgctatcctaaaactgacatgcgtcgcgatgggcaggtcgtcgtcatcagtttcaccaactaccaaattgaagttcttcctgcttttgaatgtaaaaatggaagcttcttatatcctgataccaacgacggtgggtcatggaagaacactaacccccgtctggagattaaagctatctccgatttacatgaaaagaacaaaaacttgcgtaacctgtgcaagatgattcgtagttggaagaactatcacagtgtggctatgggagggttgcttatcgactcactggcatacaatttcttaaattcgaccacgtactacaacgataagtcgttcgcccattacgatcaattgatcaaagactttttcaaatatctgagtgatcttcagaatacgaactatgtgtttgcgccgggaagctatcagaaagtctacatcaaatcgaagttccagaccaaagccaagaaagctcataaactggtattggaagctattgaggcacagaaaaataaaaatgcgaatcagaagtggaaaaagattttcggtcgtgggttcccatcggctgttcaactggcgaccgaagcgatgaatgaatcaatctcagcgtggacaaatacagaagaatttattgaggacaaatataatgttgacattcgttacgacttgtccatcgactgcgaggtaactcaaatcggattccgtactgacaagttgtcgaacatccttgctaaaaacatccgtcttttgcccaataaggaattgaaattccagattattcacaacgatacaaaaggtgacttcgagatttactggaaagttcttaaccgtggggatgaggcgcagaagcgcaatatgattcgcggtcaaattgtcaagggtacgaagattaagaaagaaacgacaaacttccgtggcgaccatattgttgaatgttacattgttcagaataacaccgtcgttgccaaagaccgcattcatgtacccatttctgagggaatttatagc

SEQ ID NO: 90 - protein, 291 aa, Desulfotomaculum hydrothermale
MSISDKFSTLIDNLKITNGDTISSRYKAITKRLNTDFWNSSSEISHSRYVGSVGRGTAIRGVSDVDMVMELPSDVYWQHDAYKSNGQSALLQAVKESIKKTYPNTHNVGDGQVVVVSFTDGIKFEVIPVFLNREGTYTYPDANNGGGWKVTDPVAEINAINDANNTYNQKVKHLAKMARAWKEKCNVPVPGILIDTLVFNFMKKWEYNDKSFLYYDFMTRDFLKYLSEQNPSQGYWLAPGSNRRVYGKGKFESKAKSSYNDALRAIEYENAKKEYSANQEWRKIFGNYFPS

SEQ ID NO: 91 - DNA, 876 bp, Desulfotomaculum hydrothermale
atgtcaatatccgataagtttagtacactaattgataaccttaagattacgaatggggacaccatttctagccgatataaggccattacgaaaagactgaacactgatttttggaattcttcctcagagataagccatagcagatatgtaggctcagtgggtaggggtactgctattaggggtgtaagtgacgttgatatggtcatggaattgccaagtgatgtttactggcaacatgatgcctataaaagtaatggccaatcggcccttctacaagctgttaaggaaagcataaagaaaacctatcctaatactcataatgttggggatggacaagttgtggttgtgagtttcactgacgggattaaatttgaggttataccagtatttttaaatcgtgaaggaacctacacttatccagatgctaacaatggcggaggttggaaagtaaccgacccagtagccgaaattaatgccattaatgatgcaaacaacacctacaatcaaaaagtaaagcacctagccaaaatggccagagcatggaaggaaaagtgcaatgtacctgttccgggcatattgattgataccctggtttttaattttatgaagaaatgggaatacaatgataaatcgtttttgtattatgattttatgaccagggatttcctaaagtatttatccgaacaaaaccctagccagggttactggctagcccctggaagtaaccgaagagtgtatggaaagggtaaatttgaatcaaaggctaaaagcagttacaacgatgctcttagggccatagaatatgaaaatgccaagaaagagtactcagctaaccaagaatggaggaaaatattcgggaactattttccgagttaa

SEQ ID NO: 92 - DNA, 873 bp, Artificial Sequence
  Description of Artificial Sequence: Synthetic polynucleotide
atgagtatttcagataagttttcaactctgattgacaacctgaaaatcaccaatggagacaccatttcatctcgctataaggctattactaaacgcttgaacaccgatttttggaactcctccagcgaaatttcccatagccgctatgtcggttcggtgggtcgtggcaccgcaattcgcggcgttagcgacgtagacatggtcatggaattaccttcagacgtctactggcagcacgatgcttataaatccaacggccagtcggctcttctgcaagccgtaaaggagtccattaaaaagacctaccctaacacccacaatgtcggagacgggcaagtagtggttgtatcctttactgacgggatcaagtttgaagtaatcccagtatttctgaaccgtgaggggacgtatacctacccagatgcaaataacggcggcgggtggaaagtaactgacccagtcgcggaaatcaacgccattaatgatgctaataatacatataatcagaaagtaaagcatctggccaaaatggcccgcgcttggaaggaaaagtgcaacgttcctgtacctggtatccttatcgacaccttggtgttcaactttatgaagaaatgggagtataatgataagtcatttctgtattacgattttatgacccgcgatttcctgaagtacctgtctgagcaaaacccatcccaagggtactggttggcacccggttccaatcgccgcgtgtacggaaaagggaaattcgagtccaaagcaaaatctagctacaatgatgcactgcgtgcgatcgagtatgagaatgcaaagaaggagtattctgcaaaccaagagtggcgcaagatttttgggaactactttcctagt

SEQ ID NO: 93 - protein, 433 aa, Leptospira interrogans
MSTSDLFSSFIENLAISNMESISSRYGEITAALNKEFRNTDSKIANTLQVGSFGRKTGINGISDLDILYFMPKGKWDTYKDSKQLSLLQDVKSAILKRYPKTEVRVDRLVVTITYTDFHIEVQPVFEQDDGSFKYPDTKDGGNWKITKPREEMEAVSKLDADKNSNLKRLCKMARAWKNKHGVEMGGLLIDTFAYNFLSSTDNYDTKSFNSYGELNRDFFQFLSEQPEQDYYRAPGSNQNVRVKKQFQKKAKKAYDLCVKAIEAKDESGVNDKWKKVFGRPFPSNIESTSDSVQKTASTLWTNTEQFIEDQYPIDIRYDMSIDCNVNQDGFRESTLRQMIEKKYPLQPKKTLEFRITSINVPGSYEIYWKVLNRGEEARKRNQIRGQIIKDSGNYEKVEQTLFKGDHVVECYAIKNGILVAKDRIHVPISLNG

SEQ ID NO: 94 - DNA, 1302 bp, Leptospira interrogans
ttgtctacatctgatttgttttcatcattcatagagaatcttgcaataagtaatatggaatcaattagctcacgatatggagaaattacagcagcgctaaacaaggaatttcgaaatactgattcaaaaattgcgaacaccttacaagttggatcctttggaagaaaaaccggcataaacggtatctcagatttggatatattatattttatgcctaagggcaagtgggatacttataaagattcaaaacaactcagccttctccaagatgtaaaatcagcgatacttaaaagatatccaaagacagaagtacgcgttgatcgccttgtcgttacgataacttatacggatttccatatagaagtgcagccagtatttgagcaagacgacggtagctttaagtatccagacactaaagatggtggcaattggaagattacaaaacctagagaagaaatggaggccgtttcgaagttagacgcagataaaaattcaaatcttaaaagactttgtaaaatggctcgggcatggaaaaataaacacggtgtcgaaatgggcgggctgcttatcgatacatttgcatataattttctaagttcgactgataattatgatacaaaaagtttcaactcgtacggagaactcaatagagatttttttcaatttctttcagagcagccagagcaggattactaccgcgcaccgggtagcaaccagaatgtaagagtgaaaaaacaatttcaaaagaaggcaaaaaaggcttatgatctttgcgtcaaagcaatagaagccaaagatgaatcaggcgtcaatgacaagtggaagaaagtttttggtcgtccatttccttcaaatatcgagtcgacttccgatagcgttcaaaaaactgcttccactctttggactaacactgagcaatttattgaagaccaatatccaatcgatatacgttatgatatgagcattgattgcaatgttaaccaagatggcttcagagaaagtactttaagacaaatgatagagaagaaatatccgttgcaacctaagaaaacattagaattcaggattacttctatcaacgttccaggatcttatgaaatctactggaaggtgcttaacagaggcgaggaagcgcgaaagagaaaccaaattaggggacaaattattaaagattctggtaactatgaaaaagttgaacaaacgttattcaaaggagatcatgttgttgaatgttatgccataaagaatggaatcctggtagcaaaagatagaattcacgtcccgatcagtttaaacggatag

SEQ ID NO: 95 - DNA, 1299 bp, Artificial Sequence
  Description of Artificial Sequence: Synthetic polynucleotide
atgagcacgtcggaccttttttcatcatttattgagaatttagccatttccaacatggagagcattagttcgcgctatggcgagatcacagcagctttaaacaaggaatttcgcaacacggatagtaagatcgcaaacacgttacaagtcggtagttttggacgcaaaacgggcattaacggaatctctgaccttgatattttgtactttatgcctaaggggaaatgggacacatacaaagactccaaacaattgtcccttttgcaagatgtaaaatcggctatcttgaagcgctacccgaagacagaggttcgtgtagaccgcttagtcgttactattacatacacagatttccacatcgaggtccaaccggtgtttgaacaagatgacggctccttcaaatatccagatactaaagacggtgggaactggaaaattacaaaaccgcgcgaagagatggaagcagtttcaaaattagatgcagacaaaaactccaaccttaagcgtctgtgcaagatggcccgtgcttggaaaaacaagcacggggtagaaatgggggggcttcttattgatacatttgcatacaatttcctttcgagtacggataattacgacaccaaatcttttaatagctatggcgaacttaatcgtgatttctttcaatttctgagtgagcagcctgaacaggattattatcgtgcaccaggtagcaaccagaatgtccgcgttaagaagcagttccagaagaaagcaaaaaaagcgtacgatctttgcgtaaaagcaatcgaagccaaggacgaatctggagttaatgacaagtggaaaaaagtctttggacgtccctttccatcaaacatcgagtccacttcggactccgtgcagaagacagcttccaccctgtggaccaacaccgaacaattcattgaggatcaatacccaattgatattcgctacgatatgagcattgattgtaatgtaaatcaggatggattccgtgaatcaacacttcgtcagatgattgagaaaaaatatcctcttcagcccaaaaaaacgcttgagttccgcatcacatccattaacgtgcctggcagctacgagatttattggaaggttcttaatcgtggtgaggaagcgcgcaagcgcaatcagatccgcggacagattattaaagacagcggcaattatgaaaaagtagaacaaactctgttcaaaggcgaccatgtggtcgaatgctacgctattaagaacggcatcctggtggctaaagaccgtatccatgtaccgatttccttaaacggg

SEQ ID NO: 96 - protein, 442 aa, Escherichia coli
MSHRELFSEFLENLNLDLKQAKKISYHYRKITKSLNLAFRGTSSRVANRLKVGSVGRHTAIKGISDLDMLYIMPPNQYEYYNRKDNGQSALLTDVRNILAEEYPDQTVKKDRLVVQIIFKNFYVEVQPVFRQDDDSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEERKERYLALGSNQHVRVKSPWFGRAAKHAYELCCDALDAEGAASENDRWRKVFGRAFPRRKVGIMEARLGLESHAADAVPWTDTEEFIEDKYPVDIRYSLNLDCTVTQDGFPPRSLREMLTRRFRLSARKSLLFRADLTEMEAEEPYTVMWKVLNVGDEARRRNMIRGQIVSDGGYCTKKETTDFRGDHMVECYVIKNEVVVARAQIEVPIS

SEQ ID NO: 97 - DNA, 1329 bp, Escherichia coli
atgagccacagggaattgttcagcgaatttcttgaaaatttgaatcttgacctcaaacaggcaaaaaagatcagctatcactatcgaaaaataaccaagtcattaaatcttgcgttcagaggaacgagttcccgggtagcaaaccgcttgaaagtggggtcagtaggcagacataccgcaataaaaggcatatccgatctggatatgctttatattatgccccccaatcagtatgaatattataaccgtaaggataatggtcagtctgcattgcttacagatgtcagaaacattctggcggaagaatatcctgaccagactgtgaaaaaggacagactggttgttcagatcatctttaaaaacttttatgtcgaggttcaacctgtattcagacaggatgatgacagctttaaattccctgaaagctataatggaggagcatggcgcattacaaaacctcttcacgaaaaggcggccatgaccgcattttcgcgagataaatccaataatctgcgcaagctgtgtaaaatgatcagagcctggaagaacctgcatggcgtcaatatgggtggcttactgatagacacactagcgtatcgctttctttcatcaacatcagattatgacaataccggaaatggcagcctgggagccctcgccagagacttttttgaatatctgtcaaatgaggagagaaaggaaaggtatctcgcgttaggcagtaatcagcatgtacgtgttaaatctccctggtttggccgggcagcgaaacacgcgtatgaattatgttgtgatgccttagacgctgagggggctgccagtgaaaatgaccgctggcgcaaagtgttcggacgagccttccccagacgtaaagtgggtattatggaagcccgtcttggtctggaatcgcatgcggcagatgctgttccctggaccgataccgaagagtttatagaggataaatatccggtggatatcaggtactcactcaaccttgactgtaccgtaacccaggatggtttccctcccagaagcctgagggagatgcttaccagaagattccgcctctccgctcgaaaatctctccttttccgggcagacttgacagaaatggaggcagaggaaccctacaccgttatgtggaaggtactgaacgtgggtgacgaagcacgcagaagaaatatgatccggggacaaatcgtttcggacggcggctactgtacgaagaaagaaactaccgacttccgcggagatcacatggtagaatgctatgtgataaaaaatgaggttgtggttgcccgggcccagattgaagttcccataagctga

SEQ ID NO: 98 - DNA, 1326 bp, Artificial Sequence
  Description of Artificial Sequence: Synthetic polynucleotide
atgagtcaccgtgaactgttctcagagtttcttgaaaacttgaatttagatttaaagcaggccaaaaagatctcttaccactatcgcaaaattacgaaatctctgaatttggctttccgcggaacatcttcccgtgtcgccaaccgtctgaaagttggctcggtggggcgtcacaccgcaattaagggcattagcgaccttgatatgctgtacattatgccaccaaatcaatacgagtactataaccgcaaagataatggccagagtgcccttttgacagacgtacgtaatattcttgccgaggaataccccgaccaaacagtcaaaaaggatcgtctggtggttcaaattatcttcaaaaatttctacgtggaagtgcagccagtcttccgtcaggatgacgatagcttcaaattccctgaatcatacaatggcggcgcatggcgcattactaagcctttgcacgaaaaagctgctatgactgcgttctctcgtgacaagagtaacaacttacgtaaattgtgtaaaatgatccgtgcttggaagaacttgcatggcgtcaacatgggggggttgttgattgacacattagcgtatcgctttctgtcttcgacttccgattacgacaataccggtaatggctccctgggcgccttggcccgcgatttctttgaatacttaagcaatgaggagcgtaaggagcgttatcttgctcttggttctaatcaacacgtacgtgtaaaatcgccctggtttggacgtgctgctaaacacgcttatgagttatgctgtgatgcgcttgatgccgagggtgcggcatcggagaatgaccgctggcgtaaggtattcggacgtgcctttccccgtcgtaaagtgggcatcatggaagcccgtttaggattggagtcccacgcagctgacgccgtgccttggacagacacagaagagttcatcgaggacaagtatcctgtagatattcgttactcattaaacctggactgtaccgtgacacaggatggcttcccgccccgctctttacgtgaaatgctgacacgtcgtttccgtttgtcggcgcgcaaaagccttcttttccgcgctgatcttactgaaatggaagccgaggagccatatacagtgatgtggaaggtcttaaatgttggcgatgaggcacgtcgtcgtaatatgattcgcggccagatcgtgagtgacgggggctactgcacgaagaaagaaaccaccgatttccgtggcgatcacatggtagagtgctatgttattaaaaatgaggtagttgtggctcgcgctcagatcgaggtgccgatttcc

SEQ ID NO: 99 - protein, 325 aa, Bacillus cereus
MADITKSINQFITEEIKLVQDDISSAVSSRKWFLNKIETAIQNRENEPVLYTPKIFNFGSYFKGTKVTNVDEFDVLVVIDSSPGIFKEGETVIGTGVGSANPNPIYNEKYKKSDGSGVSPSKLLNWLKGITEEVVKGFNGQAPERDGQAITATIKSKNLKIDLVPALKFEKDDGTGFYAIPKGDKGNGWIKTQPKDDMDALEDAAKEKDGFRNVIRLLKFIRGEYNFKVSSFAIESAVVNYSETGLWENDLYIDLKGCLGYLAQNFRDGEIKSTVDKSANLISGVESLASYATKIDKIITALGNLESEQDQKVANEEVSKIFKNE

SEQ ID NO: 100 - DNA, 978 bp, Bacillus cereus
ttggcagatatcacaaaatctataaatcaatttatcacagaagaaataaaattagtacaagacgacataagttcagctgtatctagtaggaaatggttcttgaataaaattgaaactgctattcaaaatagagaaaatgagcctgtactatacactcctaaaatttttaactttggtagttattttaaaggtacaaaggtcaccaatgttgatgaattcgatgtgttagtagtcattgattctagccctggtatatttaaagaaggagaaactgttattgggacaggggtagggagtgctaatcctaaccctatttataatgaaaaatataaaaaaagtgatggttcgggagttagcccaagtaagttgttaaattggttaaaaggaattacagaagaggttgttaaaggttttaatgggcaagcgccagaaagagatggacaagctataacagcaaccataaagtctaaaaatttaaaaattgatttggtaccagcgcttaaatttgaaaaagatgatggtactggtttttatgctattcctaaaggagataaagggaatggatggattaaaactcaaccaaaggacgatatggacgctttggaagatgctgcaaaagaaaaagatggatttaggaatgtaattcgtttattgaagtttattcgtggtgaatataactttaaagtatcttcatttgctattgaatcagctgttgttaactatagcgaaacaggattgtgggaaaatgatttgtacattgatttaaaaggttgtttaggttatttggcacagaactttagagatggagaaataaaaagtaccgtcgataaaagtgctaatttaattagcggtgtagaaagccttgcttcttatgctactaaaatagataagattataacagcacttggaaacttggaaagtgaacaagatcaaaaagttgctaatgaagaagtgagtaaaatatttaaaaatgaatag

SEQ ID NO: 101 - protein, 335 aa, Bacillus thuringiensis
MLRFGEGELGLADITKSINQFITDEIKLFQKDITSAVKSREWFLSRIESAVQKRTNELTLYKTPFVYFGSYFKKTKVTNVDEFDVLVVIDSNDGQFSQGGEVIGKGLGSASPNHKYDKKYKKSDDSGVSPSKLLNWLKGIAEEVVEGFHGQAPERDGQAITATIKSKDLKIDLVPAGIFEEDDGTVFYIIPKGDKENGWIRTQPKDDMKELEDAANEKTQFRNIIRLVKFIRGKYKFKVSSFAIESAVVNYSKTTTWRNDLYTDLKGFLSYLAQNFRTGEIKSTIDENANLISEVESLVYYASRIDKIITTLGDLEGELDQKVVNEAVSKLFKNE

SEQ ID NO: 102 - DNA, 1008 bp, Bacillus thuringiensis
atgttaagatttggagagggggagttaggtttggcagatattacaaaatctataaatcaatttattacagatgaaataaagttatttcaaaaagatataacttcagccgtgaaaagtcgagaatggtttttaagtagaattgaaagtgccgtgcaaaaaagaactaatgagcttactctttataaaacaccttttgtctattttggtagctactttaaaaaaacaaaagttactaatgttgatgaatttgatgttttggttgtcattgattctaatgatggtcaatttagtcaagggggagaagttattggaaagggattaggaagtgctagtcctaatcataaatatgataaaaaatataaaaaaagtgacgattcgggagttagtccaagtaagttactgaattggttaaagggaattgcggaggaagttgttgaaggttttcatgggcaagctccagaaagagatggacaagccataactgcaactattaaatctaaagatttaaagattgatttggtgccagccggtatatttgaagaagatgatggtactgtgttctatatcattcctaaaggtgacaaagagaatggttggattagaactcaacctaaagacgatatgaaagaattagaagatgcggcaaatgaaaaaactcaatttaggaatataattcgtttagtgaagtttattcgtggtaaatataaatttaaagtatcatcgtttgctattgagtcagctgttgttaactatagtaaaacaacaacatggagaaatgatttatatactgatctaaaaggttttttaagttatttggcgcaaaattttagaactggagaaataaagagcacaattgatgaaaatgccaatttaattagtgaagtagaaagtcttgtttattatgcgagtaggatagataagattataacgacacttggggacctggaaggtgaattggatcaaaaagttgttaatgaagcagtaagtaaattatttaaaaatgaatag

SEQ ID NO: 103 - protein, 270 aa, Clostridioides difficile
MSVNSYLENLSHELIIRDNEKENIKKSIEVIKSRLKSYFGNNIVETFCFGSYTRGTMLPRKVNENSDVDYMVVFSNSFLYAPQTLLNKLRDFVRTYYSKSEIYQSNPTIVLELNHIKFELVPAYSNNMYLWQENHYRIPAKASNYNDWIDTCPDDINSRLTRLNVESNNKLKPAIRIIKYWNSLNNNVYSSYELESAILENMHCYWRTSIQDYFTAITESLIYNFGTPSWKVDKISSLKKWYNHALKEEYIWRNYIQSNLYMENILPSIK

SEQ ID NO: 104 - DNA, 813 bp, Clostridioides difficile
ttgagtgtaaatagttatttagaaaatctatctcatgaattaataataagagataatgaaaaggaaaatataaaaaaatcaatagaagttattaagagtaggttaaaatcatattttggaaacaatattgtagaaacattttgttttggctcttataccagaggaactatgctgcctagaaaagtaaatgaaaattcggatgtagattacatggtagttttttcaaatagttttttatatgctccacagactttactaaataaacttagagattttgtgagaacatattactctaagtctgaaatataccagtctaatccaacaatagtcttagagttgaatcatataaaatttgaattagttccagcatattctaataatatgtatctttggcaagaaaatcactatagaatacctgcaaaagcctctaattataacgactggatagatacatgtccagatgatattaatagtagattgactagactaaatgttgaatcaaataataaattaaaacctgcaatacgaataattaaatattggaattctttaaacaataatgtttatagttcatatgaacttgaaagtgcaattttagaaaatatgcattgttattggagaacatctattcaggattattttacagctataacagaatctttaatttataatttcggtacaccatcatggaaggttgataaaatctcttctcttaaaaaatggtataatcatgcattaaaagaagaatatatttggagaaattatatacaatctaatttatatatggaaaatattttaccttcaataaaataa

SEQ ID NO: 105 - DNA, 810 bp, Artificial Sequence
  Description of Artificial Sequence: Synthetic polynucleotide
atgagtgttaattcttatcttgaaaacctttcacacgaattaatcattcgtgacaatgaaaaagagaatattaagaaaagcatcgaagttatcaaaagccgcttgaagagctacttcggcaacaacatcgtggaaaccttctgctttggcagctacacgcgcgggacgatgcttccacgtaaagttaatgagaattcagacgttgactacatggtcgttttttcgaactccttcttatacgccccccagaccttacttaataaactgcgcgattttgtgcgcacatactattccaaaagtgagatttaccagagcaacccaaccatcgttttggaattgaatcatatcaagttcgagctggtaccagcgtactccaacaatatgtatttatggcaggagaatcattatcgcatcccggcgaaagcctcgaattacaatgattggatcgatacatgcccggatgacatcaacagccgcctgacacgcttgaacgtagagtctaataacaaattaaaaccagcaatccgtattattaaatattggaactcactgaataacaatgtttattcatcctacgagctggaaagcgcaatccttgagaacatgcactgttactggcgcacttcaattcaagactattttacggcaattactgagtctcttatttataactttggtacgccatcatggaaggtcgataaaatttcctcgttgaaaaagtggtataatcatgctcttaaggaagagtacatttggcgcaactatatccagtctaacttatatatggaaaatattctgcctagcattaag

SEQ ID NO: 106 - protein, 262 aa, Anoxybacillus thermarum
MSVQSHIDNLASKLNLKQDEKDKIEKSIATLSDRLNRYFDGELTDHFKFGSYTRGTILPRKADEYSDVDYMVIFKNPNNYKPQTLLNYLKSFVNYYYHSSEIYQSHPTIVLELNHIKFELVPAKKDIWGNIYIPSPSSSFEEWMKTDPNAFNKKLTDANVKYFYKIKPLVRLMKYWNRLNGSYLSSYELENWIVENYYWNCNNLKDFVYSTFEKLSYNYSDPQGYKDKVDRAKKIIAQTKEYERNNMPYSAEAEIKKLFPDF

SEQ ID NO: 107 - DNA, 789 bp, Anoxybacillus thermarum
atgagcgtacaatcacacattgataatttagctagtaagttaaatttgaagcaagatgaaaaagacaaaatagaaaaatcaatcgctactttatcagacagattaaacaggtattttgatggtgaacttacggatcattttaaattcggctcatatactagggggactattttacctagaaaagcagatgaatactccgacgtcgattatatggtcatcttcaagaatccaaacaattataaaccccaaacgttgcttaattatttgaagagctttgtcaattattattatcatagttcagaaatttatcaatctcatccaacgattgtgctcgagttaaatcatattaagtttgaattagttccagcaaaaaaagacatttggggtaatatttacataccatctccatcatcttcttttgaagaatggatgaaaaccgatcctaacgcttttaacaaaaagttaactgatgcgaacgtgaagtatttttataagataaagccgttggtgcgtttaatgaaatactggaataggttaaatggaagttatctttcttcttacgaattagaaaattggattgttgaaaattattattggaactgcaacaatctaaaggattttgtgtatagtaccttcgaaaaactgagctataactatagcgatccacaaggttataaggataaagtggatagagctaaaaaaatcatagctcaaacaaaagaatatgaaaggaataatatgccatactcagcagaagcggaaataaagaagttatttccagatttttaa

SEQ ID NO: 108 - DNA, 786 bp, Artificial Sequence
  Description of Artificial Sequence: Synthetic polynucleotide
atgtccgttcaatcacatattgacaatctggcttccaagctgaacttaaagcaagatgagaaggacaaaattgaaaagagtatcgctactttgagtgatcgcttaaaccgttactttgacggagaactgacagatcactttaaattcggaagctacactcgtggcactattttacctcgtaaggcagatgagtattcagacgtggactacatggtgatcttcaagaacccaaataattataagcctcaaacgttgttgaattacctgaagagctttgttaactactattatcatagttctgaaatctaccaatcccacccgacaatcgtccttgagttgaaccacatcaagttcgaattggtccccgcgaagaaggacatctggggcaatatttatattcccagcccatcttcctcattcgaggagtggatgaagaccgaccctaacgcgtttaataaaaagctgacggacgctaatgttaaatacttctacaagatcaagccacttgttcgtctgatgaaatattggaatcgtttgaatgggtcgtatctgtccagctatgaacttgagaattggatcgtggaaaactattattggaactgcaacaacctgaaagattttgtctactcgacatttgaaaaattaagctataattactcagatccacaaggttataaagataaagtggaccgtgccaagaaaattatcgctcaaacaaaggagtacgagcgtaataatatgccatactcagctgaagcagaaattaagaaacttttcccggacttt

SEQ ID NO: 109 - protein, 343 aa, Acinetobacter sp.
MGSERIMTTQQQFLDLLSDIEPSTTTVNDCSSAHNTLRDALKVHNEFSKVHVHTFLSGSYKRNTAVRPTTIGGITQRPDVDIIALTNHTINDDPQIVLDAVHTALKDIGYTDLTVNRRSVNVKLKKVDMDVVPIISDGYGGYLIPDIHLEEWLVTNPPAHTEWTVEVNKNANGRFKPLVKLFKWWRRENLSDLKRPKGFILECLVAKHMNYYESNYEKLFVYLLETIRDSYGIYASLGIIPHLEDPGVAGNNVFSAVTADEFKTFFEKVEEQAAIARNALNETDDDKALALWRQVLGNRFPRSASHKSANSADMASSLIRSALGAGLTFPSTPVYPNKPGGFA

SEQ ID NO: 110 - DNA, 1032 bp, Acinetobacter sp.
atgggctcagagagaattatgacaactcaacagcagtttcttgacctactttccgatattgaaccctctacaacaacggttaatgattgttcaagcgcacataatacgcttcgtgatgctttaaaagtgcataatgaattcagcaaagtacatgtgcatacattcttatcaggttcttataaaagaaatacggcagtacgtccgactaccataggcggaatcacacaaaggccagatgtagatattattgcccttacaaatcacacaattaatgatgaccctcaaattgtccttgatgcagtacatacggcattaaaggatattggatataccgatcttaccgttaaccgtcgttcagtaaatgttaagttgaaaaaagttgatatggatgttgtccctatcatttcagatggatatggcggctatctgattccagacattcatcttgaagaatggctagttaccaaccctccagctcataccgagtggactgttgaggtgaataaaaatgcaaatggtcgatttaagcctcttgtgaagctatttaaatggtggcgtcgtgagaacttgtctgatttaaaaagaccaaaaggattcattttagaatgcctggttgccaagcatatgaattactacgaatccaactatgaaaagttgtttgtttatcttttagaaacgatcagggattcttatgggatttatgcgtcactaggcataattccacatttagaagatcctggtgttgcaggcaataatgttttttctgcggttacagcagatgagttcaaaactttttttgaaaaggtagaagaacaagctgctattgcacgaaacgccttaaatgaaacagatgatgataaagcattagccctatggcggcaggttctgggtaatcgttttccacgttcggcttcacacaaaagtgcaaactctgctgatatggccagctctttaatccgttctgctctaggtgcgggattaacatttccatcaacccctgtttatccaaataaaccaggaggctttgcgtaa

SEQ ID NO: 111 - DNA, 1029 bp, Artificial Sequence
  Description of Artificial Sequence: Synthetic polynucleotide
atgggctcggagcgcattatgacgacgcagcaacagttcctggatttgctgtcggacattgaaccgagcactacgacagtgaacgactgctctagcgcacacaatacacttcgcgatgcactgaaggtccataatgagttcagtaaagtacacgtccacacgtttcttagcggaagttacaaacgcaataccgcagtccgtcccacgaccatcggaggcattacacaacgccccgacgtagatattatcgcattgaccaaccatacaatcaatgatgaccctcagatcgtcttggatgcggtgcacacggcgctgaaggatatcggttatactgatttgactgttaaccgccgctcagtcaacgttaaattaaaaaaagtagacatggatgtagtcccaatcatctcggacgggtacggagggtaccttatccctgacatccatcttgaagagtggttagtaaccaatccccccgctcacaccgagtggacggttgaggtcaataaaaacgcgaacggacgtttcaaacctttggtgaagttgttcaagtggtggcgccgcgagaatctttcggaccttaagcgtccgaaaggatttattctggagtgcttggtggcaaaacacatgaattattatgagagcaactatgagaaactgtttgtctacctgctggagaccattcgtgattcttatggaatttacgcaagtttgggcattatcccgcaccttgaagatcccggcgtagccggtaacaacgtcttttctgccgtaaccgctgatgaatttaagacgttcttcgaaaaagtcgaggagcaagcagccatcgctcgtaatgcactgaatgagactgacgatgataaagcgcttgcgttgtggcgccaggtcttgggcaatcgtttcccccgttcggcaagtcataaaagcgcgaatagtgctgatatggcgtcatctcttatccgctctgcgctgggtgctggcttgacgttccctagtacgcctgtatatccgaacaagccgggcggattcgct

SEQ ID NO: 112 - protein, 381 aa, Enterobacter cloacae
MELQPQFNEFLANIRPTDTQKEDWKSGARTLRERLKNFEPLKEIVVSTFLQGSIRRSTAIRPLGDKRPDVDIVVVTNLDHTRMSPTDAMDLFIPFLEKYYPGKWETQGRSFGITLSYVELDLVITAIPESGAEKSHLEQLYKSESVLTVNSLEEQTDWRLNKSWTPNTGWLSESNSAQVEDAPASEWKAHPLVLPDREKNEWGRTHPLAQIRWTAEKNRLCNGHYINLVRAVKWWRQQNSEDLPKYPKGYPLEHLIGNALDNGTTSMAQGLVQLMDTFLSRWAAIYNQKSKPWLSDHGVAEHDVMARLTAEDFCSFYEGIASAAEIARNALASEEPQESAQLWRQLFGSKFPLPGPQGGDRNGGFTTPSKPAEPQKTGRFA

SEQ ID NO: 113 - DNA, 1146 bp, Enterobacter cloacae
atggaacttcaacctcagttcaacgaatttttagcaaatatcaggccgactgatacacagaaggaggactggaaaagtggtgctaggacattgcgcgagcgcctaaagaatttcgaaccactcaaggaaattgtcgtatcaacgttcctgcagggcagcattcgtcgttcaacggcaatccgtccgctcggcgataagcgccctgatgttgatattgtcgtggtgaccaatcttgatcacacccggatgtctcccactgatgcaatggacctgttcatcccattcctcgaaaagtattacccgggtaaatgggaaactcaggggcgctcttttggtattaccctctcctatgtcgaactggacctggtgatcaccgccatcccagagtcaggggcagaaaaaagccatcttgagcagctctataagtcagagtcagttctgactgttaactctctggaagagcaaactgattggcgcctgaataaaagctggacccccaatacgggatggttgtctgagagcaacagtgcgcaggtagaggacgcccccgcttcagaatggaaagcgcacccgttagtgcttcctgacagagaaaagaatgagtggggccggacacatccactcgcgcagatcagatggaccgccgagaaaaatcgtctttgtaacggtcactacatcaaccttgtcagggcggtgaaatggtggcgacagcagaacagcgaagacctgccgaaatatcctaaaggctatccgctggagcatctgattggaaatgcgctggataatggcaccacatcaatggcccaagggcttgttcaactgatggacacttttttatcgcgctgggcagccatttacaatcagaaaagtaagccgtggttgtcagatcacggggttgcagagcatgacgtgatggcgcgcttaacagccgaagatttctgttcattttatgagggtattgcgagtgcggcggaaattgcccgtaacgcgctggcgtctgaggagcctcaggaaagcgcacaactctggcgccaactgttcggatccaagtttcctttacccggccctcagggcggcgatcgcaacggtggatttacaacaccaagtaaaccagcagaaccacagaaaaccggacgcttcgcttga

SEQ ID NO: 114 - DNA, 1143 bp, Artificial Sequence
  Description of Artificial Sequence: Synthetic polynucleotide
atggagttacaaccgcagtttaatgaatttcttgccaacatccgtcccacagacacgcagaaagaggattggaaaagtggagcgcgtacactgcgtgaacgtctgaaaaactttgaacccttgaaagagatcgtagtctcgactttcctgcaaggtagtattcgccgtagcaccgccatccgtccgcttggagataaacgcccggacgtcgatatcgtggtcgtcaccaacttggatcacacgcgcatgagtccgactgatgcgatggatctgtttatcccatttttggaaaaatactacccaggcaagtgggagacacagggccgttccttcggaattactttatcatacgttgaattggacctggttattactgccattccagaatccggcgctgaaaaatcccatctggaacaattatataaatcagagagtgttcttaccgttaatagcttggaggaacaaactgactggcgcttgaataagagctggacacccaatacaggatggttaagcgagtcgaactccgcacaggtcgaagatgcgccggcgtccgaatggaaagcccatccattggtgctgccagaccgtgagaagaatgagtggggtcgcactcatccgttagcacaaatccgctggacggcggagaaaaatcgtttgtgcaatggacattatatcaacttagtccgtgctgtaaagtggtggcgccaacaaaactctgaagatttacctaagtacccaaagggctacccgctggaacatttaattggtaacgcgctggataatgggaccaccagcatggcgcaggggcttgtccaacttatggatacctttttgtctcgctgggccgcaatttacaatcagaaatctaagccatggttatctgaccatggcgttgccgagcacgacgtgatggcacgcctgacagcggaagacttttgctccttctatgaagggattgcctcagcagccgagattgctcgcaacgctcttgcgagcgaagagcctcaagaatctgctcagttatggcgccaactgtttggttcaaaatttccgctgcctgggccacagggcggcgaccgtaacggcgggtttaccacaccgagtaagccggcggaaccgcaaaaaacaggtcgtttcgcg

SEQ ID NO: 115 - protein, 416 aa, Bradyrhizobium sp.
MSNFPSLRRDDRPDDPFADPLDAVLAELAINIQLPPGLHAKAVERYEAVRRYIERPGSPLEGRVACFYPQGSMAIDATTSTRGTDDEYDLDIVAEIEGPDLGPEALLDDLEAALESYPVSKVVRQTRCITLYYADGMHLDITPSRRRAPKEKEGEIPHAKKGTRSDPARYVPMNSYAFGKWYCARTPTEERFALALNRQLYEQAGIAFAAADVEDVPPQTPLIIKSVTTVALQLIKRHRNIAYATETGRIPPSVMLSCHAGHAARPGMRLAEMLIRQARWTARAIDDAAKRGQLLVVPNPEFPVERFTDRWPESQLQQTTYSRHLHTLANGLEAARTGDVQLEDLQEWLRGQFGDRVVTRSVKAFNQRLGRQVQSRQHGYTRSGGLFVPAAPAIIGAATSLAPVAARAHTNMGERR

SEQ ID NO: 116 - DNA, 1251 bp, Bradyrhizobium sp.
atgtcgaattttccgtccctgcgccgcgatgatcggcctgatgatccctttgccgacccgctggacgcggtactcgccgagcttgccatcaatattcagcttccgcccggcctgcatgccaaggcggtcgagcgatatgaggcggtccgacgctacatcgaacgacccggtagtccgctcgaaggcagggtcgcctgcttctatccccagggctccatggcaatcgacgcaaccacgtcgacccgcggcacggacgacgagtacgatctcgatatcgtcgccgagatcgaaggccccgacctcggtcccgaggcgctgctggatgacctggaagccgcactcgagagctacccggtaagcaaggtcgtgcgccaaactcggtgcatcacgctctactacgccgacggcatgcatcttgacattacgccgtcgcggcggcgggcgccgaaggagaaggaaggcgagatcccgcatgcgaagaaggggactcgcagcgacccggcgcgctatgtgccgatgaactcatatgccttcgggaagtggtattgcgcccgaacgcctaccgaggagcggttcgcgctggcgctgaatcgtcagctgtacgaacaggccggaatcgccttcgccgcagcggacgtcgaggacgttccgccgcaaacgccgctcatcatcaagagcgtgacgacggtcgcgctgcagctaatcaagcggcaccgcaacatcgcctacgcgaccgagacgggccggatcccgccatcggtgatgttgtcgtgccatgccggccatgccgcccgtccgggcatgaggcttgcggaaatgctgatccggcaggcgcgctggacggcccgcgcgatcgacgacgccgcgaagcgcggccagctcctggtcgtgcccaaccccgaatttccggtcgagcgtttcaccgaccgttggccagaatctcagctgcaacagacaacctattctcgccacctgcacaccctcgctaacgggctcgaagccgcccgcaccggcgacgtgcagctggaggacttgcaggagtggttgcgcgggcagttcggggaccgggtcgtcacgcgttctgtcaaagctttcaaccagcggctcgggcgccaagttcaatcacggcagcatggttatacgcgctccggcggcctgttcgttcccgccgcgccggcgatcatcggcgcggcgaccagcctggcgccagtcgcggctcgcgcacacaccaacatgggagagcgccgataa

SEQ ID NO: 117 - DNA, 1248 bp, Artificial Sequence
  Description of Artificial Sequence: Synthetic polynucleotide
atgagcaattttcccagccttcgtcgtgatgatcgccccgacgacccatttgctgatcccttagacgccgtcttagcagagcttgctattaacatccagcttcctccaggcttgcatgcaaaggcagttgagcgttatgaagcggtccgccgctacatcgagcgccccggaagccccttagaagggcgcgtcgcttgcttttatcctcagggttcaatggctattgacgccacaacaagcactcgtggtactgacgacgaatatgatttggatattgtagctgaaattgaagggcccgatctggggccagaagctcttctggatgacttggaagctgcgttggagagttacccagtaagcaaagtcgtccgtcaaacgcgctgtatcaccttatactacgctgacggaatgcaccttgacatcacaccatcccgccgccgcgcgccgaaggaaaaggagggggagattcctcacgcaaaaaagggtactcgtagcgaccccgcgcgttatgtcccaatgaactcatacgcgttcgggaagtggtattgtgctcgtacgccaaccgaagaacgctttgccttagcgttaaaccgtcaactgtatgagcaggcagggatcgccttcgccgcggccgacgtagaggatgttccaccacagactcctcttatcattaaatcagttacgacagtagcgttacaattgattaaacgtcatcgtaatattgcatacgccaccgaaacgggacgcatccccccctctgttatgttatcgtgccatgcaggtcacgcggcccgtccgggcatgcgtcttgccgagatgttaattcgtcaggcccgctggaccgctcgcgctattgatgacgccgcaaagcgcgggcaattattagtggtcccgaacccggaatttccggttgagcgctttacggatcgctggcccgagagtcaattgcaacagacgacttattctcgtcaccttcacacactggctaacgggctggaggcggcacgtacaggggatgtacaattagaagatttgcaggagtggcttcgtggtcaattcggagaccgcgtcgttacgcgttcggtgaaagcttttaaccaacgtcttggacgtcaggtacagtctcgccaacatggctacactcgttcgggcgggttatttgttccagcggcccctgccattatcggggctgccaccagtctggcgccggtggctgcgcgtgcccacacgaatatgggcgagcgccgc

SEQ ID NO: 118 - protein, 413 aa, Mesorhizobium sp.
MTTFAYQGKNPFEDPLDRILAEIAFSVQLPPFLHGKACQRYKAVREYLEGTTSFHDQIEHFYVQGSMAIDATISTRGTDDEYDIDIVAQLGSQYRHMTPLGILKALAAALKDYPVQKIVQQTRCITLFYADNMHLDVTPALRDYGTTDRQSAITHAKGPLPSNDDCMVPMNAYGHAEWYMASTPNEERVIEAFKDRWSGDDRMRIRADADVDEVPDQTQFVVKNMATVALQLLKRYRNVRYANYSGRIPPSVMLSYFAGAAALPDMNLSDILIRICRWIIGEIERATINRQKLHVVNPTYSADVFTDRWPENLDQQNQFARYLHDLVAGIERAKRGELDPVKLRNWLREMFGDRVVTRAADRMADATGAGIVAGSQVYSKKGSILLPAAATIVTSVAPVVAKPHTFFGDPVDE

SEQ ID NO: 119 - DNA, 1242 bp, Mesorhizobium sp.
atgactacattcgcataccaggggaagaacccctttgaagatccgcttgatcgcatcctggcggaaatcgccttcagcgttcagttgccgccgttcctccatggcaaggcctgccagcgctacaaggctgtgcgcgagtacctggaaggcacgacgtcgttccatgatcagatcgagcacttctatgtacagggatcgatggcgatcgacgcgactatctccacgcgcggtaccgacgatgaatacgatatcgacatcgtagcccagctcggcagtcaatatcgtcacatgacgccgctcgggatcctcaaggcgctcgccgcggccctgaaggactatccagttcagaagatcgttcagcagacccgctgcatcacgctgttctacgccgacaacatgcatctcgatgtgacgccggcgcttcgcgactacggcaccaccgatcgccagtcggcgatcacccatgcgaaagggccgctgccgtcgaatgacgactgcatggtaccgatgaacgcatacggccatgcggaatggtacatggcgtcgactccgaacgaagagcgtgtgatcgaagccttcaaggaccgctggtccggcgacgatcgtatgaggatccgcgcggacgccgatgtcgacgaagttcccgatcagacgcagttcgttgtgaagaacatggcaaccgtcgcactgcaactgctgaagcgctatcgtaacgttcgctatgcaaactacagtggccgcatcccgccgtcggtgatgctgtcgtactttgccggcgcggcggcgcttcccgacatgaatctctcggacatcttgatccgcatctgccggtggatcatcggcgagatcgagcgggcgacgatcaaccgtcagaagcttcacgtcgtcaatccgacctacagcgccgacgtcttcaccgaccgctggcccgagaacttggatcagcagaaccagttcgcccgctatctccacgatctcgtggccggcatcgagcgcgccaagcgcggcgagttggaccccgtcaagcttcgcaactggctgcgcgagatgtttggcgaccgcgtggtgacgcgcgcggctgacagaatggcggacgccaccggcgctgggatcgtggcagggtcgcaggtctacagcaagaagggcagcattctcctgccggctgcggccacgatcgtcacatcggtggctccggtcgtcgccaagccgcacaccttcttcggagatccggttgatgaatag

SEQ ID NO: 120 - DNA, 1239 bp, Artificial Sequence
  Description of Artificial Sequence: Synthetic polynucleotide
atgaccacgttcgcgtatcaaggtaaaaatcccttcgaagatcccttagaccgtattttggcggaaatcgctttctccgtacagctgccgccattcttgcacggcaaagcttgtcagcgctacaaagcggttcgcgagtatcttgaaggtactacttcattccatgaccagatcgagcatttttatgttcaagggagcatggctatcgacgccacaatttcgactcgtgggacggatgatgaatacgacatcgatattgttgcacaactggggtcgcagtatcgccacatgaccccattaggaattctgaaagcgttggcagcggccttaaaggattatcccgtacagaagatcgttcaacaaactcgctgtatcacccttttttatgcggacaatatgcacttagatgtaactcctgcattacgcgattatggtactacagatcgccaatccgccatcactcacgcgaaaggtccacttccctcaaacgatgactgcatggttcctatgaacgcttatgggcatgccgaatggtatatggcctcaacacctaacgaagaacgcgtgattgaggcattcaaggaccgttggtccggtgatgatcgtatgcgcatccgtgcggacgccgacgtcgatgaggttccagatcagacacagtttgtagttaaaaacatggctaccgtcgctttacagttattgaaacgttaccgcaatgtccgctatgccaattactctggacgtatccccccttcagttatgctttcatactttgctggcgctgctgcacttcccgatatgaatcttagtgacatcttgattcgtatttgccgttggattattggcgaaatcgaacgtgcaactatcaatcgtcagaagttgcacgttgtcaaccccacctactcggctgacgtatttacagatcgctggccggaaaatttggaccaacaaaatcagttcgcacgttacctgcacgacttagtggcgggaatcgagcgtgccaagcgcggtgagcttgatccggttaaacttcgtaattggcttcgtgaaatgttcggggaccgtgtagttacacgcgccgcggaccgcatggcggatgccacgggggctggtattgtagccggatcacaggtatatagcaagaaaggctctatcttgcttccggctgctgcaactattgttacctcagtggctcccgtcgttgcgaaaccgcatacatttttcggcgatccagttgatgaa

SEQ ID NO: 121 - protein, 404 aa, Burkholderia pseudomallei
MNSKRTLAKAFMEKVAADQEARQWEELMVQLLSKLELSEEERGRASGHYDTLAKQVARKLGVGETDVHIVVQGSMRTQTTVAPRGREKFDLDIVVKMDGDRFIGIDPDEFFKEFGDSLRGLNNAAGDPKPKPRCWRLQYPNEPFYFDVTPALPGSFDITGTDLRVRDPDTGWSPSNPEDFADWFCEAAEQKFQFQMLLKVAMDARHQIEDVPSDPVAIDDILRRTVQLIKLHRDLMYHGASDGVKEGKPISVILVTLATWAYNDVYQDRHLYSNAIEVLLDVVERMPEYIEFDDGVYTVRNPKHPDENFAERWNGDDGVRASAFYRWHEKLQSDLTALFSDSYSRSTEERIRKIFGQHGVDAWKASIAPATSGLLNSLMKSVPGGERRDPVTPVPPGSRKDTLA

SEQ ID NO: 122 - DNA, 1215 bp, Burkholderia pseudomallei
atgaatagcaaacgcacgcttgcaaaagcgttcatggagaaggtggctgccgaccaggaagcccggcagtgggaagagttgatggtgcagctcctgtcgaagctcgagctgagtgaggaggagcgggggcgcgcctccggccactatgacacgctcgcaaagcaggtcgcgcgcaaactgggggtcggcgaaaccgatgtgcacatcgtcgtccaggggtcgatgcgcacacaaaccacggtcgcgccgcggggccgagagaagttcgacctcgacatcgtcgtgaagatggacggcgaccgttttatcggcatcgaccccgacgagttcttcaaggagttcggtgattcgctgcgtggactcaacaacgcggctggcgaccccaagccgaagccgcgttgctggcgcctgcaatacccgaacgagccgttctatttcgatgtcacgccagcgctgccgggcagctttgacatcacgggcacggacctgcgcgttcgcgacccggacactggctggagcccttcgaaccccgaagacttcgcggactggttctgtgaggctgctgagcagaagtttcaattccagatgttgctcaaggtcgcgatggacgcgcgacatcaaattgaggacgtcccctcggaccccgtggctatcgacgacatcttgcgccgcactgtgcagctcatcaagctgcatcgtgacctgatgtaccacggcgcgtccgatggcgtgaaggaaggcaagcccatctccgtcatcctcgtgacgctggcaacctgggcgtataacgatgtctatcaggaccgccacctctattccaacgcaatcgaggttctgctcgacgttgtcgagcgcatgcccgagtacattgagttcgacgacggcgtgtacaccgtgcgcaacccgaagcatcccgacgagaacttcgctgagcggtggaacggggacgacggcgtgcgcgctagcgcgttttaccgctggcacgagaagctccagagcgacctgaccgcgctgttctcggactcgtattcgcgcagtaccgaggagcgcatccgtaaaatcttcgggcagcacggtgtcgatgcatggaaagccagcatcgcgccggcgacgagcggtctgctcaattcgctgatgaaatctgttcccggcggtgaacgcagggacccggtaacgcccgtgcctcccggtagcaggaaagacaccctcgcatga

SEQ ID NO: 123 - DNA, 1212 bp, Artificial Sequence
  Description of Artificial Sequence: Synthetic polynucleotide
atgaacagtaagcgcaccctggctaaggcattcatggagaaggtcgcggcagatcaagaggcacgtcagtgggaggaattaatggtgcagcttctttctaagttagagcttagcgaagaagaacgtggccgcgcctccggacactacgacacattggcgaagcaggttgcgcgtaaactgggagttggggagactgacgtgcacattgtagttcaggggtccatgcgcactcaaactaccgttgctccccgtggacgcgagaaattcgacttggatattgtggttaagatggatggagaccgtttcattggcattgatcccgatgaattcttcaaagagtttggagacagtctgcgtggtcttaataatgcagcgggcgatccaaaaccaaaaccgcgctgctggcgcttgcaatatcctaacgaacccttttattttgatgtgactccagcgttgcctggcagtttcgatatcacaggcacagatcttcgtgttcgtgatcccgacaccggctggtccccatcgaatccggaggacttcgctgattggttctgtgaggcagcggaacagaaatttcaatttcaaatgttgttaaaggttgccatggatgcccgccatcaaatcgaggatgtccctagcgatcctgttgcgattgacgacattcttcgtcgcacagtacaacttattaaactgcaccgcgatttaatgtatcacggtgcgtcggacggcgttaaggagggcaagccaatttccgttattcttgtgactcttgcaacgtgggcctacaatgacgtgtaccaggaccgtcatctgtatagtaatgccatcgaggtgcttcttgacgtggttgaacgcatgcctgaatatatcgagttcgatgatggggtctacacggttcgtaatcctaaacaccccgacgagaatttcgcagagcgttggaacggagatgatggagtacgcgccagcgcattctatcgttggcacgagaagttgcagtccgatttaactgcgcttttttcagactcctacagtcgtagcactgaggaacgcattcgcaagatctttggacaacatggcgttgacgcgtggaaggcgtcaatcgcaccggctaccagtggattattgaatagtctgatgaaatccgtgccgggtggtgaacgtcgtgaccccgtgaccccagtaccaccaggcagtcgcaaagataccttggca

SEQ ID NO: 124 - protein, 415 aa, Citrobacter freundii
MSNEQTKHRSWEYFLLRAARKISLSAAQYSVIDARYSQLEKILSAADDPLLADAHIFPQGSMRLQTTINPVPGAPADLGTIDADAIVWLPHARGIDARTVLEVIERRFQEGSRVQEDIQQLRRGVRIVYADENPGFHIDVTPARPCHHNEQSDGLGMLEVPDREHGWKASSPIPYADWLHDASKQDIMLEHVVEFNKSRAAMDSATQAPLPEYKEYQKDDPLRASIKLMKRHRDEWAIRTKNEGYRPISAVITTLATHAYLDVVAQSEYTAFTPLQAILAIVNRMPDHIHRYSNEYYVCNPEDNGENFAEKWNRPDEGYKYVDAFNKWHASARSALTLGLDSHASTETFAKAVQEQFGIGPTFVREVNESIPANWTMPGRQDGVTRNSVSMGSLFGSSVSSNQSQANVAPVGRLG

SEQ ID NO: 125 - DNA, 1248 bp, Citrobacter freundii
atgagtaacgaacagactaaacaccgcagctgggagtattttcttctccgtgcagcccgaaaaatttcgttatcagcagctcagtacagcgttattgatgctcgctactctcagctggaaaaaattctttctgctgccgatgatcccctgctggcggatgcccatatttttccccaaggttctatgcgtcttcagacaacgattaacccggtgcctggggcgccagcagatctcgggacaattgatgcagatgcgattgtctggttaccccatgccagggggatcgatgctcggactgtattagaggtcattgaacgtcgtttccaagagggcagtagggttcaggaggatattcaacaacttcgtcgcggtgtcaggattgtttacgccgatgaaaatccaggtttccacattgatgtcacacctgcacgtccctgccatcacaatgagcaaagcgacggactgggcatgctcgaagtacccgacagggagcacggctggaaggcaagcagtcccattccttatgcagactggctgcatgatgcgtcaaagcaggacatcatgcttgaacatgttgttgagtttaataaaagtcgtgcagcaatggactctgcgacccaggccccgctgcctgaatataaagaatatcaaaaagatgatccgttacgtgcgagtattaagctgatgaaaaggcacagggatgaatgggcgatcaggacgaaaaatgaaggataccggcctatttcggcagttatcaccacgcttgcgactcacgcttatctggatgttgtcgcgcagtcagaatataccgccttcacccctcttcaggctatcctagcaatcgtgaacaggatgcctgaccatattcaccgttacagtaatgagtattacgtctgcaatcctgaagataacggcgagaattttgcggaaaaatggaatcgtccggatgaaggttataaatacgttgatgcctttaacaaatggcatgcgagtgcccgttcggcgctgacgctggggctcgacagccacgcgtcgacagaaacctttgcgaaggcggtccaggagcagtttggtattggtccgacattcgttcgcgaagttaacgagagcattccggcaaactggacgatgcccgggcggcaagacggtgtgactcgaaactctgtctcaatggggtctctgttcgggagttcagtcagcagtaaccagtctcaggcaaatgttgcacctgtcgggcgactcggctga

SEQ ID NO: 126 - DNA, 1245 bp, Artificial Sequence
  Description of Artificial Sequence: Synthetic polynucleotide
atgagtaacgagcagaccaagcatcgctcatgggaatatttcctgctgcgcgcggcccgcaagatcagcttatctgctgcccaatattctgttattgatgcacgctattcccaactggagaaaatcttgtcggccgctgatgaccctctgttagcagatgcccatattttcccccaaggctctatgcgtttacagaccaccatcaatccagtgcctggggcacccgctgaccttgggacaatcgacgccgatgccatcgtgtggctgccgcacgcgcgcggcatcgacgcgcgcaccgtgttggaagtgatcgagcgtcgttttcaggaaggctctcgcgtgcaagaagacatccagcaactgcgccgcggtgtacgcattgtatacgctgacgagaatcccggctttcatatcgatgtcacaccagcccgtccgtgccaccacaacgagcagagtgatggactgggtatgcttgaggtccctgaccgtgagcatggttggaaagcttcatctccgattccttacgcagactggttacacgatgcctcaaaacaagatatcatgcttgagcatgtcgtagagtttaataagtctcgtgcagcgatggatagcgctacccaagctcccttacctgagtataaagaataccagaaagacgatccccttcgcgcgtcgattaaactgatgaagcgtcatcgtgacgagtgggccattcgcactaagaatgaaggttatcgtccgatctcagccgttatcacaacgttggcgacgcatgcttaccttgatgtcgtagctcagagtgagtatacagcatttacccctttacaggcaattttggcaatcgttaatcgtatgcccgatcacatccaccgctatagtaatgagtattatgtttgcaacccggaagacaatggggaaaatttcgcggagaaatggaaccgccccgatgagggatataagtacgtagacgccttcaacaagtggcacgcttccgcccgttcagcattaacactgggcttagatagtcatgcctcgacagagacgttcgccaaggcagtacaggaacagttcggcatcggaccaacatttgtgcgtgaagtcaacgagtcgattcctgccaactggacgatgcctggccgtcaggatggggtgacccgcaactcggtgtcaatggggtcgttgttcggtagttcggtatcgtcaaatcaatcacaggccaacgtcgctcccgtcggtcgtctgggt

SEQ ID NO: 127 - protein, 418 aa, Acinetobacter baumannii
MNMLNIPSKVDSWEYLLLRAAQNISLSESKYTQIMERYNQLEKILTASNNPLLAEAHIFPQGSMRLRTTIKPVLGAPADLGTVDADAIIWLPNAQGVEASVILEAIEERFKEGARVQKDIQPLRRGIRIVYADVDPGFHIDVTPARAIDGNDEEKGEGKLEVPDRVTGWKASSPIPYANWLKYVSYQKIELAMESYDLVRKHQTFDAATQEELPAYSDYSDMNPLIATIKLLKRHRDEWAIRTGCKDWRPISAVITTLATHAYSDVVKMSASNPLRPLDAILAIVRKMPDYIQYLGGQFFVCNPEDAAENFAEKWNRVGEGYKYKEAFFQWHTNAMASVSIGLEDFSSYESFEAVIKEKFGLSGSFISQVNREIPPDWTQPGRVEGTTRNAAAIGILFGGESNSENIQNTVKPVGRLG

SEQ ID NO: 128 - DNA, 1257 bp, Acinetobacter baumannii
atgaatatgctgaatattccatctaaagttgacagttgggaatacctattattacgagcggcacagaatatatcgctttcagagtcgaaatatacccaaataatggaacgatataatcaattagaaaaaatcttaactgcatctaacaaccctttattagctgaagcacatattttccctcagggttctatgcgtttgagaacaacgataaagcctgtcttgggagcacccgctgatctaggtacagttgatgctgatgccatcatttggttgccgaatgcacaaggcgttgaggccagcgttattttagaggcaattgaagaacgttttaaagaaggtgctcgtgttcaaaaggacatacaacctttacgtaggggaattagaattgtttacgctgatgttgaccctggttttcatatcgatgttacacctgctcgcgctatagatgggaatgatgaggaaaaaggagagggtaaattagaagtacctgatcgtgtaactggttggaaagcaagtagtccaataccctatgctaattggctcaaatatgtgtcgtatcaaaagatagagttggcaatggaaagttatgatttggtgaggaaacatcagacatttgatgctgcaacacaagaggaacttcctgcatattctgattattcagatatgaacccattaattgcaacgattaaactcttaaaacgtcatagagatgaatgggcaattcgtactggttgtaaagattggagaccgatctctgctgttattacaacattggcgacacacgcctattctgatgtagtaaagatgtcagctagtaacccccttagacctctggatgcaattttagctatagttcgaaaaatgccagattatattcaatatttaggtggacagttttttgtttgtaaccctgaagatgcagccgaaaattttgctgaaaaatggaatagggtaggtgaaggatataaatataaagaagctttttttcaatggcatactaatgctatggcttctgtatctattgggttagaagattttagttcttatgaatcatttgaagctgttataaaggaaaaatttggtttaagtggatctttcatttcacaagtgaatagagaaattcctcctgattggacacagcctggaagggttgagggaacaactagaaatgcagcagcaattggaatattgtttggtggtgaatcaaatagtgaaaacattcaaaatactgttaaaccggtaggtcgtcttggctga

SEQ ID NO: 129 - DNA, 1254 bp, Artificial Sequence
  Description of Artificial Sequence: Synthetic polynucleotide
atgaatatgcttaacatccccagcaaagttgattcttgggagtacctgctgcttcgtgccgcgcaaaacattagtttgtccgaaagtaagtacacccaaattatggagcgctacaatcaattagagaagattttaacggcatcaaataaccccttgcttgccgaagcgcatatctttccacaagggtcaatgcgcttacgtacgacaatcaagccagtgctgggcgcccctgctgacttagggactgttgatgcagatgcgatcatctggcttccaaacgctcagggtgttgaggcgagcgttattttggaggcgattgaagagcgcttcaaggaaggagctcgtgttcagaaggatattcagcctttgcgtcgcggcattcgcatcgtatacgcagacgtagaccccgggttccatattgacgttacgccggcccgcgctattgatgggaatgacgaggaaaagggcgaggggaagctggaagtgccggatcgtgtgactgggtggaaggcctccagtccaattccctacgcaaactggctgaagtatgtatcctatcaaaagatcgagttagcgatggaatcgtacgatctggtgcgcaagcatcagaccttcgatgctgcgacacaagaagaattaccggcttattccgattatagtgatatgaatccgttgattgcgacgattaaacttcttaaacgccaccgcgacgaatgggctattcgtacaggctgtaaagactggcgcccgatctccgcagtcattacaaccctggccacgcacgcatactctgatgttgtcaaaatgagtgcatctaacccactgcgcccgcttgatgcaattttggctattgtgcgtaaaatgcccgattacattcaataccttgggggtcagttctttgtctgtaaccccgaggatgctgcggagaacttcgccgagaagtggaaccgtgttggtgaaggctacaaatataaggaagcgtttttccagtggcacacaaacgctatggcctcggtcagcatcggcttagaggattttagttcctacgagtcgttcgaggcagttatcaaagaaaaatttggcttgagtggttcgttcatctctcaagttaaccgcgagattcctcccgattggacacagccaggccgcgtagaggggaccacccgtaacgcggcggcgattgggattttgttcggtggtgagtccaattcggagaatattcagaacacggttaagccggtaggacgtctggga

SEQ ID NO: 130 - protein, 416 aa, Pseudomonas aeruginosa
MSMSNEQTKRGSWEHFLLRAAREISLSEAQYEKINDRYSQLEQILNASDNPLLAEAHIFVQGSMRLKTTIKPVSGAPEDLDTIDADAIIWLPHAQGAGAQEVLDAIEERFKAGSRVQEEIKQLRRGIRIIYADENPGFHIDVTPARAINGNSQGNGEGKLEVPDRVTGWKASSPIPYSNWLQVASKQTISLEHLAVAKSQRAFDAATQDPLPQYEDYLDQDPLRATIKLLKRHRDEWAIRTKNADHRPISAVITTLATHAYLEVAKESQTAPLKPLDAILEIVRRMPDHVKRQGNECLVCNPADNGENFAEKWNRPLDGHRYRRAFEEWHENASASVSLGLESFESAEAFAKAVKENFGMGPTFISTVNSEIPSNWTMPGRPDGTTRNSTSMGALFGGFSGTASSQEDVKPVGRLG

SEQ ID NO: 131 - DNA, 1251 bp, Pseudomonas aeruginosa
atgtccatgagcaatgaacagaccaagcgcgggagctgggagcactttctgctccgcgccgcgagggagatctcactgtcggaagcacagtacgagaagatcaacgatcgatactcccagctcgagcaaatcctcaacgcctccgacaatccactactggcggaggcgcatatttttgtccaaggctccatgcgcctgaagacgacaatcaaacccgtttctggcgctccagaggatctggacaccatcgatgcggacgccattatttggctccctcatgcacaaggggctggagctcaagaagttctggatgccattgaggaacgcttcaaagctggcagccgcgtccaggaagaaatcaagcagctacgccggggcatccggatcatctatgccgatgaaaaccccggattccacatcgatgtcacaccggcgcgtgccatcaatgggaattctcagggcaatggcgaaggtaagctggaagtgccagatcgggtaactggctggaaggcgagcagcccgatcccctactccaactggctgcaagtggcttcaaaacagacgatttcgttggagcatctggccgtcgcaaaaagtcagcgtgcctttgatgctgccactcaggatcccctgccgcagtatgaagactacctcgatcaagacccacttcgggcaacgattaagctgctgaagcgacatcgagatgagtgggccatccgtaccaaaaatgcagaccatcgcccgatttcggcagtcatcaccacactcgctacccatgcctaccttgaagtggcgaaagagtctcagacggcgccgctaaagccgctggacgccatcctcgaaatcgtccggcggatgccggatcacgtcaaacgccaggggaatgaatgcctggtttgcaacccggcggataacggcgaaaacttcgctgagaaatggaataggccgcttgacgggcaccgttaccgccgcgcattcgaggagtggcatgagaatgccagcgcatcagtgtcactggggcttgaaagcttcgaatccgcagaggcttttgccaaagcagtgaaggaaaactttggcatgggccctacgttcatttcgacagtgaatagcgaaatcccttccaattggacgatgcctggccgcccggacggaaccacccgaaactccacgtcgatgggagcactgtttggtggtttcagcggaacagcgagctctcaagaggatgtgaagccagttgggcgtcttggttga

SEQ ID NO: 132 - DNA, 1248 bp, Artificial Sequence
  Description of Artificial Sequence: Synthetic polynucleotide
atgtctatgtcgaatgagcagacaaaacgcggttcatgggagcactttcttttgcgcgctgcacgcgaaattagtcttagtgaagcacaatacgaaaaaatcaatgaccgctattctcagcttgaacaaattcttaatgccagtgacaaccctctgttagcggaggcacacatcttcgtacagggcagcatgcgcctgaaaacgaccattaaaccagtcagcggggcgccggaggatcttgacacaatcgatgcagacgctattatctggctgcctcacgcgcaaggagccggagctcaagaagtgttagatgctatcgaagaacgctttaaggcaggatctcgcgttcaagaggagatcaaacagttacgccgtggcatccgtattatttacgccgacgaaaatcctggttttcacatcgatgtcacacctgcccgcgctatcaatggaaactctcagggtaatggcgagggtaaactggaagtcccggaccgtgtgacaggctggaaggcttcgagcccaattccatatagcaattggcttcaagtagcctcgaaacagacgatctcacttgaacacttagctgtagccaaaagtcagcgtgctttcgatgcagctactcaggacccccttcctcagtacgaagattaccttgaccaagaccctctgcgtgctacaattaagcttttaaaacgccatcgtgacgaatgggctatccgcacgaagaacgcggaccatcgtcccatttctgcggtcattacaacgctggctacccatgcttatctggaggtagctaaagagtcccaaaccgcgccccttaaacctcttgatgcgattttggaaatcgtccgccgcatgcccgatcatgtaaaacgtcaagggaacgaatgcttagtgtgcaaccccgcggataacggtgagaacttcgcagagaagtggaatcgtcccttagacggtcatcgctaccgtcgtgcttttgaggaatggcatgagaatgcttctgcgtcggtttcattgggccttgagtcctttgaaagtgctgaagcgtttgcaaaggctgtaaaggagaactttggtatgggtccaacatttattagcacagtgaacagtgaaattccctcaaattggactatgcccggccgcccagatggcacgacacgtaattccaccagcatgggcgcattgtttgggggatttagcggaactgcatcatctcaagaggacgttaaacctgtcggccgcttggga

SEQ ID NO: 133 - protein, 415 aa, Burkholderia sp.
MQTPQRRSTFSHRAATQFFHLADTIARSHEPTSTQLLALESSYISTAEYLAESDEFAGLTTNIHGHGSRALGTLLRPSDESREGFDIDLVARLDQRAMLRYGGDGGPGLLLNHLHAVLSRYASAHGLKIKRWERCVTLEYASGMFADITPVVDDPLSWAPYGDTHGRVPDRQLRTYEPTNPRGLTRSFARAASIVPVFTAVEHLTFAADSVRKSISPLPKADEVFERLLSRLVQLLKLHRNVAFGKATGHEDFAPSSVFITTLAAAAYVDLAPKPHSTPLDLLLDIVEAMPRYFTRERDFGGREVWYLQNPSSPYDNLASSMNMRERQGAFDEWHARICRDLRRLVDMIEANAGLDAVVRIVLAVFGERARAEILKDDRARREAGRKAGRVAIMGGSAAPSSVIAKSKPHTFYGD

SEQ ID NO: 134 - DNA, 1248 bp, Burkholderia sp.
gtgcagacgccgcaacggcgatctaccttttcgcaccgcgcggcgacgcagttctttcaccttgccgatacgatcgcgcgctcgcacgaacctacgtcgacgcaactgttggcgctcgagtcctcctacatcagcaccgcggagtatcttgccgagagtgacgagttcgccggtctgacgacgaacattcatggccatggctcgagggcactggggacgttgctcaggccgtcggatgaatcgcgtgaaggtttcgacatcgatctcgtcgcgcgactcgatcagcgtgccatgttgagatacggcggagacggtggcccaggattgctgctcaaccacctgcatgcagtcctgtcacgatatgcgagcgcacatggtctgaagatcaagcgttgggaacggtgcgtcacgcttgaatatgcaagcggcatgttcgccgacatcacgccggttgtcgacgatccgctatcttgggccccgtacggcgacacgcacggccgtgtcccagatcgtcagttgcggacctacgaacccacgaatccgcgcgggttgacccgcagctttgcgcgtgcagcatcgattgtgccggtcttcactgccgtcgagcatctgacattcgcggccgattccgttcgcaagtccatttccccccttccgaaggccgacgaggttttcgagcgattgctgagccgccttgtacaactgcttaaactgcatcggaacgtagcgttcgggaaggctaccggtcacgaggatttcgcgccctcgtccgtgtttatcaccacgctcgcagctgcagcctacgtcgacctggctccgaaacctcattccacgccgctggatcttctgcttgatatcgtcgaggcgatgccgcggtatttcacgcgggaacgcgatttcggtggccgggaagtctggtacctccagaacccgtcgtcgccttacgacaacctcgcgagcagcatgaatatgcgtgagcggcagggcgcatttgacgagtggcatgctcgaatctgtcgagatctgcgtaggctcgtcgacatgatcgaagcaaacgccggcctggacgccgtcgttcgcatcgtgctcgctgttttcggggagcgcgcgcgagcggaaattctcaaggatgatcgggcgcgacgggaagcgggccggaaagcagggcgcgtggcgatcatgggcggcagcgcggccccatcttccgtcatcgcaaaatcgaagccgcataccttctacggtgattga

SEQ ID NO: 135 - DNA, 1245 bp, Artificial Sequence
  Description of Artificial Sequence: Synthetic polynucleotide
atgcaaacgccccagcgccgttccaccttctcgcatcgcgcagccacgcagttctttcacctggcagacactattgcccgttcgcatgagcctacgtcgacgcaactgttggcgctggaatcttcatacatttccacggccgagtacttggcagaaagcgacgagtttgctggacttactaccaacatccatggtcacgggtctcgtgcgcttgggacactgcttcgtccgtcagacgagagccgcgaaggttttgatattgacttagtcgcccgtttagatcaacgtgcaatgctgcgctatggaggcgacggggggcctggcttgctgctgaaccatctgcatgcggtattatcacgctatgcctcagctcacgggttgaaaattaaacgctgggaacgttgcgtcaccttggagtatgcttcagggatgttcgctgacattaccccagtagtggacgacccactttcgtgggctccctatggcgacacgcacggccgcgtccccgaccgccagcttcgcacgtatgaaccgacgaacccgcgtggtttgactcgcagcttcgctcgcgccgcttccatcgtgcccgtcttcactgcagtagaacatctgactttcgcggcagactcagtccgcaagtctatctctccactgcccaaggcggatgaggttttcgaacgcttactgagtcgcttggttcaattactgaaactgcaccgtaacgttgcgttcgggaaagcgaccgggcatgaagacttcgctccttcgagtgtattcatcactacattggcggctgctgcttatgttgacttagcacctaaacctcactcaaccccattagaccttttattggatatcgtagaagccatgccacgttactttacccgcgagcgcgactttggtggccgtgaagtgtggtatcttcaaaatccctcatcgccgtacgacaaccttgcaagctccatgaatatgcgcgagcgtcaaggcgcgtttgatgagtggcatgctcgcatctgtcgtgacctgcgtcgtctggtggatatgatcgaagctaatgccggactggatgccgttgttcgcatcgttttggccgtctttggggagcgcgcacgtgccgaaatcttaaaggatgaccgcgcgcgtcgtgaagcaggtcgcaaagcgggtcgcgttgcaatcatgggcggttcagcagccccaagctcagttatcgcaaaaagtaagccgcatacattctatggtgac

SEQ ID NO: 136 - protein, 377 aa, Bacillus coagulans
MQNLFSKNNLLDDLLQRIGTKLQIGKTQRKLAEDRYNAVGIWLSKDDDFFNNAKIEIYPQGSLSIGTTVKPLSKQEYDLDLVCQINENWQGKDPLQLLNSIEKRLRENEIYDKMIERKNRCIRLNYANEFHMDILPAHPLDHSTSTNVKVPDRKAKNWKDSNPKGFSQWFNEQALQYNTKLFEIRAGIEPLPSEDNVERKPPLKRAVQLIKRYRDIYFEKDPDSAPISIVLTTLACNFYSEQISVNESISHILNSILLNLPKNGKRLKVTNPTNQNEDLSERWIGHPELYQKFVEFIRVFNKKWQGLQKKTGISEINEELKFMFGEKVATESLKDQTKLISDMRENEKLAVTHTGSFVAAASNKKPTTIKRNTFYGI

SEQ ID NO: 137 - DNA, 1134 bp, Bacillus coagulans
atgcagaaccttttttcaaagaataatttacttgatgacttgcttcaacgtatagggactaagcttcagataggtaaaacacaacgaaaattggcagaagatagatataacgctgtcggaatatggttatcaaaagacgatgacttttttaacaatgctaaaattgaaatctatccccaaggttctctaagcataggtacaacagtaaaaccgttgtctaagcaggaatacgatctggacttggtttgtcaaattaatgaaaactggcaaggcaaagatccattacaattattaaactccattgaaaaacgccttagagaaaatgaaatatacgataaaatgattgaaagaaaaaaccgttgtattcggttaaattatgcaaatgaattccacatggatattttaccagctcatcctctagatcattctactagcacaaacgttaaggttcccgatagaaaagctaaaaattggaaagatagcaacccaaaaggcttttcacagtggttcaatgaacaagctttacaatacaacacaaaattgtttgaaatacgtgctggaatcgaaccattgcctagtgaggacaatgtggagagaaaaccccccttaaaacgggcagttcaattaattaaacgatatcgtgatatttattttgagaaagatccagattcagcaccaataagtattgttttaactaccttagcttgcaatttttattctgagcagatttcagtaaatgaatcaatttcacacattttgaattccattctcttaaatcttcccaaaaatggcaaaagattaaaagttacaaatccaactaaccagaatgaagatttaagtgaacggtggattggacatccagaattatatcaaaaatttgttgaattcattcgcgtttttaacaaaaagtggcaaggtttacagaaaaaaactgggatctcagaaatcaacgaggaacttaaattcatgtttggcgaaaaagttgctactgaatccttaaaagatcaaacaaaattaatatctgatatgagagagaatgaaaaacttgcggttacacatactggatcatttgttgcagctgctagcaataaaaaaccaacaacaataaaaaggaatacattttatggcatataa

SEQ ID NO: 138 - DNA, 1131 bp, Artificial Sequence
  Description of Artificial Sequence: Synthetic polynucleotide
atgcagaatttattctcaaagaataatctgcttgatgatctgttacaacgcatcggaaccaaattacagattggcaagactcaacgtaagctggccgaagatcgctataatgccgtcgggatctggttaagcaaggacgacgatttcttcaacaacgccaagattgaaatttatcctcaggggagccttagcatcggaaccacagtgaagccgttgtccaagcaggagtatgacttagatcttgtttgccagattaatgaaaactggcaaggcaaagatccactgcaactgctgaactcgatcgaaaaacgtttgcgtgaaaatgaaatttatgataaaatgattgagcgtaagaatcgctgtatccgtttaaattacgcaaacgagtttcacatggacattcttcccgctcaccctttggaccatagcacttcaacaaacgtgaaagtcccggatcgcaaagctaagaactggaaggacagcaatcccaaaggttttagtcagtggtttaatgaacaggcgttacagtacaacacaaagttatttgaaattcgcgcaggtatcgaacccttaccctctgaggataatgtcgagcgcaagcctccgctgaaacgtgctgtacagcttatcaaacgctatcgcgacatctacttcgaaaaggaccccgactcggcgcccatttccatcgtcttaacaacacttgcatgcaacttttatagcgagcagatcagtgtcaatgagtctatcagtcacattcttaacagcattttacttaatcttcctaagaacggcaaacgcttgaaagttacgaatcccaccaatcaaaatgaagatttgagcgaacgttggattggacatcccgaactttatcaaaaatttgtcgagttcatccgtgtttttaacaagaaatggcagggccttcaaaagaaaaccggcatttccgagatcaacgaagagcttaaatttatgtttggagaaaaggtcgcgacagaatcactgaaggaccaaacgaaactgatttcagatatgcgtgaaaatgaaaaacttgctgtaacgcatacgggatcatttgtggcagctgcctcaaataagaaaccaacaactattaagcgcaataccttttacggtatt

SEQ ID NO: 139 - protein, 407 aa, Serratia marcescens
MYGSATARSLPAGKKQRIADLLSQIIETLDLTKTQYANIKSAYNGVGTFLSEGDDPLLQDAVIYPQGSVRLNTTVKPKNEEQYDIDLICYLPHATQADYTGVISAIRRRLESHNTYKDLLSDLPRGFRINYAGDYHLDITPGREHTGAQHPGQPLWVVDAHTAWKESNPSGYAEWFDSSASVQPLRTILVMDSASRVGTEALLPLPDSTDKKLLNRIVQILKRHRDEWAAEQDDVRQRCRPISVIITTLACHAYNHIIADRRSYDNDLDILLDVLELMPDFIVSIQGEIQVSNPHMPEENFAEKWNRSEQDEGPQRSETFYQWHAAAQATFNTIAASVGEDNLFLSLEDGFGKKPVDVVRQRLMEHMQSAREQGSLQLDKKTGGLIATGLASTAAQAGVPKNTFYGE

SEQ ID NO: 140 - DNA, 1224 bp, Serratia marcescens
atgtacggttccgctaccgccagaagcctgccggcaggaaaaaagcagcgtatcgccgatttattatcgcaaattattgaaacgctggatctcaccaaaacccaatacgccaacatcaaaagcgcctataacggggtcggcaccttcctgtctgaaggcgacgatccgctattgcaagatgccgttatttacccgcagggcagcgtgcggctcaacaccaccgttaagcccaaaaatgaagagcaatacgatattgacctgatttgttatctgccccatgccacccaggcggattataccggcgtaatatcggccattcgccggcgactggagtcgcataacacttataaagatctactaagcgatttaccccgtggattccgtatcaactatgccggagattatcatctggatatcacgccgggccgcgaacacaccggcgcacaacatccgggccagccgctgtgggtcgtagatgcgcacaccgcctggaaggagtccaaccccagcggctacgccgagtggttcgatagcagcgccagcgtgcagcccctgcgcaccattctggtcatggattccgccagccgcgtgggcaccgaggcgctgctcccgctgccggacagcaccgacaagaaattgcttaatcgcatcgtacaaattctcaaacgccaccgtgacgaatgggccgccgagcaggatgatgtccggcagcgctgccgcccgatttcggtcatcatcaccacgctggcttgtcatgcctacaaccacatcattgctgacaggcgctcctacgacaacgacctggatattctgttagacgtgctggaactgatgccggatttcattgtgtcgatacagggagaaatacaggtcagcaacccgcacatgccggaggaaaacttcgccgagaagtggaaccgctcagagcaggatgaggggcctcagcgcagtgaaaccttttaccagtggcatgccgcggcccaggcgacgtttaacaccatcgccgccagcgtgggggaagacaacctgttcctgagcctcgaagacggcttcggcaaaaagccggtcgatgtcgtcaggcaacgtctgatggagcatatgcagtcggccagagaacaaggcagcctgcaacttgataagaaaaccggcgggctgatcgccaccggcctcgccagcacggcggcccaggccggcgtgcctaaaaacaccttctacggtgaataa

SEQ ID NO: 141 - DNA, 1221 bp, Artificial Sequence
  Description of Artificial Sequence: Synthetic polynucleotide
atgtacgggtctgctactgctcgttctcttccggcagggaagaagcaacgtattgcggacctgcttagtcagattatcgagacgttggacttaaccaaaacacaatacgcgaatatcaaatctgcttacaacggcgtgggcacgtttctgagcgaaggtgatgatcccctgttgcaagatgcggttatttatccacagggctccgtgcgccttaacactacagtcaaaccgaaaaacgaagagcagtatgatatcgaccttatttgttacttgcctcatgctacccaggcagactacacaggcgtgatttcggccatccgtcgccgtttggagtctcacaacacgtacaaagacttattgtcggacctgccgcgcggttttcgtatcaactacgccggggattatcacttggacattacaccgggtcgtgaacatacaggggcacaacatcccggccagcccttgtgggtagtggacgcgcacacagcatggaaggaatccaaccctagtggttacgcagagtggttcgatagcagcgcaagtgtccagcctttgcgtaccatcttagtgatggacagcgcttcgcgcgtcggaaccgaggctttattaccgctgcctgacagtacggacaagaagctgctgaaccgtatcgttcaaattctgaaacgtcatcgtgacgagtgggccgccgaacaagacgatgtacgccagcgctgccgccccatttcagtcattattacgacattagcctgccatgcttacaatcacattatcgccgatcgtcgttcgtatgataatgaccttgatattttgttggacgttttagagttgatgcccgattttatcgtgagcatccaaggggaaatccaagtatcgaatccgcacatgccggaagaaaacttcgcagagaaatggaatcgcagtgaacaagatgaaggcccgcagcgctccgaaaccttctatcaatggcatgcagccgctcaagctacgttcaacacaattgctgcatccgtaggtgaggataacttgttcttgagtttagaggatggttttgggaaaaagcctgtagatgttgtccgccagcgtttgatggaacacatgcaatcggcccgcgagcaaggtagcttgcaattggacaaaaaaaccgggggtttaatcgcgaccggccttgccagtacggcggcacaagcaggagtgccaaaaaatacgttctatggtgaa

SEQ ID NO: 142 - protein, 390 aa, Afipia felis
MRQSQLVDLIEEACQHLEPSAHQRDLAKQRYEGVGEWLAAADDWLLTSIAIRLQGSVAIGTTVKPIGKNEHDVDLVAHVADLDLTVSPALLKQRIGDRLRSNGHYAPLLVEMPRCWRLDYANEFHLDITPSIPNPECRFCGELVPDKTLKTWKASNPQGYRAKFERRAALLPRIRSVFGKAFDSAHANAQVEPYPEEKRLKGILRRIVQIAKRHRDIHFIDDDQGLAPLSIIITTLASRAYETCVSNFEYDHELDLIVDVLRRMPQMLQTSMTEGRVMWCLWNQTTAGENFCEKWNRHPERATAFFEWHSKVVADVEHLAAARGLDQVRRGLGDIFGTAPANKVMDTLTERVDIARRTNRLLATRSAGLIMSTAASATPVRANTFFGDGP

SEQ ID NO: 143 - DNA, 1173 bp, Afipia felis
ttgcgccaatcgcaactggtggacctgatcgaagaggcctgccagcatctggagccatccgcccaccagcgtgacctcgcgaagcagcgctacgaaggcgtcggcgagtggctcgctgcggccgacgattggctcttgacctccatcgcgatccgtctccagggctcggtcgccatcggcaccacggtgaagccgattggaaagaacgagcatgacgtcgacctggtcgcccatgttgcagacctcgaccttacggtgtcgccagctctgctgaagcaacgtattggagaccgtctccggagcaacggccactacgctcccctcttggtggaaatgccgcgctgctggcgtcttgactatgccaacgaattccacctcgacatcaccccctcgatcccgaaccctgaatgccgcttctgcggcgaattggttcccgacaagacgctgaagacgtggaaggcatcaaatccgcagggctaccgcgccaaattcgaacggcgcgcggccctgctgcctcgcatcagatccgtgtttggcaaagcctttgacagcgcacatgccaacgcacaggtcgagccgtatccagaggagaaacggctcaagggcatcctgcgccgcatcgtgcagatcgccaagcgccaccgtgacatccatttcatcgacgacgaccaagggctcgccccgctctcgatcatcatcacgacgctggcttcgcgggcctatgaaacgtgcgtcagcaacttcgagtacgatcacgaactcgacttgatcgttgacgtgctccgccggatgccgcagatgctgcagactagcatgaccgagggtcgtgtgatgtggtgcctgtggaatcagaccactgccggcgaaaacttctgcgaaaagtggaacaggcatcccgagagggcgacggctttcttcgagtggcacagcaaggttgttgccgacgttgaacaccttgccgctgcacggggtctcgaccaggtgcggcggggcctcggcgatatcttcggtacggcaccggcgaacaaggtgatggacaccttgacagaacgcgtcgacatagcgcgccgcaccaaccgcctcttggccacccggtcggcaggactgatcatgagcaccgcggcgagcgcgacgccggttcgcgccaacacctttttcggcgacggtccgtaa

SEQ ID NO: 144 - DNA, 1170 bp, Artificial Sequence
  Description of Artificial Sequence: Synthetic polynucleotide
atgcgccagtcccagttggtagacttgattgaagaggcctgccagcatttggagccttcggcacaccagcgcgatctggccaagcaacgctatgaaggagtgggcgaatggttagccgcggctgacgattggttactgacatctattgcgatccgtttacaaggtagcgtagcgattggcaccacagtcaagccgattggtaaaaacgagcatgatgttgatttagtagcacatgtggccgatcttgatttgaccgtctctcccgcacttttaaagcaacgcatcggcgaccgtcttcgcagtaatggtcactacgcacctctgttagtcgagatgccccgttgttggcgtctggattatgccaacgagtttcatttagacattactccttctatcccgaaccccgaatgccgtttctgtggtgagttggtacctgacaagacattaaaaacgtggaaagcaagtaacccccagggataccgcgcgaagttcgagcgtcgtgctgcgttactgccccgtatccgttctgtattcgggaaggccttcgactcggctcacgctaatgcacaagttgaaccgtaccctgaagaaaagcgtcttaaaggcatcctgcgccgtattgtgcaaatcgccaaacgccaccgcgatatccattttattgacgatgatcaagggctggcaccattaagtatcattattacaacgttagctagtcgcgcgtacgagacatgtgtgtcaaattttgagtatgaccacgagcttgatctgatcgtggatgtgctgcgccgtatgccgcagatgttacaaacctcaatgaccgaaggtcgcgtgatgtggtgcttatggaaccagacaactgcaggtgagaacttctgtgaaaaatggaaccgtcacccagagcgcgccactgcattcttcgagtggcactccaaggtggtcgctgacgtcgaacatctggccgctgcacgtggcttggatcaagtgcgtcgtggcttaggcgacatctttggaactgcacctgctaacaaggtaatggatacgttgacggaacgtgtcgacattgctcgtcgtactaaccgcctgttggcaactcgttcagcgggacttatcatgtctactgctgcctccgcgactcctgtgcgcgcgaatactttttttggagacggcccg

SEQ ID NO: 145 - protein, 399 aa, Rhodopseudomonas palustris
MNQMFTAPPQTHLLLRKAEVYSLLDQICQALELTAAQLEAARTSYEAVAEWLSGSDNPLLKWIDIYAHGSTGLGTTVKPIGREDFDVDLICKVLRFTADRPPAELKRIVGDRLKENARYAAMLEEKKRCWRLNYAREYHLDISPTINNAKCANGGELVPDKKLREFKPTNPKGYKALFERRAALIPTLRMQKALAAEDRAAVEPFPVHGTAKGILRRTVQILKRHRDVHFLEVVEEIAPISIIITTLAAQSYEYCVKSFVFDSELDVLIATIRLMPHFIDKPVVNGRRIYVVANETTVGENFAERWNTEPARAAAFYEWHAKALADFEALPDLQGIDVIGKSLEGSLGSSVVRKVIDARTDSISQARTAKKLYVAPTVGLTLSSAANATPVRSNTFFGD

SEQ ID NO: 146 - DNA, 1200 bp, Rhodopseudomonas palustris
atgaatcagatgttcacggcgcctccccagacgcatctgcttttgcgcaaagccgaggtttactcgctcctcgatcagatttgccaagcgctggagttgaccgctgctcagcttgaggctgcgcggacgagctacgaggctgtcgcggaatggctctccgggtcggacaaccctcttctgaagtggatcgatatttatgctcacggctcgaccggcctcggcacgacggtcaaaccgatcgggcgcgaagatttcgacgtcgatctcatctgcaaggtgctgcgctttaccgctgaccggccaccggcagagttgaaacgcattgtcggcgatcgcctgaaggagaacgcgcgctacgctgccatgctcgaagagaagaagcgctgctggcgcttgaactacgcacgcgaatatcatctcgacatctcgccgacgatcaacaatgccaaatgcgccaacggcggcgaattggttcccgacaagaagctgcgggaattcaaaccgacgaatccgaaaggctacaaggcgctctttgaacgcagggcagccctaatccccaccttgcggatgcaaaaggctctcgctgccgaggaccgtgcggccgtcgagcccttccctgtgcatggcaccgccaaaggcatcctgcggcggacggtgcagatcctcaagcggcatcgtgatgtgcatttcctggaagtcgtcgaggagatcgcaccgatctccatcatcatcaccacgctcgcggcacagtcgtatgagtattgcgtcaagagctttgttttcgattccgaacttgacgttctgatcgcgaccattcggttgatgccacacttcatcgataagccggtcgtcaatggtcggcggatctatgtggtggccaacgaaaccacggtcggcgagaacttcgccgagcgctggaatactgagccggctcgcgccgccgccttctacgagtggcatgcgaaggcactggcggacttcgaggcccttccggatttgcagggcatcgacgttatcggcaagagcttggaaggaagcctcgggagttcggtcgttcgcaaagttatcgatgctcgcaccgacagcatttcgcaggcacgcacggccaagaagctctacgtcgcgccgacggtcgggctcacgctgtccagcgcggccaatgcgacgccggttcgctccaacacgttcttcggtgactag

SEQ ID NO: 147 - DNA, 1197 bp, Artificial Sequence
  Description of Artificial Sequence: Synthetic polynucleotide
atgaaccagatgtttacagcacctccccaaacccaccttcttttgcgcaaggcggaggtctactctcttttagatcaaatttgccaggcgttagagctgacggctgcacagttggaagcagcccgtacatcttacgaagcagtcgccgagtggttatccggaagcgacaatccactgttaaagtggatcgacatctacgctcacggcagcactgggctgggcaccaccgtaaaaccaatcgggcgcgaggacttcgacgtcgatttaatttgcaaggtccttcgttttacagcggatcgcccaccggcagaactgaagcgcatcgtcggggaccgtctgaaagaaaatgcccgctacgcagctatgctggaggagaaaaaacgctgctggcgccttaattacgcgcgtgagtaccatctggacatctctcctacgatcaacaacgccaaatgtgccaacgggggtgaactggtccctgacaaaaaattacgcgagttcaagccaacgaatccaaagggctacaaagcgttgttcgagcgccgtgcggctttaattccaacgcttcgcatgcaaaaagccttagctgccgaggatcgcgccgcagtagagccttttcccgttcatggaaccgccaaaggcatcttacgccgcacagtgcagatccttaaacgccatcgtgatgtccatttcttagaagttgtggaggagattgcccccatttcgatcattattacgacgctggccgcgcagagctacgaatattgtgtaaagagttttgtattcgactcagaacttgatgtacttattgcaacgatccgcttgatgccacactttatcgacaaaccggtcgtcaatgggcgccgcatttacgtggttgcgaatgagacgactgtgggtgaaaattttgcggagcgctggaatactgaacctgcgcgcgcagccgccttttatgagtggcacgctaaggcattagccgacttcgaagctttgccggatcttcaaggcattgacgtgatcggtaaaagtctggagggaagtttgggaagttcagttgtccgtaaagtcattgacgctcgcaccgactcaatcagtcaggcacgcaccgccaaaaaactttatgtagctccgactgtcggacttacccttagttcagcggccaatgcaacacccgtacgctccaacactttcttcggtgac

SEQ ID NO: 148 - protein, 387 aa, Mycobacterium intracellulare
MDTMEQMLSMLLSGAVETLDIPPHLQALAIASYEEVGNWLAEHGEHRCRVYPQGSFRLGTVVRPHSLTGDFDIDLVFLMLLAKEATTQARLKQDVGDLLHSYLDWKERNGHPGGLKTCESRRRCWTLDDPVNGFHLDVLPAIPDLEYLPTGILLTDKELFHWQHSDPIGYANWFRRRSQELQNKVITAAAQRGVDVEDVPIWEFRTTLQRVVQVLKWHCMLYFADDPDNRPPSILITTLAAKAYRGETDLFTATRNALAGMNRYIEDRNGVNWVANPAHEEENFVDKWKEYPERRKAYYAWQRDLADTLDDALSLRGKGLQTVASQLAQSFGAEPIRQSTLKYGQRMRGHTTNRSLRLGTTGLLAPSATGIAVPPHNFYGQHPDPSH

SEQ ID NO: 149 - DNA, 1164 bp, Mycobacterium intracellulare
atggacaccatggaacagatgctgtcgatgctgctcagcggcgccgtcgaaaccctcgacataccaccgcatctccaggccctcgccatcgccagctatgaagaggtcgggaactggctggccgagcatggcgaacaccgctgccgggtatacccgcaaggctcattccgcctcggcacagtcgtgcggccgcacagcctcaccggcgacttcgacatcgacctggtcttcttgatgctcctcgcgaaggaagccaccacccaggcgcgcctcaaacaagacgtcggcgacctcctacacagctacctggactggaaagaacgcaacgggcaccctggcgggctgaagacctgcgaatcccgacggcgctgctggacactcgatgaccccgtcaacgggttccacctcgacgtcctgcccgcaatccccgatctcgagtacctgcccaccggcatcctgctgaccgacaaagagctgttccactggcagcacagcgacccgatcggctacgccaactggttccggagacggtcacaggagctgcagaacaaggtgatcaccgcagcagcccaacgcggcgtcgacgtggaggacgtccccatctgggaattccgcaccaccttgcagcgcgtcgtacaggtcctcaagtggcactgcatgctctactttgccgacgatcccgacaaccgtcctccctcgatcctcatcactacactggccgccaaggcctaccgcggggaaacggacctattcactgccacacgtaacgcgctggccggcatgaaccgctacatcgaggaccgcaacggcgtcaactgggtcgccaaccccgcccacgaggaagaaaacttcgtcgacaaatggaaggagtacccggaacgccgaaaggcgtattacgcctggcaacgcgacctcgccgacaccctggacgacgcactgagcctgcggggcaagggattgcagaccgtcgcctcccagctcgcgcagagcttcggcgctgagcccatacggcagtcgaccctgaaatacggccagcggatgcgcggccacaccacaaaccgatcactccgcctcggcaccaccggactgctggcacccagtgcgacggggatcgccgtccctccccacaacttctatggccagcaccccgacccgagccattaa

SEQ ID NO: 150 - DNA, 1161 bp, Artificial Sequence
  Description of Artificial Sequence: Synthetic polynucleotide
atggatactatggaacagatgctttctatgcttttaagtggcgcagttgaaaccttagacatccccccccacttacaagccctggccattgcctcttatgaagaagttggtaactggttagctgaacatggtgaacaccgttgtcgtgtgtatccgcaaggtagttttcgccttgggactgtagtccgtccacattcgttaacgggggatttcgacattgaccttgtctttttgatgttgctggcaaaggaagcaaccacccaagcccgtttaaagcaggatgtcggcgaccttctgcactcatatcttgattggaaggagcgtaatggccaccctggcggtttgaaaacctgcgagagccgccgtcgttgctggacgttggatgatccagtcaatggtttccatcttgacgttctgccggccatcccggatctggagtatcttccaacgggcatcctgcttactgacaaagagctgttccactggcagcactcagatccgattgggtacgccaattggttccgtcgccgtagtcaggaacttcaaaacaaggttattactgccgccgcacaacgcggtgttgatgtcgaagatgtacccatctgggaattccgcactacgttacagcgcgtggtccaggtgcttaaatggcattgtatgttgtacttcgccgatgatcctgacaaccgccccccatctattttaatcactactcttgctgcaaaagcgtaccgtggggagaccgacctgtttaccgcaactcgcaacgccttggcagggatgaatcgttatattgaggaccgcaatggcgttaattgggtcgctaaccctgctcacgaagaggaaaactttgtagacaagtggaaagaatatccggagcgtcgcaaggcctattatgcttggcaacgtgatttggcagatacacttgacgacgcccttagtctgcgcggtaagggtttgcaaacagtagcctctcagttggcacagtcctttggtgcagagccgatccgccaaagtaccttgaaatatggacaacgtatgcgcggacatactactaatcgttcactgcgtctgggaacgaccggattgcttgccccttccgcgacgggtatcgccgtaccgccccacaatttttacgggcagcatcccgatccttcacat

SEQ ID NO: 151 - protein, 485 aa, Streptococcus mutans
MENIIIGKEIKELIEELDVSDSEYEEATKRYNSIAEYIKNSELDSEKPDIYLQGSFKLGTAIRPLTEDGAYDIDIVCNFTKLKKEDQSQSSLKYELGKVVKQYAKSKSMSNDPKESKRCWTLKYVDDNNFHIDILPSVPLHNKDDEYIAITDKAKDNYFEISSNWETSNPKGYADWFREVSKYTVYQEKIAKRFYASIEKVPEYKVRTPLQRIVQILKRHAEICFEDDIEFKPGSVIITTLAAKQYRLASSIHNDFWDVISYIINHLKDGIELRNGKPCVYNPVNYSEVLSGKWDKDKRYVEAFNNWLKQLESDFNIGNDEITYPNRIQYLKRSLFKNARSQFPIINVTSLRHHQKSKWTECLVKDVFVKAMYSQNGFRWKTIRSGTALNKHGDLKFEVKANDLKQYEIWWQITNTGKEAENANSLRGDFYSSELIEGKKIKKESTLYTGRHFVEAYLVKDGICFGKSQPFEVNIVDNFTLDFAR

SEQ ID NO: 152 - DNA, 1458 bp, Streptococcus mutans
ttggaaaatatcattattggaaaagaaattaaagaattaattgaagaattagatgtttctgattctgaatatgaagaagcgacaaaaagatacaactcaattgctgaatatataaaaaattcagaactcgattcagaaaagcctgatatatatttgcaagggtcatttaaacttggaacagcaattagacctctgacggaggatggcgcttatgatattgatatagtttgtaattttacgaaattaaaaaaagaagatcaatcacaatcttcattaaaatatgaattagggaaagtagtaaagcaatatgctaaatctaaatcgatgtccaatgatccaaaggaaagtaaaagatgttggacattaaagtatgttgatgataacaattttcatattgatattttaccgtctgtcccattacataataaggatgatgaatatatagctatcactgataaagctaaagataattattttgaaatatcttcaaactgggaaacaagcaatcccaaaggatatgctgattggtttagagaagtatcaaagtacactgtatatcaagaaaaaattgctaaaagattttatgcatctattgagaaggtacctgaatataaggttagaacgccattgcaaagaattgttcagattttaaaaaggcatgcagagatttgttttgaagatgatattgaatttaaaccaggctctgttatcatcacaacactggcagcaaaacagtaccggcttgcaagttctattcacaatgatttttgggatgttataagctatattattaaccatttgaaagatggtatagaactccgtaatggtaaaccttgtgtttataatccagtgaactattcagaagttttatctggtaaatgggataaagataaaagatatgttgaagcatttaataattggttgaagcaattggaatcagactttaatattgggaatgatgaaataacatatcctaatcgaattcaatacttgaaaaggtctttattcaagaatgctagaagtcagtttccgattattaatgtaacttcactgagacatcatcaaaagtcaaaatggaccgaatgtctagtaaaggatgtatttgttaaggccatgtattctcaaaatggatttagatggaaaacaataagaagtgggactgcattaaataagcatggtgatttaaaatttgaagtgaaagctaatgatttaaagcaatacgaaatttggtggcagattactaatactggtaaagaagcggaaaatgcaaattcattgagaggggatttctatagctctgaattgattgaaggaaaaaaaataaaaaaagaaagcactctatatactggacgtcattttgtggaagcatatcttgtgaaggatggtatctgctttgggaagagtcaaccattcgaggtaaatatcgtagataattttactcttgattttgcaaggtga

SEQ ID NO: 153 - DNA, 1455 bp, Artificial Sequence
  Description of Artificial Sequence: Synthetic polynucleotide
atggaaaatatcattattggcaaagagattaaggaacttattgaagaattagacgtctccgattcggaatatgaagaagcaacgaaacgttacaatagtatcgccgaatatatcaagaactcggaactggactccgaaaaacccgatatttatttgcaaggatctttcaaattagggacagccatccgtccgctgacagaagacggcgcatacgacatcgacatcgtgtgcaactttactaaacttaaaaaggaggatcagagccagagttcgcttaagtacgagttgggcaaggtcgtgaagcagtacgccaaaagtaagtccatgtctaatgaccccaaagagagtaaacgctgctggacgttaaagtacgttgacgacaataattttcacattgacattttgccctccgtgccactgcacaataaagatgacgaatacatcgccattacggataaggcaaaggataactattttgagatcagctccaattgggagaccagtaatccaaagggctatgccgattggtttcgtgaggtatccaaatacacagtataccaagaaaagattgcaaagcgcttctatgcaagtattgaaaaagttcctgagtacaaagtgcgtacccctcttcagcgtattgtgcaaatcttaaaacgtcatgcggaaatctgcttcgaggatgatattgagtttaagccaggaagtgttattatcacgacacttgccgcaaagcagtatcgccttgcctcgagcattcacaatgatttttgggacgtcatctcctatatcatcaatcatcttaaggacggcatcgagttgcgtaatggaaaaccctgcgtatacaacccggtgaattacagcgaggtcttatccggaaaatgggacaaggacaaacgctacgtggaggcctttaataattggttgaagcaattggagtcggactttaatattgggaatgacgaaatcacctatcctaatcgcatccagtatcttaaacgtagtttgtttaaaaacgcccgcagccagttcccgatcattaacgttacatcattgcgtcatcaccaaaaaagtaaatggactgaatgtttggtaaaggatgtattcgttaaagcaatgtattcacaaaatgggttccgctggaagaccattcgtagtggcaccgctcttaacaaacacggtgacctgaaattcgaagtcaaagccaatgacttgaagcaatatgagatttggtggcaaatcacaaacaccgggaaagaagcagaaaacgctaacagtttgcgcggagatttttattcctcggaattaatcgaaggtaagaagatcaaaaaggaatccactctgtacactggccgccacttcgtggaagcctaccttgtgaaagatgggatttgtttcggtaaatctcagccgttcgaagttaatatcgtggataattttacattggacttcgcccgc

SEQ ID NO: 154 - protein, 401 aa, Escherichia coli
MPTKNAEDFLTALAEELAISDSRYEQACRSYTSLGEWLHRPESAVAKYDPQVYVQGSFRLGTAIRPLNDAEEYDVDSVCLLQSLGTKDLTQYNLKTLVGDEIKAYRKAQNMVKPVREGRRCWVLDYADGAQFHMDVVPSLPNATQQRILLETYGYDLKWSETAMVITDIESPVYQVLSDNWQRSNPKGYAEWFKMRMRDVFEQRRKMLAESIKASVEEIPDYKVRTPLQSAIMILKRHRDGMFEKRYDERPISIIITTLAAHAYNGEVKIADALYSILSRMDSFIERDGGRYIIRNPSDPLENFADKWPNHPERKDAFYEWLDQARQDFGNLAHQIEKRRLVESVRPHMGAVADRAATRLSPTPGSMLQPATGVAALGVVAASTPAFPNTRREPTSPKGFA

SEQ ID NO: 155 - DNA, 1206 bp, Escherichia coli
atgccaacaaaaaacgccgaagattttctcaccgcactagccgaggaacttgcaatcagtgactcacgatacgagcaggcatgtcggagctatacatcacttggagaatggcttcaccgtccggagtccgccgttgccaaatacgatccacaagtttacgtacagggttcattccgactgggtacagcgattcgtcctttgaatgatgcggaggagtacgatgtagattctgtttgcttactccaaagcctcggtaccaaggatcttactcagtataatttaaagactctggtcggcgatgagatcaaagcttatcgtaaagctcaaaatatggttaagcccgttcgtgaaggccggcgctgctgggttctggactatgcagacggcgcccaatttcacatggatgtcgtcccctctctccctaacgctacccagcaacgtatattacttgagacttatggctacgatctcaaatggtccgagacagcaatggtcattactgatatcgaatctcctgtttaccaggtgctttctgataattggcagcgatcaaatcccaagggatatgctgagtggttcaaaatgcggatgagagatgtttttgaacagcggagaaaaatgcttgcggaatcaatcaaagctagtgtcgaggagattcctgactacaaagttcggaccccgctccagtcagcgataatgatcttgaaacgccaccgtgacggtatgtttgaaaagcgttacgacgagcgccctatatcgatcattattactacccttgccgcgcatgcttataatggtgaagtaaagatagccgatgctctctattcaatcctttctcgaatggactcgtttatcgaacgtgatgggggtcgttatatcattcgtaacccttccgaccccctcgaaaatttcgcggataaatggccgaatcatcctgagagaaaagatgctttctacgagtggctcgaccaggctcggcaagattttggaaatttagcacatcagattgaaaaacgccgcttagttgaaagcgtccgacctcatatgggagcggtagcagacagagctgcaacacgccttagccctacgccaggatcaatgttgcaaccagcaacaggagttgcagctctgggtgttgttgcagcgagcacaccggcatttccaaatactcgtcgggagccaacttcaccaaaggggtttgcatga

SEQ ID NO: 156 - DNA, 1203 bp, Artificial Sequence
  Description of Artificial Sequence: Synthetic polynucleotide
atgccaaccaagaacgctgaggacttccttacggctttagctgaagaactggctatctccgattcccgctatgaacaggcatgccgcagctacaccagtttgggggaatggttgcatcgtcccgaatccgctgtggctaaatatgacccccaggtttacgtgcagggaagttttcgtctgggcaccgcaatccgccctttaaatgatgctgaagagtatgacgtggactccgtgtgtctgcttcagagtttaggaacgaaggatttaacccaatacaacttaaagactcttgttggggacgagatcaaagcttaccgtaaggcacagaacatggttaaacctgttcgtgagggccgtcgttgttgggttcttgattatgcagatggtgcacaattccacatggacgtggttccatctcttcctaatgcgacacaacagcgtatccttcttgagacttacggttatgacctgaaatggtcagaaacagcgatggttattaccgacatcgaatcgcccgtttaccaggtactttcagataactggcaacgctcaaatcctaagggctatgcggaatggtttaaaatgcgtatgcgtgacgtctttgagcaacgtcgtaagatgttggctgaaagtatcaaggcgagcgttgaggagattccggattataaggtccgcaccccactgcagtctgcgattatgatcctgaagcgccatcgtgacggcatgtttgagaaacgctatgatgaacgccccatttcaattattatcacaaccttggcagcgcacgcctataacggtgaggtgaaaatcgcggatgctttatattccattctgagccgtatggacagctttatcgagcgtgacggtggccgttacatcattcgtaacccctccgacccgctggaaaacttcgcggacaaatggccgaatcaccccgaacgtaaagatgctttttatgaatggttagaccaagctcgccaagacttcggcaatctggcccaccaaattgagaaacgccgccttgtcgaatccgtgcgtccccacatgggcgcggtcgccgaccgtgctgcaacccgtttgagccctacgccgggatctatgctgcagccagctactggtgttgccgctcttggagtcgttgcagcttccacacccgcgttccccaacacacgtcgcgagcctacctcacctaaaggttttgct

SEQ ID NO: 157 - protein, 396 aa, Vibrio cholerae
MSNTKSNDVLNTILEKIELPDSAYEKAEKRYKDLGDWLHRPESTCVNFDPHVFSQGSFRLGTAIRPDSEEQYDLDMGCNLRRGLDKTSITQKQLKHLVGHELELYRNARGIKEELAEKKRCWRLEYADGLSFHMDIVPCVPESDTGRGLLKKLMVENSKFDENLAQNVSQLAVSITDNTDFTYAVVNENWRISNPEGYARWFETRMKTARLVINEREMRFKASIDSLPYYQWKTPLQQVIQLLKRHRDTMFKNNEDSKPISVIITTLAAKSYKGESDLASALNTVLSEMDDHISAQAPMIPNPVNPAEDFADKWYDEKSAQYRLQENFYKWLYQARADFSALCSSDDTQRIVNAAQNGLDLKLDSSSVARLLGIPAVTAKPTFAIQSSDPKPWFKQ

SEQ ID NO: 158 - DNA, 1191 bp, Vibrio cholerae
atgagtaatactaaaagtaacgatgttctaaacacaattctggaaaaaattgagctaccagacagtgcttatgaaaaggctgaaaaacgctataaggatctaggtgattggttacatcgcccagagtcaacatgcgtgaattttgatccccacgtgttttctcaaggttcctttcgtctaggtacggcgattaggcccgattcagaagaacagtatgacctagacatggggtgcaatcttcggcgtggcctggataaaacgtctatcactcaaaagcaactaaagcacctagtcggtcatgaattagagctttatcgaaacgccagaggaattaaggaagagctagccgagaagaaacgctgttggcgcttagagtatgccgatgggcttagctttcacatggacatagttccgtgtgtgccagagagtgatacaggaagaggccttttgaaaaagctgatggtcgaaaactctaagtttgatgaaaacttggctcaaaatgtgtctcagcttgcagtttcgattaccgacaacacagatttcacttatgcagttgtgaatgaaaactggcgtatcagcaatcctgaaggatatgctcgatggtttgaaacgcgcatgaagacggcacggttagtaataaacgaacgtgaaatgcgatttaaagccagtatagatagtctgccatattatcaatggaagacacccttacagcaggttatccaattattgaagcgtcatcgtgacactatgtttaaaaacaatgaggatagtaagccaatatcggtaatcatcactacattggcggctaaatcatataaaggtgaaagtgatttggcttcagcgttgaatacggtgctctccgagatggatgaccatatttctgcacaagcgccaatgattccgaacccagtcaacccagccgaagattttgcagacaagtggtatgacgaaaaatctgctcaataccgattacaagaaaacttttataaatggctgtatcaagctagagctgattttagtgctctttgctcaagtgatgatacgcaacgaatagtaaatgcggcgcaaaatggtttggatttgaagcttgattcaagttcggtagcacgtctattgggtattcctgcggtgacagcaaaaccaactttcgcaattcaatcatctgatccaaagccatggtttaagcaatag

SEQ ID NO: 159 - DNA, 1188 bp, Artificial Sequence
  Description of Artificial Sequence: Synthetic polynucleotide
atgtcgaacactaagtcgaatgatgtgttaaatactattttagagaagatcgaattgcccgactcagcctacgagaaggccgaaaagcgctataaagaccttggagattggttacaccgtcccgaaagtacgtgcgtcaattttgatcctcatgtattctcacaaggctcctttcgtttggggacggccatccgtccagattcagaggaacagtatgacttggacatggggtgtaacctgcgccgcgggttagataagactagcattacgcaaaaacaactgaagcaccttgtaggtcacgagctggaactgtatcgtaacgctcgcggtattaaggaagagttagcagaaaaaaaacgctgttggcgcttagagtatgcagacgggttatcatttcacatggatattgtgccctgtgtccctgagagtgatacgggacgtgggttgctgaaaaagttgatggtagagaactctaaatttgatgagaacctggctcaaaacgtatcacagttggcagtgtctattacagataacaccgattttacatacgcagttgtcaatgagaactggcgtattagtaatcctgaggggtacgcgcgctggttcgaaacgcgtatgaagacagctcgtttagtaatcaatgagcgcgagatgcgttttaaagccagtatcgattcgctgccttattatcagtggaagactcccttgcaacaagtaatccaacttcttaaacgccaccgtgacaccatgttcaaaaataatgaagactcgaagcccattagcgttatcatcacaactctggcggcgaaaagttataagggggaaagtgatctggcatcagcattgaacaccgttcttagcgaaatggacgatcatatctctgctcaggcccctatgatccccaatcctgtaaaccccgcagaggattttgccgataagtggtacgatgaaaaatcggctcaataccgtctgcaagagaacttctataagtggctgtatcaggcacgcgccgatttcagtgcgttatgtagctcagatgatacgcagcgcattgtaaacgctgctcagaacggcctggacttaaagcttgattcgtcatccgtagctcgtctgttgggaatcccagccgtgacggctaagccaaccttcgcaatccagtcctcagatcctaaaccgtggttcaaacag

SEQ ID NO: 160 - protein, 418 aa, Vibrio vulnificus
MQDQGFKSLRQLSASDKEFCFEMISHITSNLDLTETQLSQLKTAYRAIGSYLANQGGELAECHIYAQGSVGIGTSVKPIDEDSDMDIDLVLHLPSQHYPTTTDEANELLFNLIRVLKDSQRYGDKIENMPKRRCVTLQYGGIEGQGFHMDITPSMPEDMDSPNHKSKVRVADIKDANSPSHPYGYRKWFRSACSKEIRWNRKSNYRSNNDIYAGTVEPLPGQGRKTVLQIVVQLLKRHRDMWKQNKQNVYGDCAPISIIITTLAGLAYEKCSNSNKEYYNPFDLMLDVLEEMPNFISHQYQSNGTVKYTIRNPALPTENFADKWHEKPMLPQAFKAWYTQVTEDLAKLLELDQGLDKTIERSREMFGSQAARGIQAKLADTLTERRAKNRAVVSSIGLGVSNAATATPVPKHNFYGDV

SEQ ID NO: 161 - DNA, 1257 bp, Vibrio vulnificus
gtgcaagatcaaggtttcaaatcactaagacaactaagtgcaagcgacaaagaattttgtttcgagatgatctctcatatcacatcgaacctagacttgaccgaaacacagttgtctcaattgaagacggcttaccgagctatcggatcctacttggcaaaccaagggggcgaactagcggaatgccacatttatgctcaaggtagtgttggtattggcacatccgtaaaaccgattgatgaagactcagacatggatatagatctcgtgctgcacttaccaagtcagcactatccaacaactactgatgaagccaacgagctactcttcaatttgatacgagtgctgaaagactctcaacgatacggtgacaaaatagagaatatgccaaaacgcagatgtgtcactctgcaatatggaggtatcgaaggccaggggttccacatggacatcacccctagcatgcctgaagatatggactcgccaaaccataagagcaaagtaagagttgcagacatcaaggatgccaatagtccttctcatccatacggatataggaagtggttccgaagcgcgtgtagtaaagagattcgctggaatagaaaaagcaactacagatctaataatgatatatatgcggggacagtagaaccgttacctggtcagggtcgaaagactgtacttcagattgtagttcagcttctcaagcgacatagagacatgtggaaacaaaataagcagaacgtttatggcgattgcgctccaataagcataattattacgactctagcaggtctagcttatgaaaagtgctcaaactctaacaaggaatactacaacccatttgatctgatgttagatgtacttgaagaaatgccaaacttcatttcccatcaatatcagtctaacggtactgtaaagtacactattcgcaacccagcacttcctacggagaattttgcagataaatggcatgagaaaccgatgttaccccaagcatttaaagcgtggtatacgcaggttactgaagacttagcaaaactacttgaattagatcaagggcttgataaaaccattgagcgatcaagagaaatgtttggttctcaagcagcaagaggaatccaagccaaacttgcggacactctgactgaacgacgagctaaaaatcgtgcggtagtttcttctattggcttaggagtatccaatgcagccactgccacccccgttcctaaacacaacttctacggtgatgtatag

SEQ ID NO: 162 - DNA, 1254 bp, Artificial Sequence
  Description of Artificial Sequence: Synthetic polynucleotide
atgcaagaccaaggtttcaagtctctgcgtcaattatctgcgtcggacaaggaattttgtttcgaaatgatctcgcacattacaagcaatcttgaccttacggaaactcagttatcgcagttgaaaacagcgtaccgcgctattggttcataccttgccaaccaagggggcgaattagctgagtgtcacatttacgcgcagggttccgtcggaattggaacatcggtcaagccaatcgatgaggacagtgacatggatattgacttagtgttgcatctgccatcccaacactaccctacaacaacggatgaggctaatgaattactttttaacttgattcgcgtgcttaaagattcccaacgttacggcgacaagatcgaaaacatgccaaagcgtcgctgcgtgacgttacaatacggtggaatcgaggggcaagggttccacatggatattacgcccagtatgccggaagatatggattctccgaaccataaatcaaaagttcgcgtcgccgacattaaggacgcgaatagccccagccacccgtacggctaccgtaaatggtttcgctccgcgtgtagtaaggagattcgttggaaccgtaaatctaattaccgcagcaacaatgacatttatgccgggacggtcgaacctttgcccggccaaggccgtaagacggtgcttcaaattgtcgttcaattgttgaaacgccaccgcgatatgtggaagcagaataagcaaaatgtgtatggcgattgtgcccctatctcgatcatcatcaccacgttggccggtttggcatacgaaaagtgcagtaacagtaataaagagtattataacccctttgacttaatgttagacgtgctggaggaaatgcccaatttcatttcgcaccaatatcagagtaatggtaccgtcaaatatacaattcgtaaccccgcacttcccactgaaaacttcgcggataagtggcacgagaagcctatgttaccccaggcgttcaaagcgtggtatacgcaagttacggaagatcttgctaagctgcttgaattggatcagggcctggacaagaccatcgagcgtagtcgtgagatgttcggctcccaagcagcgcgcggaatccaggcaaagttggcagacacattaactgagcgtcgtgctaaaaatcgcgccgtcgtttccagtatcgggttgggcgtgtctaatgcagccaccgcgacgcccgtcccaaagcataatttttacggagacgtg

SEQ ID NO: 163 - protein, 299 aa, Burkholderia sp.
MSISEAQLETWSHQGAIRGSSLTYQAIKSTLENADSPYAGKNIEVFLQGSYGNATNIYAESDVDVVILLKDCFQQDLKALSEEQKTAWRAAYHDAVYAHRDFKKDVVSVLRDAYGGDVTVGDKAIAIAARGVRRKADVIAAIGYRRYYRFNGLRDQSYDEGICFYDAAGTRIANYPKQHAENLTAQHQATQQRLKPMVRIWKNLRSALVEAAAIEAGAAPSYYLEGLLYNVPVDKFVGSYGDTFVNVYNWLVTEADKTQLVCANRQYYLLRDNAPTCWAPAQCEAFLAATLAYWDDWGA

SEQ ID NO: 164 - DNA, 900 bp, Burkholderia sp.
atgtccatttccgaagcgcaattggaaacctggtcgcaccagggggccatccgtgggtcgagcctgacctatcaggcgatcaaatccacgctggagaacgcggacagtccctatgcgggcaagaacatcgaggtattcctgcagggctcctacggcaacgccacgaatatctacgccgagagcgatgtcgacgtggtgatcctgctgaaggactgcttccagcaggacctgaaggcgttgagcgaggagcagaaaaccgcttggagggcggcgtatcacgatgcggtgtatgcgcaccgggatttcaagaaggacgtggtgtcggtcctgagggatgcctacggcggtgacgtcacggtcggcgacaaggcgatcgccatcgccgcgcgcggcgtgcgccgcaaggcggatgtgatcgcggcgattggctaccggcgctactaccgcttcaacggcctgcgcgaccagtcctacgacgaaggcatttgtttctacgacgcggcggggacgcggatcgccaactatcccaagcaacacgctgagaaccttaccgcccagcatcaggccacccagcagcggctcaagccgatggtgcggatctggaagaacctgcgcagcgcgctggtcgaggcggccgcgatcgaggctggcgccgcgccgtcctactatctcgagggcctgctgtacaacgtgccggtggacaagttcgtcggcagctatggggatacgttcgtcaacgtctacaactggctggtgaccgaggcggataagactcagctggtgtgcgccaaccggcagtactacctgttgcgcgataacgcgccgacctgctgggccccggcgcaatgcgaggcctttctcgcggcgaccctggcgtattgggacgattggggcgcatga

SEQ ID NO: 165 - DNA, 897 bp, Artificial Sequence
  Description of Artificial Sequence: Synthetic polynucleotide
atgagcatctctgaagcgcagttagaaacctggagtcatcaaggtgcgatccgtgggtccagtttaacttaccaggctatcaaatcgacacttgagaatgccgattcaccctatgctggaaagaacattgaagttttccttcagggcagctatggaaacgctacgaatatctatgcagaaagcgatgtggacgtggtgatcctgctgaaagattgtttccagcaggatttaaaagccttatccgaggagcagaagacggcatggcgcgctgcataccacgatgcagtgtatgcacatcgcgatttcaaaaaagacgtcgtaagcgtccttcgcgacgcttatggtggagatgtgacagtcggtgataaagccattgctatcgccgcacgcggcgtacgtcgcaaagcggatgtaattgcggcaatcggctatcgtcgctactatcgtttcaatgggttgcgtgaccaatcttacgacgagggaatttgtttttacgatgctgctgggacgcgcatcgctaattatccaaagcaacacgccgaaaacttgactgcccagcatcaagccacgcagcaacgcttaaaacctatggtacgcatttggaagaatttgcgtagcgctcttgtagaagcggctgctattgaggcgggggctgcgccttcatattacttggagggtttgttgtataatgtccccgtcgacaaatttgtagggtcctatggtgatacctttgtgaacgtctacaactggttagttacagaagcagataaaacacaattagtctgcgcaaaccgtcagtattatctgttacgcgacaatgctcccacgtgctgggcccctgcacaatgcgaagcctttctggcagcgaccttagcgtattgggacgattggggcgca

SEQ ID NO: 166 - protein, 297 aa, Escherichia coli
MGIPESQLDTWSHQGSIAQSASTYSIIKNALESANTKYHGKNFKVFLQGSYGNDTNIYAESDVDVVICLDDVYYSDLTQLSPEDKDAYDRAFVPATYSYTQFKQDVLEALTERFGSDVKVGDKAIVVAANGSRRKADVIASMQFRRYWKFKGHYDSQYDEGICFFNGAGERIANYPKQHSENLTLKHQASNKWLKPMVRVLKNLRSKLIADGKLKSGLAPSYYLEGLLYNVPNEKFGTSYADCFVNAMNWIQTEADKDKLVCANEQYYLLWEGTHTSWEKADAEAFIDAAIKMWNEW

SEQ ID NO: 167 - DNA, 891 bp, Escherichia coli
atgggaatacctgaatcacagctcgatacatggtcccaccaaggatctattgcacagtctgcctcgacttatagcattataaagaatgcattagagagcgcaaacactaagtatcatggaaagaattttaaagtattccttcagggctcctatggaaacgatactaacatttatgctgaaagtgacgttgatgtagtcatatgtcttgatgatgtctactacagtgacctcacacagttatcaccagaagacaaagatgcgtatgaccgtgcatttgttcctgcaacctactcgtatactcaatttaagcaagatgtgcttgaggctcttacagagcgcttcgggtctgatgttaaggtcggagataaggccatagttgtagcggcaaatggaagtaggcgcaaagctgacgttatcgcatcaatgcagtttcgtcgttattggaaattcaaggggcattacgactcacaatacgatgagggcatctgtttctttaatggcgctggtgaacggattgccaattaccccaagcagcattcagaaaatctcaccttaaaacatcaggccagtaataaatggctaaagcccatggttcgcgtactgaagaaccttcgaagtaaactcattgctgacggaaaattgaagtcaggacttgcaccttcctattaccttgaaggtctactctacaacgtgccaaatgaaaagtttggcaccagttatgctgattgttttgtcaatgccatgaattggattcagacagaagcagataaagacaagctggtatgcgccaatgaacagtattacttgctttgggaggggacacatacctcatgggagaaagccgatgcggaagcgtttatcgacgctgcaataaaaatgtggaatgaatgg

SEQ ID NO: 168 - protein, 295 aa, Legionella pneumophila
MSIDWEQTFRKWSKPSSETESTKAENAERMIKAAINSSQILSTKDISVFPQGSYRNNTNVREDSDVDICVCLNTLVLSDYSLVPGMNDKLAELRTASYTYKQFKSDLETALKNKFGTLGVSRGDKAFDVHANSYRVDADVVPAIQGRLYYDKNHNAFIRGTCIKPDSGGTIYNWPEQNYSNGVNKNKSTGNRFKLIVRAIKRLRNHLAEKGYNTAKPIPSYLMECLVYIVPDQYFTGDSYKTNVENCINYLYNQIDSSDWTEINEIKYLFGSHQMWNKTQVKEFLLTAWSYIQKN

SEQ ID NO: 169 - DNA, 888 bp, Legionella pneumophila
atgagcattgattgggaacaaacttttcgcaaatggtcaaagccatctagcgaaactgagtctacaaaagcggagaatgcggaacgtatgataaaggctgctattaatagtagccaaattttatcaactaaagatattagtgtctttcctcagggttcatacagaaataatacaaatgttagagaagatagtgatgttgatatttgtgtatgccttaataccttagtgctctctgattattcacttgttcctggcatgaatgataagttagctgaattacgtacagcatcttacacgtataaacaattcaaaagcgatcttgaaacagcattaaaaaataaatttggcacgttaggcgttagtcggggagataaggcatttgacgtgcatgcaaattcctatcgggttgatgcagatgttgttcctgccattcaaggacgactatattatgataaaaaccataatgcctttatacgaggcacatgtataaaacctgactccggtggcactatctataattggcctgagcagaattatagtaatggcgtaaacaaaaataagagtacaggaaacagatttaagctcatagtacgtgccataaaaagattaagaaaccacttggcagaaaagggttacaataccgcaaaaccaataccatcataccttatggaatgtttggtgtacattgttccagatcaatatttcacgggtgattcttataaaactaacgttgagaattgcattaactatttatataaccaaatagactcaagcgactggactgaaattaacgaaattaaatacttgtttggttcgcaccaaatgtggaacaaaacccaagtgaaagaatttttactaacagcttggagttatatacagaaaaattaa

SEQ ID NO: 170 - DNA, 885 bp, Artificial Sequence
  Description of Artificial Sequence: Synthetic polynucleotide
atgtctatcgattgggaacaaacctttcgcaaatggtcaaagccaagctcagaaacggaatcgacaaaggctgaaaatgccgagcgcatgattaaagccgcgatcaatagtagccaaattctttccaccaaagacattagcgtgttcccgcaagggtcttatcgtaacaatactaatgtccgcgaggactctgatgtggacatttgtgtgtgtttaaataccttggtgcttagtgattatagtctggtgccgggcatgaatgataaattggctgaattacgcaccgcttcctatacctacaaacaatttaagagtgatcttgagactgccttgaaaaacaaattcgggacacttggagtaagtcgtggcgataaagccttcgacgtacacgccaacagttatcgtgtggacgccgatgtagttcccgcaatccaaggacgtctttattatgacaaaaatcataacgctttcattcgtggcacctgcatcaagccggatagtgggggaacaatttacaattggcctgagcaaaactatagtaatggcgtcaataagaacaagtcaacggggaatcgcttcaaattgattgtgcgtgcaatcaaacgtttacgcaaccatttagcggagaaagggtataacacagccaaaccaattccgtcctatctgatggagtgcttggtatatattgtgccagatcagtattttaccggggatagctataagactaatgtggagaactgcatcaattacctttacaatcaaatcgacagcagtgattggacggaaatcaatgagatcaagtacttatttggttcgcatcaaatgtggaataagacacaggtgaaagaatttctgcttacggcatggagttatattcagaaaaac

SEQ ID NO: 171 - protein, 319 aa, Bacillus thermoamylovorans
MKFSEEKLRLFAAPLSETEDQKCKNAIGMVRDALKDIGFTDDGKTIEKLYADTYSYSLEMRNATKNRKVKLFVKGSYANNTNVRTESDVDIAVVLESTFKVKYRPNINDAKYGFSNSTDNVMTFKDDVEDALRKKFGSDVERKNKSIKIHGNTYRVDADAVPCMRHRDYSNDYNSDPNNFIGGIFIRSDDGQTIINYPEQHIRNGREKNNQTNTYYKKMVRIIKKMRYIMQDENYESANNVSSFGLESLLWNLPNGVFTKYTIYRYAFGEITEYLWNNSHMLPFYKEANGIKPLCESAIDVEKYTRFIKDLYNFYEYDI

SEQ ID NO: 172 - DNA, 876 bp, Bacillus thermoamylovorans
ttgttatttactgaagaacaattaaaattatattctaaaccattgtcagaatctgaaaaagaaaagtgtgaaaatgcaataagaattattcaagaatctctggagtcattaggatatgaaataaaaaagggtatacatagaaacaatgaagatacgctatcatatcaaattaaaatgactaattcatcgaaagattatgaactaagtatatttgtgaaaggttcgtatgcaacaaataccaatgtaagacaaaatagtgacgttgatattgcagtggtaaaagaaagtgagttttttgataaatatagagaaggtaaaactagagaaaattataaatttatttctagtaataagcctccgtattattttaaagatgaagtagaagaagctttgattgaaaaatttggaagaagtgaggtaagaagaggtaataaagcaattagaatcaatggcaatacttaccgtaaagaaacagattgtgtaccttgttttagatatagagattatagtaatgattatatggatgatccaaataatttcattggaggaatcacaatttattcagataaaggtgaacgaattataaattatccggaacagcatataaataatagtgttataaaaaataacaatacaaattataaatataaaaagatggttagaataataaaggaaataagatatcaattaatagatagtaaaaatagaaacgcggaacaaacttcttcatttggagttgaaggtttgttttggaacataccggattacaaatatagcaatgatgaaatgttaggtgatacatttaatgcattaattgcatttttaatagataatatagataaattaagtgaatttaaagaacctaatgacagataa

SEQ ID NO: 173 - DNA, 957 bp, Artificial Sequence
  Description of Artificial Sequence: Synthetic polynucleotide
atgaaatttagcgaagaaaagttacgcttgttcgccgcccctttatccgagaccgaggatcagaagtgcaagaacgccatcgggatggtacgtgatgctttgaaggatatcggatttaccgacgatggaaagactattgagaagttgtacgctgatacttactcatattccttagagatgcgtaatgccacgaaaaatcgcaaggtaaaactgtttgtaaagggcagctatgccaacaatacgaatgtgcgcaccgaaagtgatgttgatattgccgtagttttagaaagtaccttcaaagtgaaataccgcccaaatattaatgatgcgaaatacggtttctcaaatagtacggataatgtgatgaccttcaaagacgatgttgaagacgccctgcgtaaaaagtttggctccgatgttgaacgtaagaacaaatctatcaagattcacggaaacacttatcgtgtggatgccgatgctgttccctgcatgcgtcaccgtgattattcaaatgactataacagtgatccgaacaactttatcggtggtatctttattcgttctgatgacgggcaaactatcatcaactatcctgaacagcacatccgtaatgggcgcgaaaagaacaaccagaccaatacatactataaaaagatggtccgcattattaagaaaatgcgctatattatgcaggacgagaattatgaaagtgcaaataacgtgtcctcgttcggtcttgagagtttgctttggaatttgcccaacggggtgtttaccaaatacacaatctatcgctatgccttcggagaaattacagagtatttgtggaataattcgcacatgttgcccttttacaaggaagctaatggaattaagcctttgtgcgaatcagcgattgacgttgagaagtatactcgtttcattaaagacctgtacaatttctatgaatacgatatc

SEQ ID NO: 174 - protein, 291 aa, Staphylococcus sp.
MLFTEEQLKLYSKPLSESEKEKCENAIRIIQESLESLGYEIKKGIHRNNEDTLSYQIKMTNSSKDYELSIFVKGSYATNTNVRQNSDVDIAVVKESEFFDKYREGKTRENYKFISSNKPPYYFKDEVEEALIEKFGRSEVRRGNKAIRINGNTYRKETDCVPCFRYRDYSNDYMDDPNNFIGGITIYSDKGERIINYPEQHINNSVIKNNNTNYKYKKMVRIIKEIRYQLIDSKNRNAEQTSSFGVEGLFWNIPDYKYSNDEMLGDTFNALIAFLIDNIDKLSEFKEPNDR

SEQ ID NO: 175 - DNA, 876 bp, Staphylococcus aureus; identical to SEQ ID NO: 172

SEQ ID NO: 176 - DNA, 873 bp, Artificial Sequence
  Description of Artificial Sequence: Synthetic polynucleotide
ttgcttttcaccgaagaacagttaaagttatactcaaaaccgctgtcggaatcggaaaaggaaaagtgtgaaaatgcaattcgcatcattcaagaatcccttgaatctctggggtacgaaatcaaaaaaggtattcaccgcaacaatgaagatactctgagttatcaaattaaaatgactaattcctctaaagattacgagttaagcatctttgtgaaggggtcttacgcaacgaatactaacgtgcgtcagaactcagacgtggacatcgccgtagttaaagaaagcgaattcttcgacaaataccgcgaaggcaagacccgcgagaactacaagtttatcagttccaacaaaccgccgtactatttcaaagatgaagtagaggaggctttaatcgaaaaatttggccgttcagaagttcgccgtggtaacaaggcaattcgcatcaacgggaatacttaccgtaaagaaacagattgtgtgccatgctttcgttatcgcgattactcgaacgactatatggacgatcccaataattttattggtggcatcaccatctatagtgataaaggcgaacgcatcattaattatcctgaacaacatattaataacagcgtaatcaagaacaacaacactaactacaaatacaagaagatggttcgtatcatcaaggaaatccgctatcaacttattgacagcaaaaaccgcaatgctgagcagacatcatcgtttggggtcgaaggattattctggaatattccggactataaatatagcaacgatgaaatgttaggtgacacgttcaacgccctgatcgctttcttaattgacaatatcgacaagcttagcgagttcaaggaacccaatgaccgt

SEQ ID NO: 177 - protein, 303 aa, Legionella pneumophila
MYETKTTASDWDKTLITLSKGPSESESQKCENTENAIRKAITSNAKLSQMDISIFAQGSYKARTNVRAESDVDIAVLLNTVAYNDYPVGLTAENFGFTPAKIEFIDFKNLVKQAMEEYFGYFNIDRSGKKSIKVHSNTYRVDADVVPMFCHNHFLSANPDDCLRGVAFSTNEGMIIKNWPQQNYENGIQKNTATKRKYKRLIRILKRLKAYMIQEGIQEANIPSYLIECLVWNVPNVEFFHDSLYQNLRQILFYLWDKTRTNETCSNWGEVNELKYLFSTSQPWTFQQAHNFILATWKYIGYK

SEQ ID NO: 178 - DNA, 912 bp, Legionella pneumophila
atgtacgagacaaaaaccaccgccagtgattgggataaaacccttattactctttcaaaaggaccaagcgaatctgaaagtcaaaaatgtgaaaatacggaaaatgccatccgaaaagcgatcacaagtaacgcaaaactatctcagatggatatctctatttttgctcaaggctcttacaaagccagaacaaatgtaagagcagaaagtgatgttgatattgcagtactcctcaacacggtggcttataatgattacccggttgggcttacagccgaaaactttggattcactcctgctaaaatcgagtttatagattttaaaaatttagtaaaacaagcaatggaagagtattttggatattttaatattgaccgatccggaaagaaatcaatcaaggtccactcaaatacttatagggttgatgccgatgtagtacctatgttttgtcataatcattttctgagtgcaaatccagatgattgtttacgaggtgtggcattttccactaatgaaggtatgatcatcaaaaactggcctcagcaaaattatgagaatggaatacagaaaaacactgcaactaaaagaaaatataagcgtttaatcagaatactgaaacgactaaaagcttatatgatacaagaaggcatacaagaggctaacataccttcatatttgatcgagtgcttagtatggaatgtaccaaatgtagagtttttccatgactcactttatcaaaatctacgacaaatactattttatttatgggataaaacccgaacgaatgaaacatgtagtaattggggtgaagtaaacgagttaaaatatctttttagcactagtcagccttggacttttcaacaggcacacaattttatactcgccacatggaaatatattggatataaataa

SEQ ID NO: 179 - DNA, 909 bp, Artificial Sequence
  Description of Artificial Sequence: Synthetic polynucleotide
atgtacgagactaagacgactgcgtcggactgggacaagacattgatcacactgtcaaaggggccgtccgaatccgaaagccagaaatgtgaaaacactgaaaacgctattcgtaaagcaatcacctctaatgcaaagctgtcacaaatggacatctcgattttcgcgcaaggaagttataaagcacgtacaaatgtgcgtgcagaatccgacgtggacatcgctgtattattaaataccgtagcatataacgactatccggtcggcttaacggcagaaaactttggctttacacccgccaagatcgagttcattgactttaaaaacctggtcaaacaggcaatggaggaatattttggctattttaacattgaccgtagcggaaagaagagtattaaagtgcattcgaatacttatcgtgttgacgccgatgtcgtgccaatgttctgtcataaccacttcttatctgcgaatcctgatgactgcttgcgcggagtggctttcagtaccaatgaaggcatgatcattaagaactggcctcagcaaaattatgagaacggaatccaaaaaaacacagccactaaacgtaaatataaacgtctgatccgtatcttgaagcgtttgaaggcgtacatgattcaagaaggcattcaagaggcgaatattccgtcgtatctgattgagtgccttgtgtggaatgtacctaatgtagaattctttcacgattctttgtatcagaacttgcgccagattttgttttatctttgggataagacgcgcacgaacgaaacatgttcgaattggggagaagtgaatgaattgaagtatttgttctccacatctcaaccgtggacgttccagcaagctcataactttatcctggcaacgtggaagtacattggttacaaa

SEQ ID NO: 180 - protein, 299 aa, Yersinia pseudotuberculosis
MSRDWESVFATWSQGPSATEQERAQNAERQIRQAIQASDKLKNRNIKVFTQGSYRNRVNVRRDSDVDIGVLCFDTYFPEYPDDNVKMELAKNSVPATYEYATFKSELEEALVARFGRDAVTRGSKAFDIKANTYRVESDVAAFFEHRRYVTATYYHSGVEMIPDDYDPPRVKNWPEQHYENGVSKNTYSLRRYKRVVRVLKTLSNEMASKGIQSAKDAPSFLIESLVFNASNSCFEYQSFKPMVRHILAELFNNTMSHEKCSEWGEVNELKYLFRSSQPWTRESAHQFLSDAWDYIGYE

SEQ ID NO: 181 - DNA, 900 bp, Yersinia pseudotuberculosis
gtgagtagggattgggagtcggtatttgcaacttggtcacaaggaccaagcgcaacggagcaagagagagcgcaaaatgccgagaggcaaataaggcaagcaattcaggcgagtgataagttaaaaaatcgaaatatcaaagtatttacgcaaggctcttacagaaacagggttaatgtaaggcgggatagcgatgtagatatcggagttctctgtttcgatacctattttcctgaataccctgatgacaacgtaaaaatggagcttgcaaaaaattccgttcccgccacctatgaatacgcgacattcaaaagtgagttagaagaggcgcttgtagctaggttcggaagagatgctgttacacgtggtagcaaagcctttgatataaaagcgaatacatatcgcgtagagtcagatgtggctgcgttttttgagcatcgtagatatgttaccgccacttattatcattctggagtcgagatgataccagatgattacgaccctcctagagtcaaaaattggcctgagcaacattacgaaaatggcgtttcaaaaaacacttattcattaagaagatataaaagggtcgttcgggtattaaaaacactatctaacgagatggcgtcaaaaggtatccaatcagcaaaagacgcgccgagttttctcattgaaagcttggtgttcaatgcatcaaattcatgttttgaatatcaatctttcaaacccatggtaaggcatatacttgcagagctattcaataatactatgtcacatgaaaaatgctctgagtggggtgaagtaaacgaacttaagtatcttttcagaagctctcagccgtggactcgtgagagtgctcaccagttcttaagtgatgcttgggactacataggttacgaataa

SEQ ID NO: 182 - DNA, 897 bp, Artificial Sequence
  Description of Artificial Sequence: Synthetic polynucleotide
gtgtcacgcgattgggaaagtgtatttgcaacgtggagccagggtccctcagcgacggaacaggaacgcgcgcagaacgctgaacgccagatccgccaagctattcaagcaagcgataaactgaaaaaccgtaatatcaaagtgtttacccaaggctcctatcgcaatcgcgttaatgttcgccgcgacagcgatgtggatattggggtcttatgctttgacacatattttcctgaatacccggacgataacgtcaagatggaattggccaagaactcggtcccggcgacgtatgagtatgccacctttaaatctgagctggaagaggcgcttgtcgctcgctttggacgtgacgcagtcacacgcggttcaaaagcgtttgatatcaaggcaaatacttatcgcgtagagtctgatgtggcagccttcttcgagcaccgccgttatgttacggcaacttattaccatagtggagttgagatgatccctgacgattatgatcccccccgtgtgaagaattggcccgagcagcactacgaaaatggcgtttcgaaaaacacgtattcacttcgccgttataaacgtgtagtacgtgttttgaagactctgagtaacgaaatggcgtcgaaaggcatccaaagcgcgaaagatgcgccatcgttccttattgaatcgctggtttttaatgcgagtaactcatgctttgaatatcaatccttcaagccgatggttcgtcatattttagccgagttgttcaacaacacaatgtcgcatgaaaaatgcagcgaatggggagaggttaacgagctgaagtatctgttccgcagttctcagccgtggacccgcgagagcgcccaccagtttttgtcagacgcgtgggactacatcggatacgag

SEQ ID NO: 183 - protein, 378 aa, Klebsiella pneumoniae
MSNSFSARIERMKSRRKGTFDQLNVARESISNQRIDGLENYALLEGFLDLNESWETRGKQDSATRYVIGAMQPVDNRYTEISFETAKRIENQLVKKLDLNLEFRVQGSVPLDIHIKSFSDVDLLIIDTQMLIYDSDGIGRYTPTNKNDGDVILELRDAARDALKATFPAADVDDNNAKSLRITGGSLQREVDVVPSIWWDTKEYQHTKDVDQRGVTIIDKNTRQRIYNLPFLHIKRIKDKCDQCNGGLRKSIRFLKTLKADSEAEGTKIELSSYDIASLMYHADGNNLRHSQYYELAVLVETHRWLNYLAQNPNAAMLLYVPNGTRKIIDKNETFAELLKLTGMVNSIVTEVLREITGQPTEYYTPAKGILLIKQAVY

SEQ ID NO: 184 - DNA, 1137 bp, Klebsiella pneumoniae
atgtctaattcatttagtgcgcgaattgaacgcatgaagtctcgtcgtaaagggacattcgatcaattaaacgtagccagagagtcaatcagtaaccagaggattgatggactggaaaactatgctttgctagaaggtttcctggatttaaatgaaagttgggaaaccaggggaaaacaagattctgcaacccgctatgttataggtgccatgcaaccggttgataaccgctataccgaaatttcttttgaaactgccaagcgtattgagaaccaactggtaaagaaattagatcttaatctggagtttcgtgtccaaggctctgtaccactggatattcatattaaaagtttcagtgatgtggatctgctgattatagacactcagatgcttatttatgatagcgacggtattggccgctacacccctacgaacaaaaatgatggggatgtcatccttgaactcagggatgccgctagggatgccctgaaagcaactttccctgcggcagatgttgatgacaacaacgccaaatctttgagaataacgggagggtctttgcagagagaagtggatgtggtgccaagcatctggtgggataccaaagagtaccaacatactaaagatgtagatcaacgtggggtcactattatagataaaaacacacgtcaacgtatctacaacctacctttcctccacatcaaacgaattaaagacaaatgcgatcaatgtaatggaggattgcgtaagtctattcgttttcttaagacactaaaagcggatagtgaagctgagggtactaaaattgaactcagtagttatgatattgcctcgctgatgtaccacgcagatggtaacaatctccgacatagccaatactacgagctggctgtccttgtagagactcacagatggctaaattatcttgcacagaaccctaatgctgcaatgctgctctacgttccaaatggcaccagaaagataattgacaagaatgaaacttttgccgaattgcttaaactgacgggaatggtcaatagtattgtcactgaggtgctgcgtgaaataaccggccagcctactgaatattacacacccgccaaaggaattttacttataaaacaagcggtttactaa

SEQ ID NO: 185 - DNA, 1134 bp, Artificial Sequence
  Description of Artificial Sequence: Synthetic polynucleotide
atgagtaacagtttttcggcacgtatcgaacgcatgaaatcacgccgtaaagggactttcgaccagcttaatgtagcacgtgaatctattagtaaccagcgtatcgatgggctggagaactatgccttgttagaagggtttctggatttgaacgaaagttgggaaacgcgtggtaagcaagatagcgcgactcgttatgtgattggggcgatgcagcccgttgacaatcgttacactgaaattagttttgaaaccgccaagcgcatcgaaaatcagttagtgaagaaattagatttgaaccttgagtttcgtgtccaaggctcggttccacttgatatccacattaagtctttcagtgatgttgacttgttgattatcgacactcaaatgttaatctacgactcggacggtattggacgctatactccgacgaacaagaacgacggggacgttattttagaattgcgcgatgcagcacgtgacgcattaaaggcgacctttcctgcagcagatgttgatgataacaatgcaaaatcacttcgcattacagggggttccctgcagcgtgaagtcgacgtagtccctagtatttggtgggataccaaggaatatcagcacaccaaagatgtcgatcaacgcggagtaactatcatcgataaaaacacacgtcagcgcatctacaatctgccattcttacatattaagcgcattaaagacaaatgtgatcagtgcaatggaggactgcgtaagtccattcgcttcctgaaaacgcttaaagcagatagtgaggccgaggggacaaagatcgagttatcaagctacgacatcgcatcgttgatgtaccatgctgatgggaacaacctgcgccactctcagtattacgaactggcggtattagtagagactcatcgctggttaaactatctggcgcaaaacccgaatgcagctatgttgttgtatgtcccaaatggtactcgcaaaattatcgacaagaatgagacattcgcggaattgctgaaacttaccggcatggtaaattcgattgtgaccgaagtcttacgtgaaatcacagggcaaccgaccgaatattacacgcccgccaaaggcatccttctgattaaacaagcagtctac

SEQ ID NO: 186 - protein, 375 aa, Pseudomonas syringae
MNTPINERINRLRSRRSGLDRSSVIAMDAKDFIVNRSLTKEAWEHRVKDKPNTTFALGAMQEVDPTYTRISIETAERVSNQLSKRTSGNLEFELQGSVPLNVHIRGVSDVDLLAIEADFHTYDARGYMSTSGQYRSPTSRTSVGVLTARRGEIGRALRDAFPAATIDTSGSKAIKLQGGSLARPVDVVPSHWHDTITYQASGQKHDRAVTILDSHKSTTIENWPFLHIKKVRERCETTGGGLRKSIRLCKNIKAELEAEGKPVTISSFDIASIMYHANMHSLSAGAYYELAILAETQRYLDYLWNNKEEARRLVVPDGSRFIFNTEDKFNGLLHLSVAMDSLLREAAKEQNYLLSLSDKPLLDASRIAVTNAIIF

SEQ ID NO: 187 - DNA, 1128 bp, Pseudomonas syringae
atgaacacaccaattaacgaacgaatcaatcgtctgcgctccagacgctcgggccttgatagatcctctgtaatcgcgatggatgcgaaggacttcatcgtgaaccgaagccttacaaaagaggcgtgggaacatagggttaaagacaagccgaatacaacatttgctttaggcgctatgcaggaggtagatcctacctacacccgcatcagcatcgaaaccgcagaacgggttagcaaccagttgtctaagaggacaagcggcaatcttgaattcgagctacagggatcagtaccactgaatgtccatattcgaggggtcagtgatgttgatcttttagcaatagaagctgactttcatacctatgatgcgcgtgggtacatgagtacatcgggtcagtaccgctcaccgacctcacgcacctcagttggggtattaaccgctcgcaggggcgaaattggtagagctcttcgtgatgcgtttcccgctgcgacgattgacacttctggctctaaggccatcaaattgcaaggagggtcattagcacgtccagtagacgtcgtgccttcccactggcatgacactatcacttaccaagcctctggccagaaacatgaccgcgctgtcactatcctagattcgcataaaagtaccacgattgaaaactggcctttcctgcacatcaaaaaggtacgagaacgatgtgaaactacgggtggtggactccgcaaatcaataaggttatgtaaaaacataaaggcagagctcgaggcagagggaaaacctgtaacgatctcaagctttgatattgcctcaataatgtaccatgccaacatgcatagcctctccgctggtgcctactacgaattagcgatattggccgagacccaaagatatctggattatttgtggaacaacaaggaagaagcgaggagattagtagtacctgatggctcccgttttatctttaataccgaggacaagttcaatggcttgctgcatctatccgtagcaatggatagtctcctccgagaggcagccaaagagcaaaactaccttctaagcttatccgataaacctttgctggatgccagcaggatagctgtgaccaacgcgatcattttttaa

SEQ ID NO: 188 - DNA, 1125 bp, Artificial Sequence
  Description of Artificial Sequence: Synthetic polynucleotide
atgaatacccctatcaacgagcgtatcaaccgtttgcgttctcgtcgttccggactggatcgctcaagcgtcattgccatggatgcaaaggatttcattgtaaaccgctcccttacaaaggaagcctgggaacatcgtgttaaggacaagccgaacacgacattcgcattgggtgctatgcaggaggttgatcccacctatactcgcatcagtattgagacggctgagcgtgtatcaaatcaattatcaaagcgtacctcgggtaacttggagtttgaattgcaagggtcagtaccgctgaacgtacatattcgcggggtctccgacgtggatttgctggccattgaggcggattttcacacttatgacgcacgcggctatatgtctacatcagggcaatatcgcagcccgacctctcgtacttcagttggggtccttacggcacgccgtggagaaattggacgcgccctgcgtgatgcgttccctgcggctactattgacacttcgggttcaaaggccatcaaattacaaggggggtcgttggcccgccccgttgatgttgtgccctctcattggcatgacacaattacctatcaggcctccggacagaagcatgaccgtgctgttaccatcttagactctcataagtcaacgactatcgagaattggccttttcttcacatcaagaaggtgcgcgagcgctgcgagacaacgggtggaggtttacgtaagtcgatccgcttatgcaaaaatatcaaggcagagctggaggcggaaggaaagcctgtgactatctcgagttttgacatcgcaagcattatgtatcatgcgaacatgcactctttatcggccggggcctactacgagctggcgatccttgcagagacccagcgttacctggattatctttggaataataaggaggaagcgcgccgtcttgtagtaccagatgggtctcgtttcatctttaacacggaggataagttcaacggcctgttacatttatctgttgccatggattcccttttgcgtgaagccgcgaaggagcaaaattacctgctgtcattatctgacaaaccgttacttgatgcgtcgcgtattgcagtcaccaacgctattatcttc

SEQ ID NO: 189 - protein, 271 aa, Listeria monocytogenes
MSILVTNSYVTPLEARQTIARRYRIVTKAINVEFWNSISETAHSFYVGSYGRGTAISTSDIDILVEIPNSEYDKFNSSTGNGQSRLLQSIRKSLQVAYPQSDIRADGQVVKINFHDGIKFEILPAFQNIDYWGKNQGYIYPDSNMGGNWKATNPKNEQEAMKIKNGPTYSNGLLYATCRHFRYVRDTYFSSYHLSGIVIDSFVYNAMGNWRYTESGSSSNASMGAYENILLEYFNNNTIWGLSLNSPGSNQTVSTTNSITCLEKVIKKIAT

SEQ ID NO: 190 - DNA, 816 bp, Listeria monocytogenes
atgagtattttagtaacaaattcgtatgttacaccattagaagcaagacaaaccatagctagaagatatcgtattgtgactaaagcgattaatgtagagttttggaattcaattagtgaaacagctcatagtttttacgtaggatcttacggacgtggaactgcaataagtacaagtgatattgatattttggtagaaattcctaattcagagtatgataaattcaattcgtctactggtaatggccaatcacgattattacagtcaattagaaaatcacttcaagtagcataccctcaaagtgatataagagcagatggacaggtggttaaaattaattttcatgatggaataaaatttgaaattttacctgcttttcagaatatagattattggggtaaaaatcaggggtatatctatcccgactcaaatatgggagggaattggaaagcgactaatccaaaaaatgaacaagaagctatgaagataaagaatggtccaacatatagtaatgggctgctttatgcaacgtgtagacattttcgttatgttcgtgatacttacttcagtagttatcatctttccggcatagtaatagatagttttgtttacaatgcgatgggaaactggagatatactgaatctggaagtagttctaatgcaagtatgggagcttatgagaacatcttattagagtattttaataataatacaatttggggattaagtttgaattcgccaggtagtaatcaaactgtaagcactactaatagtattacatgtctagaaaaagtgataaagaagattgcaacttaa

SEQ ID NO: 191 - DNA, 813 bp, Artificial Sequence
  Description of Artificial Sequence: Synthetic polynucleotide
atgagtatcttggtgacaaattcttacgtcactccgcttgaagcacgtcagacaatcgcgcgtcgttaccgtatcgtaacaaaggctatcaatgtggaattctggaacagcatctccgaaaccgcacacagcttttacgtgggctcgtacggacgtggtacggccatttccacatctgatatcgacatcctggtggaaattccgaatagcgagtatgataagtttaacagctcaacggggaatggacaaagccgccttttgcaatcaattcgtaaaagcttgcaggttgcttatccgcaatccgatattcgcgctgatggacaagtggtgaaaattaacttccacgatggtatcaagtttgagattttgccagcattccagaatatcgactactggggtaagaaccaaggatatatttatccggattcaaacatgggcgggaactggaaggcgacaaatcccaagaacgaacaggaggcgatgaaaatcaaaaatggtccgacttactccaatgggttgctttatgcaacatgccgtcacttccgctacgtgcgtgacacatacttcagttcgtatcacctgagcgggatcgtgatcgacagctttgtttataacgcgatggggaattggcgttatacagagagtgggagtagttctaatgcctcaatgggtgcatacgaaaacatcttacttgagtatttcaataacaatactatttggggcctgtccttaaatagccctgggagtaaccagaccgtttccaccactaactccattacgtgccttgaaaaagttatcaagaagattgcgacc

SEQ ID NO: 192 - protein, 423 aa, Salmonella enterica
MSTATDFKTLLDNIKIDNAGQISKRYGRITKALNQYFYNLDSKTANSLQVGSYGRFTGIRGISDLDMLYFLPATAWPRFRDRQSYLLQVVKTEIKKTFKNTDIRGDGQVVVVKFKNQEVEVVPVFSNEDGTFTYPDTHDGGSWKVCNPRAEMSSFRALNDDRKGHLRRLSKMIRAWKARHEVEISGFLIDTLCYNFFSNLTEYDDKSFKSYDQLSLDFFTFLENEGDRVFYYAPGSRSKVSVKKSFNKVAKLTKEYCEEALSATSENSRNLAWKKVFGRPFPNYTTKALSNVNVSEQFIEDQYEMNLYGHVSIECEIRKNNLLEALLSNLLGEGHDISTNRKLRFYVDEINNISHPYKIKWKIKNVGDEAERRGNVRGEILDDEGGSERFETADFSGPHFVECYVIYGNQVVARDRIDVPIHN

SEQ ID NO: 193 - DNA, 1272 bp, Salmonella enterica
atgagcaccgcaactgactttaagacactcctcgacaatataaaaatagataatgcaggccagattagtaaaaggtatggtcgtataactaaggctttgaaccaatacttttataacttagattctaagacagccaattcactacaggttggttcctatgggcgcttcacagggattcgagggatctctgatcttgatatgctttactttctacctgcaactgcatggccaagattccgagatcgacaatcgtatttattacaggttgtgaaaacagaaatcaagaaaactttcaaaaatacagatattcgcggtgatgggcaagttgttgttgttaaatttaagaatcaagaggttgaggtagttcctgtattcagtaatgaagatggcacttttacatacccggatacacatgatggtggatcgtggaaggtatgtaaccctagggccgaaatgtcgtcttttagggcactgaatgatgataggaagggacatctgagacgtctatctaaaatgattcgagcatggaaagctcgtcatgaagttgagataagtggattcttaattgatacactgtgttataattttttctctaatctaactgaatatgatgataagagtttcaaaagttatgatcaactttcgcttgattttttcactttcttagagaatgaaggtgaccgagtattttattatgctcccggtagtcgctcaaaagtgagcgtaaaaaaatcatttaataaagtagcaaaattaacaaaagaatattgtgaagaagctttatctgctacaagtgaaaactcaagaaacttagcttggaaaaaagtttttggcaggccttttccaaattatacgacaaaagcactcagtaatgtcaatgtatctgaacagtttattgaagatcaatatgagatgaatttatatggtcatgtttcgatagaatgtgagattagaaagaataatttactggaagctcttctttcaaatcttcttggcgaagggcatgatattagcacgaatcgcaagttaagattctatgttgatgagataaataatatatctcacccatataagattaaatggaaaataaaaaatgtaggtgatgaagctgagcgccgaggaaatgttagaggtgaaattttagacgatgaaggcggttctgagcgtttcgagaccgcagatttctcaggacctcattttgttgaatgttatgttatttatggtaatcaagttgtagcaagagatagaatcgacgtacctatacataattag

SEQ ID NO: 194 - DNA, 1269 bp, Artificial Sequence
  Description of Artificial Sequence: Synthetic polynucleotide
atgtccaccgcaactgattttaagacattgctggataatatcaagattgacaacgccgggcagatctctaagcgttacgggcgtattaccaaggccctgaaccaatatttttacaaccttgactcaaagacagctaatagcttgcaggtagggtcgtatggtcgcttcacgggtattcgtggtattagtgacctggacatgctgtattttctgcccgcgactgcctggcctcgtttccgtgaccgccagtcgtatttactgcaagtagtaaaaacagagattaagaaaacattcaagaacactgacattcgcggggacggccaagtggtcgttgttaagtttaaaaaccaagaagttgaggtcgtgcctgtgtttagcaacgaggacggcacattcacatatccggacactcatgatggtggcagttggaaagtctgtaaccctcgcgcagagatgtcatcgttccgcgccttaaatgacgaccgtaagggccaccttcgtcgccttagtaaaatgattcgcgcctggaaggctcgtcacgaggtagagatttcaggatttttgatcgacacgttatgctataatttcttcagtaatttgacagagtatgatgataagtcgtttaagagttacgaccaacttagccttgactttttcaccttccttgagaacgaaggggatcgtgttttctattatgcccccgggagccgttcgaaagtctcggtaaagaaaagcttcaataaggttgctaagttgacaaaggaatattgcgaagaagcccttagtgctacatcagagaactcccgcaatttagcatggaaaaaggtcttcggtcgcccatttccaaactacaccactaaagcattgtctaatgttaacgtaagtgagcagtttatcgaagaccaatatgaaatgaatttgtacgggcatgtgagcattgaatgcgaaattcgcaagaataatttgctggaagcccttttgagcaatctgttgggggaaggacatgatatttccaccaaccgcaaacttcgcttctacgtggacgagattaacaacattagccacccgtacaaaattaagtggaaaattaagaatgttggagatgaagcagaacgccgtggaaatgttcgtggggagatcttggacgatgaagggggaagtgaacgctttgagaccgctgacttcagtgggcctcattttgtggagtgctatgtaatctatggaaaccaggttgtagcgcgtgaccgtattgacgtccctatccataac

SEQ ID NO: 195 - protein, 273 aa, Enterococcus faecium
MGLLVPRANTYTIPLTKRQLIAKRYQRITRAINREFWNSESDTAHSLYVGSYGRGTAISTSDIDIIVELPMAEFDRFKNYLSNGPSKLLQVIKNAFQEILPNSDIRADGQVVKINFHDGIKFEIVPAFNEKDYWGESKGFIYPDSNMGGNWKATNPKKEQEAMKLKNTKSNNLLYATCKHFRHVRDTEFTSYHLSGIVIDSFVYEAMGNWKFVENNSGGQNISSVSYETALLEYYNSHKVMGGLNLYSPGSNQFVNSDSSIICLEKVLKKIAL

SEQ ID NO: 196 - DNA, 822 bp, Enterococcus faecium
atggggttactggttccgagagctaatacttatactatacctttaacgaaacgccaattaattgctaaaagatatcaaaggattactagagccatcaatagagagttttggaattctgaaagtgatactgctcacagtttatacgtaggttcttatgggagaggaacggcaattagtactagtgatatagatataatagttgaattaccgatggcagaatttgacagattcaaaaattatttatcaaatggcccgtctaagttattacaagttataaaaaacgcatttcaggaaatactaccaaatagtgatattagagctgatggacaagttgttaaaataaatttccatgatggaatcaaatttgaaatagttccagcttttaatgaaaaagattattggggtgagtcaaaagggtttatttatccagattcaaacatgggagggaactggaaagctacaaatcccaaaaaagagcaagaagccatgaaattaaagaatacaaaaagtaataatttattatatgctacgtgtaaacattttcgacatgtacgagatacagaatttacgagttatcatctttcaggaatagtaattgacagtttcgtatatgaggctatgggaaattggaaattcgttgaaaataacagtgggggtcaaaacattagttctgtatcttatgagacagctttattagaatactataactcacataaagttatgggcggtttaaatttatactctcctggaagcaatcaatttgttaattctgatagtagtatcatatgtttagaaaaagtattaaaaaaaatagctttataa

SEQ ID NO: 197 - DNA, 819 bp, Artificial Sequence
  Description of Artificial Sequence: Synthetic polynucleotide
atgggattattagtcccgcgtgcaaatacttacacaatcccattaacgaagcgtcaacttattgccaaacgctaccaacgcattacacgcgctattaatcgcgagttctggaattcggagtctgacaccgcccactcactgtacgtgggatcatacggtcgcggtacagccatttcaacctctgatatcgacatcatcgtggagttgccaatggccgagtttgatcgttttaagaactacttatctaacggtccatcgaagttacttcaagttatcaaaaacgcttttcaggagatcttgccgaattctgatattcgcgcggatggccaagtcgtcaagatcaatttccatgatggcattaaattcgagatcgtgcctgcgttcaacgagaaagactactggggtgagagcaagggctttatttatcctgactcgaatatgggcggcaattggaaagcaacgaaccctaagaaggaacaagaggcaatgaaattgaagaataccaagagcaataaccttttgtatgcgacgtgcaagcattttcgccatgtgcgtgatacggagtttacaagctatcatttaagtggaatcgtaattgattcgtttgtctatgaagctatggggaattggaaattcgtggaaaataattcgggcgggcagaatatctctagtgtatcctacgagaccgctctgttggagtattataactcacataaagtcatgggtggactgaatttatactcaccaggatcaaatcaattcgtcaactcggacagcagcatcatttgtctggaaaaagtacttaaaaaaatcgctctt

SEQ ID NO: 198 - protein, 288 aa, Rhodothermus marinus
MPVPESQLERWSHQGATTTAKKTHESIRAALDRYKWPKGKPEVYLQGSYKNSTNIRGDSDVDVVVQLNSVFMNNLTAEQKRRFGFVKSDYTWNDFYSDVERALTDYYGASKVRRGRKTLKVETTYLPADVVVCIQYRKYPPNRKSEDDYIEGMTFYVPSEDRWVVNYPKLHYENGAAKNQQTNEWYKPTIRMFKNARTYLIEQGAPQDLAPSYFLECLLYNVPDSKFGGTFKDTFCSVINWLKRADLSKFRCQNGQDDLFGEFPEQWSEEKARRFLRYMDDLWTGWGQ

SEQ ID NO: 199 - DNA, 867 bp, Rhodothermus marinus
atgccggtacctgaaagtcaacttgagcgatggtcccaccagggagcaaccactacggccaagaaaacacatgaatctatcagggcagcgctagatcgctacaaatggcctaagggcaaaccagaggtgtaccttcagggctcctataagaacagcacaaacattcgtggcgatagcgacgtagatgttgtggttcagctcaattccgtgttcatgaacaatttgactgcagaacaaaagcgtagattcggctttgttaaatcagactacacctggaatgacttctacagcgatgtggaacgagctcttacggactactacggagcttcaaaagttagacgaggaagaaaaacgctaaaggttgaaacaacataccttccggcagatgtagtggtttgcatccagtacagaaaatacccgcccaatcgaaaatccgaagatgattacatagaaggcatgaccttctatgtgccgtctgaagaccgttgggtagtgaactaccccaaactccattacgagaatggcgcagccaaaaatcaacaaaccaacgaatggtataagccaacaattcgtatgttcaagaatgcacggacataccttattgagcagggggcgccgcaagaccttgctccctcttatttccttgagtgtcttctctacaacgttcctgatagcaaatttggcggaaccttcaaagatactttctgcagcgttataaactggttgaaacgagctgacttgagcaagttccgttgtcaaaacggacaggatgatttgtttggagaattcccagaacagtggagtgaagaaaaggccaggcgcttcttgagatatatggacgatctctggacaggttggggacaatag

SEQ ID NO: 200 - DNA, 894 bp, Artificial Sequence
  Description of Artificial Sequence: Synthetic polynucleotide
atgcctgtccctgagtcccaactggaacgttggtctcaccagggagccacgacaaccgcaaaaaaaacgcacgagtccatccgcgcagctttggatcgctacaaatggcccaaggggaagccggaggtgtaccttcaagggtcgtataaaaatagcacaaacattcgcggcgactctgacgtagatgttgtcgtacaattgaactctgtttttatgaataacttgaccgctgagcaaaagcgtcgttttggttttgtcaaatccgattatacctggaatgatttctatagtgacgtcgaacgtgctttgactgattattatggagcatccaaagtgcgccgtgggcgcaagaccttaaaagttgagactacttatttaccagctgatgtcgtcgtgtgcatccagtatcgcaagtatccgccaaatcgcaagtctgaggatgattatattgaaggaatgacgttctatgtgccctcggaggatcgctgggtagttaactatcctaagttgcattacgagaacggagctgccaaaaatcagcagacgaatgagtggtacaagccaacaatccgtatgttcaagaatgcccgcacttatttgatcgagcaaggtgcgccacaagatttggctccctcctatttcttagagtgcttattgtataacgttccagactctaaatttggcggaaccttcaaggacacgttctgttccgttatcaattggcttaaacgtgctgatctttccaaattccgctgtcaaaatggccaggacgacttgttcggtgagtttcctgaacagtggtctgaagaaaaggctcgtcgttttttgcgctacatggacgatttatggacagggtgggggcagggatcccaccatcaccatcaccattgataa

SEQ ID NO: 201 - protein, 292 aa, Elizabethkingia meningoseptica
MNFSEQQLINWSRPVSTTEDLKCQNAITQITAALRAKFGNRVTIFLQGSYRNNTNVRQNSDVDIVMRYDDAFYPDLQRLSESDKAIYNAQRTYSGYNFDELKADTEEALRNVFTTSVERKNKCIQVNGNSNRITADVIPCFVLKRFSTLQSVEAEGIKFYSDDNKEIISFPEQHYSNGTEKTNQTYRLYKRMVRILKVVNYRLIDDGEIADNLVSSFFIECLVYNVPNNQFISGNYTQTLRNVIVKIYEDMKNNADYTEVNRLFWLFSNRSPRTRQDALGFMQKCWNYLGYQ

SEQ ID NO: 202 - DNA, 879 bp, Elizabethkingia meningoseptica
atgaattttagtgagcaacaattaataaattggtcgagaccggttagtacaactgaagatcttaaatgccaaaacgcaattactcaaattaccgcagctttgagagctaaatttggcaatagggttacaatttttcttcaaggttcttatagaaataatactaacgtgaggcaaaatagtgatgtcgacattgttatgagatatgacgatgctttttatccagatttacaaaggttatccgaaagtgataaagcaatatacaatgcacaaagaacatattcaggatataactttgatgaattgaaagcagatacagaggaggcattacgaaatgtttttaccactagtgtggaaagaaaaaacaaatgtattcaggtaaatggaaatagtaaccgtattactgctgatgttatcccctgctttgttctaaaaagatttagtacattacagtctgtcgaagcagagggaataaaattttattcagatgataataaagaaattataagtttccctgaacaacattattcaaatggaacggagaaaacaaaccaaacgtatcgtttatacaagcgtatggtacgtattttaaaagtagtaaattatcgattaattgatgatggtgaaattgctgataatttagtatcttcttttttcattgaatgcttagtgtacaatgttcctaataatcaatttatatcaggaaactatactcagacattaagaaatgtaattgtaaagatatacgaagacatgaaaaacaatgccgattatactgaggttaatagattattttggctttttagcaatagatctcctagaactcgtcaagatgcattgggttttatgcagaaatgttggaattacttaggatatcaataa

SEQ ID NO: 203 - DNA, 876 bp, Artificial Sequence
  Description of Artificial Sequence: Synthetic polynucleotide
atgaatttctcggaacagcagcttattaattggtcacgcccagtctcaaccacggaagacttaaagtgccaaaacgctattacacaaatcacggcggctttacgtgcgaaatttgggaaccgcgtaaccatttttttacaggggagttatcgcaacaataccaatgtgcgtcaaaatagtgatgttgatattgtgatgcgttatgacgatgcgttctatccggatttgcaacgtctttccgaaagtgataaggcaatttataatgcacaacgcacctattcgggctacaatttcgatgagttgaaagcggatacagaagaggcattgcgtaacgtatttacaaccagtgtagaacgtaaaaacaagtgcattcaagtaaatggcaatagtaatcgtatcacagccgatgttattccctgctttgtcctgaagcgcttcagcacgctgcaatccgtcgaagctgaggggatcaagttttacagtgatgacaacaaagagatcattagtttcccggagcagcattactcaaatggaacagaaaagacgaaccagacatatcgtctgtacaagcgcatggtacgtatcctgaaggtggtaaactaccgtttgattgacgacggtgagattgccgataacctggtaagctcgtttttcattgagtgccttgtttataatgtccccaacaaccaattcatctctggtaattatactcaaactcttcgtaatgtcatcgttaaaatctatgaggatatgaagaataacgccgactatactgaggtgaaccgcttattctggttattcagtaaccgttctccacgcacgcgtcaggatgctttgggatttatgcagaaatgttggaattacctggggtatcaa

SEQ ID NO: 204 - protein, 418 aa, Vibrio parahaemolyticus
MQDQGFKSLRQLSASDKEFCFEMISHITSNLDLTETQLSQLKTAYRAIGSYLANQGGELAECHIYAQGSVGIGTSVKPIDEDSDMDIDLVLHLPSQHYPTTTDEANELLFNLIRVLKDSQRYGDKIENMPKRRCVTLQYGGIEGQGFHMDITPSMPEDMDSPNHKSKVRVADIKDANSPSHPYGYRKWFRSACSKEIRWNRKSNYRSNSDIYAGTVEPLPGQGRKTVLQIVVQLLKRHRDMWKQNKQNAYGDCAPISIIITTLAGLAYEKCSNSNKEYHNPFDLMLDVLEEMPNFISHQYQSDGTVKYTIRNPALPTENFADKWHEKPMLPQAFKAWYTQVTEDLAKLLELDQGLDKTIERSREMFGSQAAKGIQAKLADTLTERRAKNRAVVSSIGLGVSNAATATPVPKHNFYGDV

SEQ ID NO: 205 - protein, 418 aa, Vibrio parahaemolyticus
MQDQGFKSLRQLSASDKEFCFEMISHITSNLDLTETQLSQLKTAYRAIGSYLANQGGKLAECHIYAQGSVGIGTSVKPIDEDSDMDIDLVLHLPSQHYPTTTDEANELLFNLIRVLKDSQRYGDKIENMPKRRCVTLQYGGIEGQGFHMDITPSMPEDMDSPNHKSKVRVADIKDANSPSHPYGYRKWFRSACSKEIRWNRKSNYRSNSDIYAGTVEPLPGQGRKTVLQIVVQLLKRHRDMWKQNKQNAYGDCAPISIIITTLAGLAYEKCSNSNKEYHNPFDLMLDVLEEMPNFISHQYQSDGTLKYTIRNPALPTENFADKWHEKPMLPQAFKAWYTQVTEDLAKLLELDQGLDKTIERSREMFGSQAARGIQAKLADTLTERRAKNRAVVSSIGLGVSNAATATPVPKHNFYGDV

SEQ ID NO: 206 - protein, 418 aa, Vibrio vulnificus
MQDQGFKSLRQLSASDKEFCFEMISHITSNLDLTETQLSQLKTAYRAIGSYLANQGGKLAECHIYAQGSVGIGTSVKPIDEDSDMDIDLVLHLPSQHYPTTTDEANELLFNLIRVLKDSQRYGDKIENMPKRRCVTLQYGGIEGQGFHMDITPSMPEDMDSPNHKSKVRVADIKDANSPSHPYGYRKWFRSACSKEIRWNRKSNYRSNNDIHAGTVEPLPGQGRKTVLQIVVQLLKRHRDMWKQNKQNAYGDCAPISIIITTLAGLAYEKCSNSNKEYHNPFDLMLDVLEEMPNFISHQYQSDGTLKYTIRNPALPTENFADKWHEKPMLPQAFKAWYTQVTEDLAKLLELDQGLDKTIERSREMFGSQAARGIQAKLADTLTERRAKNRAVVSSIGLGVSNAATATPVPKHNFYGDV

SEQ ID NO: 207 - protein, 418 aa, Unknown
  Description of Unknown: Vibrio sequence
MQDQGFKSLRQLSASDKEFCFEMISHITSNLDLTETQLSQLKTAYRAIGSYLANQGGELAECHIYAQGSVGIGTSVKPIDEDSDMDIDLVLHLPSQHYPTTTDEANELLFNLIRVLKDSQRYGDKIENMPKRRCVTLQYGGIEGQGFHMDITPSMPEDMDSPNHKSKVRVADIKDANSPSHPYGYRKWFRSACSKEIRWNRKSNYRSNSDIYAGTVEPLPGQGRKTVLQIVVQLLKRHRDMWKQNKQNVYGDCAPISIIITTLAGLAYEKCSNSNKEYHNPFDLMLDVLEEMPNFISHQYQSDGTLKYTIRNPALPTENFADKWHEKPMLPQAFKAWYTQVTEDLAKLLELDQGLDKTIERSREMFGSQAARGIQAKLADTLTERRAKNRAVVSSIGLGVSNAATATPVPKHNFYGDV

SEQ ID NO: 208 - protein, 418 aa, Vibrio parahaemolyticus
MQDQGFKSLRQLSASDKEFCFEMISHITSNLDLTETQLSQLKTAYRAIGSYLANQGGELAECHIYAQGSVGIGTSVKPIDEDSDMDIDLVLHLPSQHYPTTTDEANELLFNLIQVLKDSQRYGDKIENMPKRRCVTLQYGGIEGQGFHMDITPSMPEDMDSPNHKSKVRVADIKDANSPSHPYGYRKWFRSACSKEIRWNRKSNYRSNSDIYAGTVEPLPGQGRKTVLQIVVQLLKRHRDMWKQNKQNVYGDCAPISIIITTLAGLAYEKCSNSNKEYHNPFDLMLDVLEEMPNFISHQYQSDGTLKYTIRNPALPTENFADKWHEKPMLPQAFKAWYTQVTEDLAKLLELDQGLDKTIERSREMFGSQAARGIQAKLADTLTERRAKNRAVVSSIGLGVSNAATATPVPKHNFYGDV

SEQ ID NO: 209 - protein, 418 aa, Vibrio parahaemolyticus
MQDQGFKSLRQLSASDKEFCFEMISHITSNLDLTETQLSQLKTAYRAIGSYLANQGGELAECHIYAQGSVGIGTSVKPIDEDSDMDIDLVLHLPSQHYPTTTDEANELLFNLIRVLKDSQRYGDKIENMPKRRCVTLQYGGIEGQGFHMDITPSMPEDMDSPNHKSKVRVADIKDANSPSHPYGYRKWFRSACSKEIRWNRKSNYRSNSDIYAGTVEPLPGQGRKTVLQIVVQLLKRHRDMWKQNKQNVYGDCAPISIIITTLAGLAYEKCSNSNKEYYNPFDLMLDVLEEMPNFISHQYQSDGTLKYTIRNPALPTENFADKWHEKPMLPQAFKAWYTQVTEDLAKLLELDQGLDKTIERSREMFGSQAARGIQAKLADTLTERRAKNRAVVSSIGLGVSNAATATPVPKHNFYGDV

SEQ ID NO: 210 - protein, 418 aa, Vibrio vulnificus
MQDQGFKSLRQLSASDKEFCFEMISHITSNLDLTETQLSQLKTAYRAIGSYLANQGGKLAECHIYAQGSVGIGTSVKPIDEDSDMDIDLVLHLPSQHYPTTTDEANELLFNLIRVLKDSQRYGDKIENMPKRRCVTLQYGGIEGQGFHMDITPSMPEDMDSPNHKSKVRVADIKDANSPSHPYGYRKWFRSACSKEIRWNRKSNYRSNSDIYAGTVEPLPGQGRKTVLQIVVQLLKRHRDMWKQNKQNVYGDCAPISIIITTLAGLAYEKCSNSNKEYYNPFDLMLDVLEEMPNFISHQYQSDGTLKYTIRNPALPTENFADKWHEKPMLPQAFKAWYTQVTEDLAKLLELDQGLDKTIERSREMFGSQAARGIQAKLADTLTERRAKNRAVVSSIGLGVSNAATATPVPKHNFYGDV

SEQ ID NO: 211 - protein, 418 aa, Vibrio vulnificus
MQDQGFKSLRQLSASDKEFCFGMISHITSNLDLTETQLSQLKTAYRAIGSYLANQGGELAECHIYAQGSVGIGTSVKPIDEDSDMDIDLVLHLPSQHYPTTTDEANELLFNLIRVLKDSQRYGDKIENMPKRRCVTLQYGGIEGQGFHMDITPSMPEDMDSPNHKSKVRVADIKDANSPSHPYGYRKWFRSACSKEIRWNRQSNYRSNSDIYAGTVEPLPGQGRKTVLQIVVQLLKRHRDMWKQNKQNVYGDCAPISIIITTLAGLAYEKCSNSNKEYYNPFDLMLDVLEEMPNFISHQYQSDGTLKYTIRNPALPTENFADKWHEKPMLPQAFKAWYTQVTKDLAKLLELDQGLDKTIERSREMFGSQAARGIQAKLADTLTERRAKNRAVVSSIGLGVSNAATATPVPKHNFYGDV

SEQ ID NO: 212 - protein, 418 aa, Vibrio parahaemolyticus
MQDQGFKSLRQLSASDKEFCFEMISHITSNLDLTETQLSQLKTAYRAIGSYLANQGGKLAECHIYAQGSVGIGTSVKPIDEDSDMDIDLVLHLPSQHYPTTTDEANELLFNLIRVLKDSQRYGDKIENMPKRRCVTLQYGGIEGQGFHMDITPSMPEDMDSPNHKSKVRVADIKDANSPSHPYGYRKWFRSACSKEIRWNRKSNYRSNNDIYAGTVEPLPGQGRKTVLQIVVQLLKRHRDMWKQNKQNVYGDCAPISIIITTLAGLAYEKCSNSNKEYQNPFDLMLDVLEEMPNFISHQYQSNGTVKYTIRNPALPTENFADKWHEKPMLPQAFKAWYTQVTEDLAKLLELDQGLDKTIERSREMFGSQATRGIQAKLADTLTERRAKNRAVVSSIGLGVSNAATATPVPKHNFYGDV

SEQ ID NO: 213 - protein, 420 aa, Vibrio parahaemolyticus
MAAQDQGFKSLRQLSASDKEFCFEMISHITSNLDLTETQLSQLKTAYRAIGSYLANQGGKLVECHIYAQGSVGIGTSVKPIDEDSDMDIDLVLHLPSQHYPTTTDEANELLFNLIRVLKDSQRYGDKIENMPKRRCVTLQYGGIEGQGFHMDITPSMPEDMDSPNHKSKVRVADIKDANSPSHPYGYRKWFRSACSKEIRWNRKSNYRSNNDIYAGTVEPLPGQGRKTVLQIVVQLLKRHRDMWKQNKQNVYGDCAPISIIITTLAGLAYEKCSNSNKEYQNPFDLMLDVLEEMPNFISHQYQSNGTVKYTIRNPALPTENFADKWHEKPMLPQAFKAWYTQVTEDLAKLLELDQGLDKTIERSREMFGSQATRGIQAKLADTLTERRAKNRAVVSSIGLGVSNAATATPVPKHNFYGDV

SEQ ID NO: 214 - protein, 418 aa, Unknown
  Description of Unknown: Vibrio sequence
MQDQGFKSLRQLSASDKEFCFEMISHITSNLDLTETQLSQLKTAYRAIGSYLANQGGKLAECHIYAQGSVGIGTSVKPIDEDSDMDIDLVLHLPSQHYPTTTDEANELLFNLIRVLKDSQRYGDKIENMPKRRCVTLQYGGIEGQGFHMDITPSMPEDMDSPNHKSKVRVADIKDANSPSHPYGYRKWFRSACSKEIRWNRKSNYRSNNDIYAGTVEPLPGQGRKTVLQIVVQLLKRHRDMWKQNKQNVYGDCAPISIIITTLAGLAYEKCSNSNKEYQNPFDLMLDVLEEMPNFISHQYQSNGTVKYTIRNPALPTENFADKWHEKPMLPQAFKAWYTQVTEDLAKLLELDQGLDKTIERSREMFGSQAARGIQAKLADTLTERRAKNRAVVSSIGLGVSNAATATPVPKHNFYGDV

SEQ ID NO: 215 - protein, 418 aa, Vibrio vulnificus
MQDQGFKSLRQLSASDKEFCFEMISHITSNLDLTETQLSQLKTAYRAIGSYLANQGGELAECHIYAQGSVGIGTSVKPIDEDSDMDIDLVLHLPSQHYPTTTDEANELLFNLIRVLKDSQRYGDKIENVPKRRCVTLQYGGIEGQGFHMDITPCMPEDMDSPNHKSKVRVADIKDANSPSHPYGYRKWFRSACSKEIRWNRKSNYRSNSDIYAGTVEPLPGQGRKTVLQIVVQLLKRHRDMWKQNKQNVYGDCAPISIIITTLAGLAYEKCSNSNKEYQNPFDLMLDVLEEMPNFISHQYQSNGTVKYTIRNPALPTENFADKWHEKPMLPQAFKAWYTQVTEDLAKLLELDQGLDKTIERSREMFGSQAARGIQAKLADTLTERRAKNRAVVSSIGLGVSNAATATPVPKHNFYGDV

SEQ ID NO: 216 - protein, 418 aa, Salinivibrio sp.
MQDQGFKSLRQLSASDKEFCFEMISHITSNLDLTETQLSQLKTAYRAIGSYLANQGGKLAECHIYAQGSVGIGTSVKPIDDDSDMDIDLVLHLPSQHYPTTTDEANELLFNLIRVLKDSQRYGDKIENKPKRRCVTLQYGGIEGQGFHMDITPSMPEDMDSPNHKSKVRVADIKDANSPSNPYGYRKWFRSACSKEIRWHRKSNYRSNSNIYAGTVEPLPGQGRKTVLQIVVQLLKRNRDMWKQNKQNAYGGCAPISIIITTLAGLAYEKCSNSNKEYHNPFDLMLDVLEEMPNFISHQYQSDGTLKYTIRNPALPTENFADKWHEKPMLPQAFKAWYTQVTEDLARLLELDQGLDKTIVRSREMFGSQAARGIQAKLADTLTERRAKNRAVVSSIGLGVSNEATATPVPKHNFYGDV

SEQ ID NO: 217 - protein, 419 aa, Vibrio splendidus
MQNQDFKSLRKLNSSDKEFCFEMISKITSNLDLTETQLSQLTTAYRAIGSYLANQGGKFADCHVYAQGSVGIGTSVKPIDEDSDMDIDLVLHLPNEEYPLTTDEANQLLFSVIHVLKHSQRYGNKVEGLPKRRCVTLQYGGIEGQGFHMDITPSMPENADLPNYKNNVRVADIKDANSPSHPYGYRSWFRSACSQDIRWSRKSSYKAQRQIYAGTVEELPGQRRKTVLQIVVQLLKRHRDMWKKDMNNVYAQYAPISIIITTLAGLAYERCSRSKKEYENPFDLMLDVLEAMPSYISQQCQSDGTLTYTILNPALPTENFADKWHEKPMLAQAFRAWYQQATRDLTALLEFGQGLDHTITRTKSMFGNQAAKGLETKLADTLTTRRAMERATVSSVGLGLSNSATAKSVPKHDFYGSNR

SEQ ID NO: 218 - protein, 420 aa, Enterovibrio coralii
MQNFKALRQLSQSDKEFSFEMIAHITSNLDLTETQLGKLKSAYQAIGSYLSNRGGWLKDCYIYAQGSVGIGTSVKPLDAKSDMDIDLVLHLPEQSYPLNQYEANQLLRDLIHELKQSSRYSEKVEPEPKRRCVTMQYGSEEGTSFHMDITPSMPEDQSRPSRQNSVRVADIFTANSPSHPYGYRAWFRSICSKEVRWSRRSAYKSKQELRAGTVEDLPGQTRKTVLQIVVQLLKRHRDIWKSDEGNFYKDFAPISIVLTTLAARAYNDCIASGKEYDNPFDLMLDVIESMPTYIHGKPLSDGTIQYEIVNPSLPTENFADKWREKPILAQSFKAWYEDAKNDIVEILEFNQGLDQTVATATKIFGAQSTKGLAGILADTLTTRRALNQAIIASTGLGLGIPGVALAKPVPKHNFFGELSD

SEQ ID NO: 219 - protein, 437 aa, Burkholderia pseudomallei
MSTPALTISPLDSGRGEGRGATVQTPQRRSTFSHRAATQFFHLADTIARSHEPTSTQLLALESSYISTAEYLAESDEFAGLTTNIHGHGSRALGTLLRPSDESREGFDIDLVARLDQRAMLRYGGDGGPGLLLNHLHAVLSRYASAHGLKIKRWERCVTLEYASGMFADITPVVDDPLSWAPYGDTHGRVPDRQLRTYEPTNPRGLTRSFARAASIVPVFTAVEHLTFAADSVRKSISPLPKADEVFERLLSRLVQLLKLHRNVAFGKATGHEDFAPSSVFITTLAAAAYVDLAPKPHSTPLDLLLDIVEAMPRYFTRERDFGGREVWYLQNPSSPYDNLASSMNMRERQGAFDEWHARICRDLRRLVDMIEANAGLDAVVRIVLAVFGERARAEILKDDRARREAGRKAGRVAIMGGSAAPSSVIAKSKPHTFYGD

SEQ ID NO: 220 - protein, 415 aa, Burkholderia sp.
MHTPQRRSTFSHRAATQFFHLADTIARSHEPTSTQLLALESSYISTAEYLAESDEFVGLTTNIHGHGSRALGTLLRPSDESREGFDIDLVARLDQRAMLRYGGDGGPGLLINHLHAVLSRYASAHSLKIKRWERCVTLEYASGMFADITPVVDDPLSWAPYGDTHGRVPDRQLRTYEPTNPRGLTRSFARAAAISPVFTAVEHLTFAADSVRKSISPLPKADEVFERLLSRLVQLLKLHRNVAFGKAAGHEDFTPSSVFITTLAAAAYVDLAPKPHSTPLDLLLDIVEAMPRYFTRELDFGGREVWYLQNPSSPYDNLASSMNTRERQGAFDEWHALICQDLRKLVDAIEANAGLDAVVRIVLAVFGERAEAEILKDDRTRREAGRKAGRVAIMGSGAAPSSVIAKSKPHTFYGD

SEQ ID NO: 221 - protein, 415 aa, Burkholderia pseudomallei
MQTPQRRPTFSHRAATQFFHLADTIARSHEPTSTQLLALESSYISTAEHLAESDEFAGLTTNIHGHGSRALGTLLRPSDESREGFDIDLVARLDQRAMLRYGGDGGPGLLINHLHAVLSRYASAHGLKIKRWERCVTLEYASGMFADITPVVDDPLSWAPYGDTHGRVPDRQLRTYEPTNPRGLTRSFACAAAIAPVFTAVEHLTFAADSARKSISPLPKADEVFERLLSRLVQLLKLHRNVAFGKATGHEDFAPSSVFITTLAAAAYVDLAPKPHSTPLDLLLDIVEAMPRYFTRERDFGGREVWYLQNPSSPYDNLASSMNTRERQGAFDEWHARICRDLRKLVDAIEANAGLDAVIRIVVAVFGERAGAEILKDDRARREAGRKAGRVAIMGGSAAPSSMTARSKPHTFYGD

SEQ ID NO: 222 - protein, 415 aa, Paraburkholderia bryophila
MQTPQRRSTFSYRAETQFFHLADTIARSHELTSTQLLALESSYISTAEYLAESDEFAGLTTNIHGHGSRALGTLLRPSDESREGFDIDLVARLDQRAMLRYGGDGGPGLLINHLHAVLSRYASAHSLKVKRWERCVTLEYASGMFADITPVVDDPLSWAPYGDTHGRVPDRQLRTYEPTNPRGLTRSFARAAAIAPVFTAVEHRTFAADSVRKSISPLPKADEVFERLLSRLVQLLKLHRNVAFGKASGHEDFAPSSVFITTLAAAAYVDLAPKPHSTPLDLLLDIVEAIPRYFTRERDFGGREVWYLQNPSSPYDNLASSMNTRERQGAFDEWHARICRDLRKLLDAIEANAGLDAVMRIVRAVFGERAEAEILKDDRARREAGRRAGRVAIIGGGAAPSSVIARSKPHTFYGD

SEQ ID NO: 223 - protein, 438 aa, Burkholderia cenocepacia
MSTPALTISSLGGGREEGHGATSQVPQRRPFFSYRAETQFFHLADTIARSHEPTSTQLLALESSYISTAEYLAESDEFAGLTTNIHGHGSRALGTLLRPSDESREGFDIDLVARLDQRAMSRYGGDGGPGLLINHLHAVLSRYASAHNLKVKRWERCVTLEYAGGMFADITPVVDDPLSWAAYGDTHGRVPDRQLRTYEPTNPRGLTRSFAQAAAIAPVFTAVKHLIFAADSVRKSISPLPKADEVFERLLSRLVQLLKLHRNVAFGKATTGHQDFAPSSVFITTLAAAAYVDLAPKPHSTPLDLLLDIVEAMPQYFTRERDFGGGEVWYLQNPSSPYDNLASSMNTRERQGAFDQWHARICRDLRMLVDVIETNAGLDAVVRVVAAVFGERARAEILRDDRARREADRKAGRVAILGGGAAPSSVIARSKPHTFYGD

SEQ ID NO: 224 - protein, 414 aa, Unknown
  Description of Unknown: Burkholderia cepacia complex
MPQRRPFFSYRAETQFFHLADTIARSHEPTSTQLLALESSYISTAEYLAESDEFAGLTTNIHGHGSRALGTLLRPSDESREGFDIDLVARLDQRAMSRYGGDGGPGLLINHLHAVLSRYASAHNLKVKRWERCVTLEYAGGMFADITPVVDDPLSWAAYGDTHGRVPDRQLRTYEPTNPRGLTRSFAQAAAIAPVFTAVKHLIFAADSVRKSISPLPKADEVFERLLSRLVQLLKLHRNVAFGKATTGHQDFAPSSVFITTLAAAAYVDLAPKPHSTPLDLLLDIVEAMPQYFTRERDFGGGEVWYLQNPSSPYDNLASSMNTRERQGAFDQWHARICRDLRMLVDVIETNAGLDAVVRVVAAVFGERARAEILRDDRARREADRKAGRVAILGGGAAPSSVIARSKPHTFYGD

SEQ ID NO: 225 - protein, 414 aa, Burkholderia cenocepacia
MPQRRPFFSYRAETQFFHLADTIARSHEPTSTQLLALESSYISTAEYLAESDEFAGLTTNIHGHGSRALGTLLRPSDESREGFDIDLVARLDQRAMSRYGGDGGPGLLINHLHAVLSRYASAHNLKVKRWERCVTLEYAGGMFADITPVVGDPLSWAAYGDTHGRVPDRQLRTYEPTNPRGLTRSFAQAAAIAPVFTAVKHLIFAADSVRKSISPLPKADEVFERLLSRLVQLLKLHRNVAFGKATTGHQDFAPSSVFITTLAAAAYVDLAPKPHSTPLDLLLDIVEAMPQYFTRERDFGGGEVWYLQNPSSPYDNLASSMNTRERQGAFDQWHARICRDLRMLVDVIETNAGLDAVVRVVAAVFGERARAEILRDDRARREADRKAGRVAILGGGAAPSSVIARSKPHTFYGD

SEQ ID NO: 226 - protein, 404 aa, Achromobacter piechaudii
MRASARFFYLVDVIARANEPTATQLLALERSYNSTGEFLSACPEFQGDLIQIHAHGSRQLGTVVRPRDGSREGFDIDLIARLASGVRHEYDGEHGPALLLDRLHRALSRYADAHGLQLRRWERCATLEYAEGMCADIAPVIDSPLLAAPFGETHGLIPDRELRLFDSTNPRGYAKHFDIAAAISPNFTDVVRFSEAMDSVTRAEVAPLPDAQEVFDRLLCRLVQLLKLHRNVAFGVAQGSQDMAPSSVFLTTLAAMAYAVEAPQPHESPLELLLDIVERMPLHFERVSCSDSSEKWVLPNPSAPRDNLAGGMNSSVRQKAFLAWHRRLIEDLKRILHAIENHQGMDVLLKALESAFGPRCAGAIQQDQTQRRQTSRAAGRVTLISSTVAAPVSVAARPHTYFGH

SEQ ID NO: 227 - protein, 419 aa, Achromobacter piechaudii
MIRELVTLPQRPRISMRASARFFYLVDVIARANEPTATQLLALERSYNSTGEFLSACPEFQGDLIQIHAHGSRQLGTVVRPRDGSREGFDIDLIARLASGVRHEYDGEHGPALLLDRLHRALSRYADAHGLQLRRWERCATLEYAEGMCADIAPVIDSPLLAAPFGETHGLIPDRELRLFDSTNPRGYAKHFDIAAAISPNFTDVVRFSEAMDSVTRAEVAPLPDAQEVFDRLLCRLVQLLKLHRNVAFGVAQGSQDMAPSSVFLTTLAAMAYAVEAPQPHESPLELLLDIVERMPLHFERVSCSDSSEKWVLPNPSAPRDNLAGGMNSSVRQKAFLAWHRRLIEDLKRILHAIENHQGMDVLLKALESAFGPRCAGAIQQDQTQRRQTSRAAGRVTLISSTVAAPVSVAARPHTYFGH

SEQ ID NO: 228 - protein, 394 aa, Variovorax sp.
MDVIARANEPTATQLMALERSYNSTGEFLSACPEFQGDLIQIHAHGSRQLGTIVRPRDGSREGFDIDLIARLASGARHKYDGEHGPVVLLDRLHRVLARYADAHGLRLRRWERCATLEYSEGMCADIAPVIDSPLLAAPFGETHGLIPDRELRLFDSTNPRGYAKHFDLAAAISPNFTGAVRFAEAMDSVTRAEVTPLPDAQEVFDRLLCRLVQLLKLHRNVAFGVALGSQDMAPSSVFLTTLAAMAYAVEAPQPHESPLELLLDIVERMPLHFERISRADGSEEWVLPNPSAPRDNLAGGMNSPARQEAFFSWHHRLIGDLKRILHAIENHEGMDVLIKALEGAFGPRCAGAIQQDQTQRRQNSRVAGRVTLISSAAAAPVSVAARPHTYFGR

SEQ ID NO: 229 - protein, 419 aa, Variovorax sp.
MIREPVTLPQRPHISMRSSARFFHLVDVIARANEPTATQLMALERSYNSTGEFLSACPEFQGDLIQIHAHGSRQLGTIVRPRDGSREGFDIDLIARLASGARHKYDGEHGPVVLLDRLHRVLARYADAHGLRLRRWERCATLEYSEGMCADIAPVIDSPLLAAPFGETHGLIPDRELRLFDSTNPRGYAKHFDLAAAISPNFTGAVRFAEAMDSVTRAEVTPLPDAQEVFDRLLCRLVQLLKLHRNVAFGVALGSQDMAPSSVFLTTLAAMAYAVEAPQPHESPLELLLDIVERMPLHFERISRADGSEEWVLPNPSAPRDNLAGGMNSPARQEAFFSWHHRLIGDLKRILHAIENHEGMDVLIKALEGAFGPRCAGAIQQDQTQRRQNSRVAGRVTLISSAAAAPVSVAARPHTYFGR

SEQ ID NO: 230 - protein, 419 aa, Xylophilus ampelinus
MIREPVTLPQRPRISMRSSARFFHLVDVIARASEPTATQLMALERSYNSTGEFLSACPELQGDLIQIHAHGSRQLGTIVRPRDGSREGFDIDLIARLASGARHKYDGEHGPALLLDRLHRVLSRYADAHGLRLRRWERCATLEYAEGMCADIAPVIDSPLLAAPFGDTHGLIPDRELRLFDSTNPRGYAKHFDLAAAISPNFTGAVRFAEAMDSVTRAEVTPLPDAQEVFDRLLCRLVQLLKLHRNVAFGVARGSQDMAPSSVFLTTLAAMAYAVEAPQPHESPLELLLDIVERMPLHFERISRSDGSEEWVLPNPSAPRDNLAGGMNSPARQEAFFSWHHRLIGDLKRILHAIENHEGMDVLIKALEGAFGPHCAGAIQQDQTQRRQTSRVAGRVTLISSAAAAPVSVAARPHTYFGR

SEQ ID NO: 231 - protein, 404 aa, Burkholderiales bacterium
MRSSARFFHLVDVIARANEPTATQLLALERSYNSTGEFLSACPEFQGDLIQIHAHGSRQLGTIVRPRDGSREGFDIDLIARLAYGARHKYDGEHGPALLLDRLHRALSRYADAHGLRLHRWERCATLEYAEGICADIAPVIDAPLLAAQFGDTHGLIPDRKLRLFDSTNPRGYAKHFDLAAAISPNFSDAVSFAKAMDSVTRAEVTPLPDAQEVLDRLLCRLVQLLKLHRNVAFGVARGSQDMAPSSVFLTTLAAMAYAVEAPQPHDSPLELLLDIVERMPLHFKRILRSDGFEEWVLPNPSAPRDNLAGSMNSPARQEAFFSWHRHLIGDLKRILHAIENHEGMDVLLKALEDAFGPRCAGAIQQDQAQRRQTSRVAGRVTLISSAAAAPVSVAARPHTYFGR

SEQ ID NO: 232 - protein, 419 aa, Variovorax sp.
MIREPVTLPQRSRISVRSSARFFHLVDVIARAHEPTATQLAALERSYNSTGEFLSACPEFQGDLIQIHAHGSRQLGTIVRPRDGSREGFDIDLIARLASGARRKYEGEHGPVLLLDRLHRALSRYADAHGLRLHRWERCATLEYAEGMCADIAPVIDSPLLTAPFGETHGLIPDRELRLFDSTNPRGYAKHFDLAATISPNFTAVMSFSEAMDSVTRAEVTPLPDAQEVFDRLLCRLVQLLKLHRNVAFGIAQGSQDLAPSSVFLTTLAAMAYAVEAPQPHESPLELLLDIVERMPLHFGQLPRPDGSEEWVLPNPSAPGDNLAAGMNSPARQGAFFSWHQRLMGDLKRILHAIENHEGLDVLIKALEGAFGPRCAGVIQQDQTQRRQSNRVAGRVTLISSAAAAPVSVAARPHTYFGR

SEQ ID NO: 233 - protein, 417 aa, Comamonas testosteroni
MICEPVTLPQRPRISMRSSARFFHLVDVIARANEPTATQLAALERSYNSTGEFLSACPEFQGDLIQIHAHGSRQLGTIVRPRDGSREGFDIDLIARLVPEARHKYDGEHGPALLLDRLHRALSRYADAHGLRLLRWERCATLEYAEGMCADIAPVIDSPLLAAPFGETHGLIPDRELRFFDSTNPRGYAKHFDHAAAISPNFTAALTLSMDSAVRADVTPLPDAQEVFDRLLCRLVQLLKLHRNVAFGNAQGNQDVAPSSVFLTTLVAMAYAVEAPQPHESPLELLLDIVEQMPLHFKRIPRPDGFEEWVLPNPSAPRENLAASMNSPARQEAFFFWHRRLIGDLKRILHAIENHEGMDVLIKALEGSFGPRCANAIQQDQAQNRQSSRAAGRVTLISSAAVAPVSVASRPHTYFGR

SEQ ID NO: 234 - protein, 419 aa, Achromobacter xylosoxidans
MIREPVTLPQRPRISIRSSARFFHLVDAIAQAHEPTPTQLSALERSYNSTGEFLSACPEFRGDLIQIHAHGSRQLGTIVRPRDGSREGFDIDLIARLASGARPQYEGERGPTVLLDRLHRALSRYADAHGLRLRRWERCATLEYAEGMCADIAPVIDSPLLAAPFGETHGLIPDRKLRLFDSTNPRGYAEHFDLAAAISPNFTAVATFAAAMDSVKRADVTPLPDAQEVFDRLLCRLVQLLKLHRNVAFGIAQGSPDMAPSSVFLTTLAAMAYAVEAPQPHDSPLELLLDIVERMPLHFERILRSDGSEEWLLPNPSAPKDNLAASMNSPARQEAFFLWHRRLIDDLRRILRTIENNEGMDVLLKVLEGAFGPRSAAAIQQDHTQRRQVNRAAGRVTLISSAAAAPVSVAARPHTYFGR

SEQ ID NO: 235 - protein, 419 aa, Candidatus Accumulibacter phosphatis
MICEPVTLPQRPLISTRSSARFFHLVDAIARANEPTPTQLTALERSYNSTGEFLSGCSEFHGDLIQIHAHGSRQLGTIVRPRDGSREGFDIDLIARLTPEARRKYEGDRGPALLLDRLHGVLSRYAEAHGLQLHRWERCATLEYSDGMFADIAPVIDAPLLAAPFGDTHGLIPDRELRRFDSTNPRGYAKHFDLAAAISPNFTAALSFSEAMDSVTRADVTPLPDAQEVFGRLLCRLVQLLKLHRNEAFGVVQVGQDMAPSSVFLTTLAAMAYAVEAPQPHESPLELLLDIVVRMPLHFERISRPDGTEEWVLPNPSAPKDNLAASMNLPARQEAFFFWHRRLISDLNRILNAIEHHEGMDVLLKALQAAFGSHSAGAIQQAQAERQSASRAAGRVTLISSVAAAPINVPVRSHTYFGR

SEQ ID NO: 236 - protein, 418 aa, Cupriavidus sp.
MIREPVTFQPPRRASTRSAARFFHLVDAIARAHEPTPTQLGALERSYNSTGDFLAECPEFRGLLVQIHSHGSRRLGTIVRPRDGSREGFDIDLIARLAPEARHKYAGDQGPALLLDHLHAALSRYASTHGLRLRRWERCATLEYAEGMCADIAPVIDAPLLSGPFANSHGLIPDRELRLFGSTNPRGYAKHFDLAAAISPNFSTTEIAVEAMDSAKRADVAPLPDVQEVFDRLLCRLVQLLKLHRNVTFGSVTAQDLAPTSVFLTTLAAMAYAVEAPLPHASPLELLLDIVERMPLQFERRRLPDGSEEWRLPNPSAPSDNLAASMNSAARQAAFRSWHRRLLDDLKRILDAIEYRQGMDVLLEAVQIAFGPRGFHAVQQMESGRQERSREAGRTILLASAAATPVSVAARPHTFFGG

SEQ ID NO: 237 - protein, 414 aa, Pandoraea sp.
MIREPVTLVPQRRASTRSSARFFHLVDAIARAHEPTPTQLADLERSYNSTGDFLSECPEFNGLLVQIHSHGSRRLGTIVRPRDGFDIDLIARLAPAARYKYEGGRGAALLLDHLHGALSRYASAHGLQLHRWERCATLEYAGGMCADIAPVIDAPLLSGPYGETHGLIPDRELRAFNSTNPRGYAKHFDLAAAISPNFRTTDFAVEAMDSARRADVAPLPDAQEVFDRLLCRLVQLLKLHRNVAFGSAKDQDLAPASVFLTTLAAIAYAVEAPLPHASPLELLFDIVERMPSHFVRHKLPDGSEEWELPNPSAPTDNLAESMNDAARQAAFFAWHRRLLSDLKRILDVIEDHGGMDVLLKAVQVAFGSRGFTAVQQMETGRQERSRQVGRTILLAAPAAVPISVAARSHTFFGG

SEQ ID NO: 238 - protein, 422 aa, Hydrogenophaga flava
MPALLQPNSHPAVPGRRVSHRSSARFFYLIDAIGRLHEPTSTQLDALESSYRSTAEFLSTCPEFNGLLHEIHAHGSRQLGTLVRPMDETREGFDIDLIARLHGRAMREYGGAAGPARLLNNLFAALERYANAHGLRIQRWERCVTLEYADSMFADIAPIIDEPSIVSIYGDTLGRIPDRKLHIYDKTNPKGYARAFDKAAAISPNFTSSLEFTEAFEAETRANVTPLPVAEEVFNRLLSRLVQMLKLHRNVAFGTAVGTSADLAPSSVFVTTLAAAAYAVQAPLPHHSPLELLLDIVETLPVYFERTLLQNGAEHWVLQNPSAPGENLASSMNTPARQAAFNSWHGLIKEQLADIVESIEAQAGMGVLLAKLETAFGKRAARAIRNEEARQRQSTAGIGKVVLLSSGAPIATTARAHTFFGD

SEQ ID NO: 239 - protein, 431 aa, Acidovorax wautersii
MKRDPAIAIAPPSRSPTFATRFFYLVDVIAKAHEPTASQLEALDSSYESTGNFLCEQPEFAGLLTTVHSHGSRHLGTIVRPRDGGRQGFDVDLIASFETDAFLAYDLPHGPGKLLDQLERCMDRYARAHRLEIKRYSRCITINYEGGMTADIAPVIDSPLQAAPYGDTHGLIPDHEFHQYEPTNPRGYSRYFKEAATISPVYFTEFVIAMESIREAAVEPLPQADEVLGQLLSRLVQLVKLHRNTTFGPPTADADDLAPSSVFLTTLVAEAYKFQAPIPHASPLSLLLDIVVDMPNRFTRAGSDGASRWHLANPAVPHGNLAEDMNSPPKQEAFEKWHRMFEMDLRAIVQSIEQPEGFDQLCKHVEKAFGKRASEAVSEDATKLQESRRSAQTVGIFEPVVTRAAASGAASTSIASSARVIPSRPHTFFGS

SEQ ID NO: 240 - protein, 413 aa, Burkholderia cenocepacia
MTARFRRPSTSDLSRRFFFLVDAIARDHEPTATQLERLASSYEGTADFLANRKEFADLLIKIHPHGSRQLGTMVRPLRTSTDGFDVDLIALLSSEARGHYMTHGGAAALINDFYWALKGYADYHGLSIRRWERCVTLGYADGMSADIAPVIEAPLLSAPFGETHALIPDRAVMTFESTNPLGYAKHFDRAAAVSPVFRERIVVAKAMDAADRAEVVPLADADEVFNRLLCRFVQLLKLHRNSKFSVSEALKKLAPTSVFVTTLAALAYARLAPIQHDSPLDLLADMVKLMPSLFHRTMLPSGLEEWNLPNPSAPKDNLASAMNEEGRQEAFEGWIGVLARDLGKLQEAVEHNLGNDVLISIVEGAFGARSASTLKVELSNTRESNRAAGRVALVTSTAATRTLPARAHNFHGD

SEQ ID NO: 241 - protein, 423 aa, Burkholderia cepacia
MAEPTAIPDPLTARFRRPSTSDLSRRFFFLVDAIARDHEPTATQLERLASSYEGTADFLANRKEFADLLIKIHPHGSRQLGTMVRPLRTSTDGFDVDLIALLSSEARGHYMTHGGAAALINDFYWALKGYADYHGLSIRRWERCVTLGYADGMSADIAPVIEAPLLSAPFGETHALIPDRAVMTFESTNPLGYAKHFDRAAAVSPVFRERIVVAKAMDAADRAEVVPLADADEVFNRLLCRFVQLLKLHRNSKFSVSEALKKLAPTSVFVTTLAALAYARLAPIQHDSPLDLLADMVKLMPSLFHRTMLPSGLEEWNLPNPSAPKDNLASAMNEEGRQEAFEGWIGVLARDLGKLQEAIEHNLGNDVLISIVEGAFGARSASTLKVELSNTRESNRAAGRVALVTSTAATRTLPARAHNFHGD

SEQ ID NO: 242 - protein, 423 aa, Burkholderia cenocepacia
MAEPTAIPDPLTARFRRPSTSDLSRRFFFLVDAIARDHEPTATQLERLASSYEGTADFLANRKEFADLLIKIHPHGSRQLGTMVRPLRTSTDGFDVDLIALLSSEARGHYMTHGGAAALINDFYWALKGYADYHGLSIRRWERCVTLGYADGMSADIAPVIEAPLLSAPFGETHALIPDRAVMTFESTNPLGYAKHFDRAAAVSPVFRERIVVAKAMDAADRAEVVPLADADEVFNRLLCRFVQLLKLHRNSKFSVSEALKKLAPTSVFVTTLAALAYARLAPIQHDSPLDLLADMVKLMPSLFHRTMLPSGLEEWNLPNPSAPKDNLASAMNEEGRQEAFEGWIGVLARDLGKLQEAVEHNLGNDVLISIVEGAFGARSASTLKVELSNTRESNRAAGRVALVTSTAATRTLPARAHNFHGD

SEQ ID NO: 243 - protein, 423 aa, Burkholderia cepacia
MAEPTAIPDPLTARFRRPSTSDLSRRFFFLVDAIARDHEPTATQLERLASSYEGTADFLANRKEFADLLIKIHPHGSRQLGTMVRPLRTSTDGFDVDLIALLSSEARGHYMTHGGAAALINDFYWALKGYADYHGLSIRRWERCVTLGYADGMSADIAPVIEAPLLSAPFGETHALIPDRAVMTFESTNPLGYAKHFDRAAAVSPVFRERIVVAKAMDAADRAEVVPLADADEVFNRLLCRFVQLLKLHRNSKFSVSEALKKLAPTSVFVTTLAALAYARLAPIQHDSPLDLLADMVKLMPSLFHRTMLPSGLEEWNLPNPSAPKDNLASAMNEEGRQEAFEGWIGVLARDLGKLQEAVEHNLGNDVLISIVEGAFGARSASTLKVELSNTRESNRAAGRVALATSTAATRTLPARAHNFHGD

SEQ ID NO: 244 - protein, 416 aa, Burkholderia catarinensis
MQRDLLVNTHRRSISRSSSDNFFFLVDVIAKEQVPTAMQLQKIESSYNSTAEFLSQRDEFADLITQIHPHGSRQLGTMVRPRDDSRDGFDIDLIARLNEKARARYSDERGPARLLNQFHAAFQDYANAHGLELKKWDRCVTLCYADGMCADIAPVIDAPLLQAPFGSTHALIPDKSVARFESTNPRGYAKFFGEIAAIAPYMLSLESAAMDSMRKSVEIVPLEDPDEVFDPWLCRIVQVLKLHRNVSFGTKTDDVDFAPTSIFITTLAAHAYAEKARTYHETPLELLLDVVETMPTKFVSKRVGQREEWQLPNPAAPASNLAEDMNEVGRQTAFRNWIAKLVGDIETIIAAIDSRSGMDVVIESVRKAFGRRPATAVQKALLARQQTERGAGRATFYTATATAKSVASRPHNFFGD

SEQ ID NO: 245 - protein, 416 aa, Burkholderia pseudomallei
MQRDLLVNKHRRSISRSSSDNFFFLVDAIAKEQVPTATQLQKIESSYNSTAEFLSRRDEFADLITQIYPHGSRQLGTMVRPRDDSRDGFDIDLIARLNEKARVRYSDERGPARLLNQFHAAFQDYANAHGLELKKWDRCVTLCYADGMCADIAPVIDAPLLQAPFGSTHALIPDKSIARFESTNPRGYAKFFSEIAAIAPHMLSLESAAMDSTRKSVEIVPLEDPDEVFDPWLCRIVQVLKLHRNVSFGTKTGDVDFAPTSIFITTLTAHAYAEKARTYHETPLELLLDVVETMPTKFVSRRVGQREEWQLPNPAAPASNLAEDMNEVGRQTAFRNWIVKLVGDIETIIAAIDSRSGMDAVIESVQKAFGRRPASAVQKALLTRQETERGAGRATFYTATATAKSVASRPHNFFGD

SEQ ID NO: 246 - protein, 411 aa, Paraburkholderia terrae
MSTPRRRPASRTSSDDFFFLLEAIARQQTPTGTQLEQIESSYNSTAEFLAKRPEFAGLITQIHPHGSRQLGTMVRPWDDSRDGFDIDLIARLDSQALARYGDERGPTRLLNHFHVAFQDYANAHGLTLKKWDRCVTLCYSGGMCADIAPVIDDPLFAQAYGSTHGLIPDRAASRFESTNPRGYAKFFSETAAIAALMPAMESATFDSVRRSAEIVPLNDPDEVFEPLLCRIVQVLKLHRNVSFLAKNNAKDLVPSSIFITTLAAHAYAAKAPLIHMTPLDLLLDVVETMPTMFASTTLGRDEEWHLPNPAAPRSNLAEDMNEPSRQIAFRAWIELLVEDVEKILAAIDARQGIASVITQVRDVFGQRPAQAVEKALLERQKAELNLGRATFLTAAATPLTVPSRSHNFFGK

SEQ ID NO: 247 - protein, 418 aa, Burkholderia sp.
MLRDQVSIRRRHNLSSDASTRFFALVDAMAEHQTPTTTQLDALTSSYESTAEFLSAREEFAETLIQIHPHGSRQLGTLTKPIDDSRNGFDVDLIARFSEAAWSRYSDYEGPARLLNQIQTALADYARAHQLELQRHDRCVTLHYAGGMCADIAPVIDSPRVSIRYGETHGLIPDRGLKSFESTNPRGYTRFFNEAAAISPRFPLMEKITAAMDSVRKADIVPLPNARDVFDRLLCRFVQVIKLHRNFRFGPQSGTVDLRPSSVFITTLAAQAYAIQAPQAHASPLDLLLDVVETMPRLFARIPVGASLEEWRLPNPAAPQSNLAAEMNLPLRQIAFDRWIEQLMQDIEAVIDAIEARAGMNEVVSAVENGFGARSGRTVRDALFAEQQATREAGKARLFTGAPAPLVIPSRQHRFFGR

SEQ ID NO: 248 - protein, 415 aa, Polaromonas sp.
MHRDTLPLPLKRQLSRVSSPKFFYLADAIAKYNEPTQTQLDAMERSYGATGSYVMESEEFRDLTMTVHAQGSRVIGTIIRPTKWRPEGFDIDVVIRLRHVANLLYGDNPAKLINDLYAVLKRYAEIHGLGITRWERCITLEYADGMRADITPIIEDPLFSILHGETHAKVPDRELHLFEPSNPMGLANAFNDAARISPLFTTTKLASFSEAVVRGDMLPLPDADEVLNRLLSRLVQLLKLHRNVAFGAPTDGSDFAPKSIFLTSLAAAAYALRAPIEHESPLDLLLDIVETMPLCFERHQLASGGEFWHLPNLTAPGDNLASGMNTSERQAAFTNWHSLLTNHLQQMLECIEQREGLDTLLKVIEEAFGPRAAQAVRELEEPRPIAKPDRRIVTVGTVAATTMALPARGHTFFGD

SEQ ID NO: 249 - protein, 427 aa, Variovorax sp.
MHRDPLPQPIKRSLSAAASPHFFFLADAIAVANEPTPSQLEALERSYMATGQFVMDSPEFKGLVLQVHAQGSRAIGTLVRPRRERPEGFDVDIVIRLQRDALVRFGNSPVRLINELHKVIERYANAHGLALTRWERCVTLEYADGMCVDLTPIVEDERFSIPHGGTHARVPDRELQLFDPTNPMGLVRTFDDAARVRANFTRQLIVKSSAMDSAAELVQLPNADQVQSRLLSRLVQLLKLHRNVKFGSALNLDLSPRSVFVTSLAASAYVMRAPIAHESPLDLLLDIVATMPLLFRRCSLPSGGEHWDLPNPTAPGDNLASGMNAPGRQAAFLQWHASLVSDLERVIACIERRAGQDVLQTLVEQSFGKRAAQALQAATAPKAAPPNLPVTSLTSNIGTGRIVSVGTAIPSVTVAAPTRAHRFFGDQ

SEQ ID NO: 250 - protein, 416 aa, Delftia sp.
MNRDPLPVPTKRQFSRPTGHKFFGLVDAVAKYNEPTQSQLDALERSYNSTAEYVMNSEEFRDLTATVHAQGSRALGTIIRPMRFRPEGFDIDIVVRLHRAAMRIYGNDPVALINDLHTVIKRYAAMHGLEVTRWERCITLQYADGMCVDITPIIEDERIGIPYGETHARVPDRSLKLFEPTNPKGLANAFADAARVQALFRVTEALSFDEAQIRADLQPLPDMADVQSRLLSRLVQLLKLHRNVAFGGVSAGPDFSPRSVFITDLAATAYATRAPIAHDSPLDLLLDIVDTMPMFIQRHPLGGGGEHWVLPNMTAPGDNLASGMNTPERQKAYFEWHARLKSDLELLLQCIEQRQGLDQLLKIVQSTFGSRAAKAVQELEAPRQVQPIGRRIVTVGTAAAATAISMPARSHSFYGD

SEQ ID NO: 251 - protein, 415 aa, Variovorax soli
MNRDPLPQPLKRQLSTNTGFKFFGLVDAVAKHNEPTTTQMDALERSYNATSEYIMGSSEFADLILQVHPQGSRALGTIIRPMRQRPEGFDIDSVLRLKRAAMQKYGQDPAALINDLHAVVKRYAEAHGLALKRWERCVTLEYADGMCVDITPIIDDPRVGIRYGDTHARVPDRRLKLFEPTNPKGLSDAFSMAARVQAVFSVSKAMTLDEAIVRGELQPLPDAVEVQSRLLSRLVQLLKLHRNVAFGTAAMGPDFSPKSVFITVLAATAYASRAPIAHDSPLDLLLDIVDMMPLFIRREPLVGGGEYWELPNQTAPGDNLASGMNTPQHQQAYLQWHLRLKADLQDVLECIEQRRGLDELLQIVQRCFGGRAAQAVRELEAPRAGSPSGRRLVTVGTAGTGALLLPSRGHTFYGD

SEQ ID NO: 252 - protein, 422 aa, Polaromonas sp.
MQRDSIHLSVPRRSHSERASGQFFHLSSVVASVFVPTHKQLETLDGSYLSIGSYLTESEEFRELTIEVHGHGSRQIGTLVRPLHVREIGFDVDAVLLLKRAAMLRYGGAEGARRLINDLHRVLKRYADHHRLGIEKWDRCVTLVYVDGVRVDVAPVIEDPLVSIPSGETHALIPDRLLERYAPTNPRGLEQGFNTAAKIQAIFTRVLKEAQVLDYATRADVAPLPDPDVVSKRLLSIFVQLMKVHRNICFGAPKNDSEDLSPASIFITTLAAISYTLKAPQPHETPLDLLLDVFETMPMCFQRERRPHGDEIWALPNPWAPGDDLAACMNTPQKQAAFFQWHTRFCRDIGELLESIEQRSGSGVTEALVEKAFGPRAASAVREDSAPKAPTSHAGRSVVFGTAAGAMASLPARANTNFGSPD

SEQ ID NO: 253 - protein, 418 aa, Variovorax sp.
MQRDLPQLPTRRRFSDAASAKFFYLAEKIARVYEPTTTQLEELDRAYGSTGDYLATCPEFDGLLYRVHAHGSRQLGTMVRPIDACRTGYDIDLAACLEAAGMRRYSGSTGPALLIEHLYVALKRYADRHGLEIKRHERCVTLTYAGGMTADFAPIIDDPSQVVMHGDTHASIPDRDLQRYISTNPRGYCKAFDLIAQISPAFERSTAMHMTFDSMRKSELVPLPDADEVFGRLLSRLVQLTKINRNIRFGAPSGTLDLAPPSSFLTTLVANAYAIEAPKPHDGPMDLLLDMVSLMPKLFQRLQLPEGREFWYLSNPTALNDNLAGCMDTSSKQKAFDAWHERLQTDLTALVDAIDQSAGLDVIAKAAERAFGDRAKNAVLEDNAARREEKRTSGQAVFIAGGSAAISTPSRAHTNFGD

SEQ ID NO: 254 - protein, 418 aa, Variovorax sp.
MQRDLPQLPTRRRFSGAASAKFFYLAEKIARVYEPTTTQLEELDRAYGSTGDYLSTCTEFDGLLYRVHAHGSRQLGTMVRPIDACRTGYDIDLAACLEAAGMRRYGGPTGPALLIEHLYVALKRYADRHGLEIKRHERCVTLTYAGGMTADFAPIIDDPSQVVVHGDTHASIPDRDLQRYISTNPRGYCKAFDLIAQISPAFERSTAMHMTFDSMRKSELVPLPDADEVFGRLLSRLVQLTKINRNIRFGAPSGTLDLAPPSSFLTTLVANAYAIEAPKPHDGPMDLLLDMVSLMPKLFQRLQLPEGREFWYLSNPTALNDNLAGCMDTNSKQKAFDAWHERLQTDLTALVDAIDQSAGLDVIAKAAERAFGDRAKNAVLEDNAARREEKRMSGQAVFIAGGSAAISTPSRAHTNFGD

SEQ ID NO: 255 - protein, 418 aa, Variovorax paradoxus
MQRDLPQLPTRRRFSDAASAKFFYLAEKIARVYEPTTTQLEELDRAYGSTGDYLSTCPEFDGLLYRVHAHGSRQLGTMVRPIDACRTGYDIDLAACLEAAGMRRYGGPTGPALLIEHLYVALKRYADRHGLEIKRHERCVTLTYAGGMTADFAPIIDDPSQVVMHGDTHASIPDRDLQRYISTNPRGYCKAFDLIAQISPAFERSTAMHMTFDSMRKSELVPLPDAEEVFGRLLSRLVQLTKINRNIRFGAPSGTLDLAPPSSFLTTLVANAYAIEAPKPHDGPMDLLLDMVSLIPKLFQRLQLPEGREFWYLSNPTALNDNLAGCMDTTTKQKAFDAWHERLQTDLTVLVDAIDQNAGLDVIAKAAERAFGDRAKNAVLEDNAARREEKRASGQAVFIAGGSTAISTPSRAHTNFGD

SEQ ID NO: 256 - protein, 408 aa, Herbaspirillum sp.
MPLQRTFSNRSSDYFVRMIEDIGRALEPTETQLALLERSYKSTGEFLVNCAEFDGLLVEIHPQGSRELGTITRPVNPDRTGFDIDLVARFDTTAYTKYGYPDGPTRLLRDLFAALQKYADRHGLTLKRWDRCATLEYSDGMCADIAPIIDMPSLIAVHGDLHGWIPDRQLKRYQPTNPRGYNREFNRIATISPIFTGSARLVVAMDSISEKRAEIKPLSNPDDVFGRLLCRFIQVLKLHRDVAFNGSDIAPSSVFLTTLTAAAYEQLAPQPHTNPLDLLSHIVGDMPHHFSASRDWGGEEWTIDNPTAPGDNLASSMNTSERQQAFTQWHSMLEDDLNELFDSIESQAGIDQVARKIESAFGAKASKSVQTAQLERQATARSAGKAPLFTAAGILVPSTARAHTFFGD

SEQ ID NO: 257 - protein, 413 aa, Janthinobacterium lividum
MAANPSYLSKSYSANTDSFFVRLVEDIGRSLEPSDSQLATLERSYRSTSEFLVDCPELKGHLEEVHPQGSRQLGTLTRPLRRRDGFDIDLVARMNRSAWAVYSGSAGANTLMNKLHTALTRYADQHSLRLHRWARCATLEYADGMCADIAPIIEYPHLAALHGEHHGMIPDRELRSFHPTNPKGFSRMFSDIAAIEPNFRRIVMDSLSAEGFRKADITPLPGTEAFGRLLCRLIQMMKLHRDALFGEESVQHLRPSSILITSLAASSYKLLAQIPHLDQLDLLLDIIRTMPTLITTRHAGYDQVEWVVDNPTAPGDNLASCMDSPQKRQAFSQWHNKLLEDVLAVVDTVEARAGLDQVASQVSSAFGEKAGAALRQAQLGRQSQQRGAGKIASITGGGIAVPMTAHGHTFFGK

SEQ ID NO: 258 - protein, 417 aa, Xenorhabdus bovienii
MNNQHTKRNSWEYFLLRAARAISLTEPQYSKIDDRYSQLQRILSALDTPPLLEGAHIFPQGSMRLRTTINPVPDAPADLGTIDADAIVWLPNAAGVEAETILAAIEKRFQEGSRVQQSIQQLRRGIRIVYADQNPGFHIDVTPARAIGSNNQTEGQGKLEVPDREHGWKASSPIPYSDWLQEASKQQFRIIEEAFSLNKSIRAADSATQAPLPEYVEYQNDDPLRAAIKLLKRHRDEWAIRTKNEEVRPISAVITTLATHAWLNVVKQSQQCPLTPLEAITEIVRQLPDAIRRDQRGFLVCNPKDNGENFAEKWNRPGEGISYYRAFLKWHESAWDAVNLGLQDYDSTDAFADAIKANFGIGRTFIDEVNSNIPSGWTMPGRPEGVTRNTASMGALFGTATGGSDSQASVKPVGRLG

SEQ ID NO: 259 - protein, 419 aa, Xenorhabdus bovienii
MLMNNQHTKRNSWEYFLLRAARAISLTEPQYSKIDDRYSQLQRILSALDTPPLLEGAHIFPQGSMRLRTTINPVPDAPADLGTIDADAIVWLPNAAGVEAETILAAIEKRFQEGSRVQQSIQQLRRGIRIVYADQNPGFHIDVTPARAIGSNNQTEGQGKLEVPDREHGWKASSPIPYSDWLQEASKQQFRIIEEAFSLNKSIRAADSATQAPLPEYVEYQNDDPLRAAIKLLKRHRDEWAIRTKNEEVRPISAVITTLATHAWLNVVKQSQQCPLTPLEAITEIVRQLPDAIRRDQRGFLVCNPKDNGENFAEKWNRPGEGISYYRAFLKWHESAWDAVNLGLQDYDSTDAFADAIKANFGIGRTFIDEVNSNIPSGWTMPGRPEGVTRNTASMGALFGTATGGSDSQASVKPVGRLG

SEQ ID NO: 260 - protein, 415 aa, Xenorhabdus bovienii
MNNEQTKRSSWEYFLLRAARKISLSEPQYEKINGRYDQLQSILSASDDPLLAEAHIFPQGSMRLKTTINPVPDAPADLGTIDADAIVWLPHAKGVDAGRVLNAIEKRFKEGSRVQGDIQQLRRGVRIVYADQNPGFHIDVTPARACFWNEQDNGLGMLEVPDRELGWKASSPIPYSDWLHHASSLEVMLESYVALNKSFATADSATQEPLPEYGDYQKEDPLRASIKLLKRHRDEWAIRTKNEKNRPISAVITTLATHAYLDVVKQSQQRPFTPLEAIIEIVRIMPQFIRLNGHEYMICNPRDSGENFAEKWNRPGEGPFYRRAFYDWHENASQAVNLGLQNYSSTDSFALAVKENFGIGRAFVDEINSQVPASWTMPGRAAGVTRNAASMGALFGSATGSSRSQVNVKPVGRLG

SEQ ID NO: 261 - protein, 417 aa, Xenorhabdus bovienii
MVMNNEQTKRSSWEYFLLRAARKISLSEPQYEKINGRYDQLQSILSASDDPLLAEAHIFPQGSMRLKTTINPVPDAPADLGTIDADAIVWLPHAKGVDAGRVLNAIEKRFKEGSRVQGDIQQLRRGVRIVYADQNPGFHIDVTPARACFWNEQDNGLGMLEVPDRELGWKASSPIPYSDWLHHASSLEVMLESYVALNKSFATADSATQEPLPEYGDYQKEDPLRASIKLLKRHRDEWAIRTKNEKNRPISAVITTLATHAYLDVVKQSQQRPFTPLEAIIEIVRIMPQFIRLNGHEYMICNPRDSGENFAEKWNRPGEGPFYRRAFYDWHENASQAVNLGLQNYSSTDSFALAVKENFGIGRAFVDEINSQVPASWTMPGRAAGVTRNAASMGALFGSATGSSRSQVNVKPVGRLG

SEQ ID NO: 262 - protein, 404 aa, Photorhabdus temperata
MNNEQTKRSSWEYFLLRAARKISLSEPQYEKINDRYDQLQSILSASDDPLLAEAHIFPQGSMRLKTTINPVPDAPADLGTIDADAIVWLPHAKGVDAGRVLNAIEKRFKEGSRVQGDIQQLRRGVRIVYADQNPGFHIDVTPARACFWNEQDNGLGMLEVPDRELGWKASSPIPYSGWLHHASSLEVMLESYVALNKSFATADSATQDPLPEYEDYQKEDPLRASIKLLKRHRDEWAIRTKNEKNHPISAVITTLATHAYLDVVKQSQQRPFTPLGAIIEIVRIMPTFIRSNGHEYLVCNPQDSGENFAEKWNRPGEGQSYRRAFYDWHENACQAVNLGLQNYSSTDSFALAVKESFGIGRAFVDEINSQVPASWTMPGRAAGVTRNANGIRLRKQRCDKIRFK

SEQ ID NO: 263 - protein, 415 aa, Klebsiella pneumoniae
MNNEQTKHSSWEFFLLRAARAISLTGPQYEKINGRYAQLQTILSASDDPILQDAHIFPQGSMRLKTTIKPVSDAPADLGTIDADAIVWLPNARGVSADTVLEAIEKRFQEGSRVHEDIQPLRRGVRVVYADQSPGFHIDVTPARPRSWNDETHGHGMLEVPDRATGWKASSPIPYADWLHDASESQIMLENYVALNKSRAVADSATIAPLPEYEEYQTEDPLRASIKLLKRHRDEWAIRTNNEKSRPISAVITTLAAHAWLNVAMQSRQRPFTPLEAILEIVRTMPNFIRSNGQEYMVCNPEDSGENFAEKWNRPGEGAAYQRAFYEWHESACEAFSLGLESYSSVESFAEAVNESFGIGRSFVDEVNTSIPANWTMPGRPSGMNRNSVSMGALFGSVVGSDQSQADTKPVGRLG

SEQ ID NO: 264 - protein, 415 aa, Raoultella planticola
MNNEQTKHSSWEFFLLRAARAISLTGPQYEKINGRYAQLQTILSASDDPILQDAHIFPQGSMRLKTTIKPVSDAPADLGTIDADAIVWLPNARGVSADTVLEAIEKRFQEGSRVHEDIQPLRRGVRVVYADQSPGFHIDVTPARPRSWNDETHGHGMLEVPDRETGWKASSPIPYADWLHDASESQIMLENYVALNKSRAVADSATIAPLPEYEEYQTEDPLRASIKLLKRHRDEWAIRTNNEKSRPISAVITTLAAHAWLNVAMQSRQRPFTPLEAILEIVRTMPNFIRSNGQEYMVCNPEDSGENFAEKWNRPGEGAAYQRAFYEWHESACEAFSLGLESYSSVESFAEAVNESFGIGRSFVDEVNTSIPANWTMPGRPSGMNRNSVSMGALFGSVVGSDQSQADTKPVGRLG

SEQ ID NO: 265 - protein, 415 aa, Unknown
  Description of Unknown: Enterobacter cloacae complex
MNNEQTKHSSWEFFLLRAARAISLTGPQYEKINGRYAQLQTILSASDDPILQDAHIFPQGSMRLKTTINPVSDAPADLGTIDADAIVWLPNSRGVSADTVLETIEKRFQEGSRVHEDIKPLRRGVRVVYADQNPGFHIDVTPARPRSWNDETHGHGMLEVPDRETGWKASSPIPYADWLHDASESQIMLENYVALNKSRAAADSATIAPLPEYEEYQTEDPLRASIKLLKRHRDEWAIRTKNERSRPISAVITTLAAHAWLNVAMQSRQRPFTPLEAILEIVRTMPNFIRSNGQEYMVCNPEDSGENFAEKWNRPGEGSAYQRAFYEWHESACEAFSLGLESYSSVESFAKAVNESFGIGRSFVDEVNTSIPANWTMPGRPSGMNRNSVSMGALFGGVAGSDQSQADTKPVGRLG

SEQ ID NO: 266 - protein, 415 aa, Unknown
  Description of Unknown: Enterobacterales sequence
MNNEQTKHSSWEFFLLRAARAISLTGPQYEKINGRYAQLQTILSASDDPILQDAHIFPQGSMRLKTTINPVSDAPADLGTIDADAIVWLPNSRGVSADTVLETIEKRFQEGSRVHEDIKPLRRGVRVVYADQNPGFHIDVTPARPRSWNDETHGHGMLEVPDRETGWKASSPIPYADWLHDASESQIMLENYVALNKSRAVADSATIAPLPEYEEYQTEDPLRASIKLLKRHRDEWAIRTKNERSRPISAVITTLAAHAWLNVAMQSRQRPFTPLEAILEIVRTMPNFIRSNGQEYMVCNPEDSGENFAEKWNRPGEGSAYQRAFYEWHESACKAFSLGLESYSSVESFAKAVNESFGIGRSFVDEVNTSIPANWTMPGRPSGMNRNSVSMGALFGGVAGSDQSQADTKPVGRLG

SEQ ID NO: 267 - protein, 415 aa, Hafnia paralvei
MNNEQTKHSSWEFFLLRAARAISLTGPQYEKINGRYAQLQTILSASDDPILQDAHIFPQGSMRLKTTINPVSDAPADLGTIDADAIVWLPNSRGVSADTVLETIEKRFQEGSRVHEDIKPLRRGVRVVYADQNPGFHIDVTPARPRSWNDETHGHGMLEVPDREAGWKASSPIPYADWLHDASESQIMLENYVALNKSRAVADSATIAPLPEYEEYQTEDPLRASIKLLKRHRDEWAIRTKNERSRPISAVITTLAAHAWLNVAMQSRQRPFTPLEAILEIVRTMPNFIRSNGQEYMVCNPEDSGENFAEKWNRPGEGSAYQRAFYEWHESACKAFSLGLESYSSVESFAKAVNESFGIGRSFVDEVNTSIPANWTMPGRPSGMNRNSVSMGALFGGVAGSDQSQADTKPVGRLG

SEQ ID NO: 268 - protein, 415 aa, Unknown
  Description of Unknown: Klebsiella sequence
MNNEQTKHSSWEFFLLRAARAISLTGPQYEKINGRYAQLQTILSASDDPILQDAHIFPQGSMRLKTTINPVSYAPADLGTIDADAIVWLPNSRGVSADTVLETIEKRFQEGSRVHEDIKPLRRGVRVVYADQNPGFHIDVTPARPRSWNDETHGHGMLEVPDRETGWKASSPIPYADWLHDASESQIMLENYVALNKSRAVADSATIAPLPEYEEYQTEDPLRASIKLLKRHRDEWAIRTKNEKSRPISAVITTLAAHAWLNVAMQSRQRPFTPLEAILEIVRTMPNFIRSNGQEYMVCNPEDSGENFAEKWNRPGEGSAYQRAFYEWHESACEAFSLGLESYPSVESFAKAVNESFGIGRSFVDEVNTSIPANWTMPGRPSGMNRNSVSMGALFGGVAGSEQSQADTKPVGRLG

SEQ ID NO: 269 - protein, 339 aa, Escherichia coli
MYRGATSMSNEQTKHSSWEYFLLRAARKISLSAAQYSVIDARYSQLEKILSAADDPLLADAHIFPQGSMRLQTTINPVPGAPADLGTIDADAIVWLPHARGIDARTVLEVIERRFQEGSRVQEDIQRLRRGVRIVYADENPGFHIDVTPARPCHHNEQSDGLGMLEVPDREHGWKASSPIPYADWLHDASKQDIMLEHVVEFNKSHAAMDSATQAPLPEYKEYQKDDPLRASIKLMKRHRDEWAIRTKNEGYRPISAVITTLATHAYLDVVAQSVYTAFTPLQAILAIVNRMPDHIHRYGNEYYVCNPEDNGENFAEKWNRPDEGYKYVDAFNMSAPMI

SEQ ID NO: 270 - protein, 332 aa, Escherichia coli
MSNEQTKHSSWEYFLLRAARKISLSAAQYSVIDARYSQLEKILSAADDPLLADAHIFPQGSMRLQTTINPVPGAPADLGTIDADAIVWLPHARGIDARTVLEVIERRFQEGSRVQEDIQRLRRGVRIVYADENPGFHIDVTPARPCHHNEQSDGLGMLEVPDREHGWKASSPIPYADWLHDASKQDIMLEHVVEFNKSHAAMDSATQAPLPEYKEYQKDDPLRASIKLMKRHRDEWAIRTKNEGYRPISAVITTLATHAYLDVVAQSVYTAFTPLQAILAIVNRMPDHIHRYGNEYYVCNPEDNGENFAEKWNRPDEGYKYVDAFNMSAPMI

SEQ ID NO: 271 - protein, 422 aa, Escherichia coli
MYRGATSMSNEQTKHSSWEYFLLRAARKISLSAAQYSVIDARYSQLEKILSAADDPLLADAHIFPQGSMRLQTTINPVPGAPADLGTIDADAIVWLPHARGIDARTVLEVIERRFQEGSRVQEDIQRLRRGVRIVYADENPGFHIDVTPARPCHHNEQSDGLGMLEVPDREHGWKASSPIPYADWLHDASKQDIMLEHVVEFNKSHAAMDSATQAPLPEYKEYQKDDPLRASIKLMKRHRDEWAIRTKNEGYRPISAVITTLATHAYLDVVAQSVYTAFTPLQAILAIVNRMPDHIHRYGNEYYVCNPEDNGENFAEKWNRPDEGYKYVDAFNKWHASARSALTLGLDSHASTETFAKAVQEQFGIGPTFVREVNESIPANWTMPGRQDGVTRNSVAMGSLFGSSVSSTQSQANVAPVGRLG

SEQ ID NO: 272 - protein, 415 aa, Unknown
  Description of Unknown: Enterobacteriaceae sequence
MSNEQTKHSSWEYFLLRAARKISLSAAQYSVIDARYSQLEKILSAADDPLLADAHIFPQGSMRLQTTINPVPGAPADLGTIDADAIVWLPHARGIDARTVLEVIERRFQEGSRVQEDIQRLRRGVRIVYADENPGFHIDVTPARPCHHNEQSDGLGMLEVPDREHGWKASSPIPYADWLHDASKQDIMLEHVVEFNKSHAAMDSATQAPLPEYKEYQKDDPLRASIKLMKRHRDEWAIRTKNEGYRPISAVITTLATHAYLDVVAQSVYTAFTPLQAILAIVNRMPDHIHRYGNEYYVCNPEDNGENFAEKWNRPDEGYKYVDAFNKWHASARSALTLGLDSHASTETFAKAVQEQFGIGPTFVREVNESIPANWTMPGRQDGVTRNSVAMGSLFGSSVSSTQSQANVAPVGRLG

SEQ ID NO: 273 - protein, 415 aa, Escherichia coli
MSNEQTKHSSWEYFLLHAARKISLSAAQYSVIDARYSQLEKILSAADDPLLADAHIFPQGSMRLQTTINPVPGAPADLGTIDADAIVWLPHARGIDARTVLEVIERRFQEGSRVQEDIQRLRRGVRIVYADENPGFHIDVTPARPCHHNEQSDGLGMLEVPDREHGWKASSPIPYADWLHDASKQDIMLEHVVEFNKSHAAMDSATQAPLPEYKEYQKDDPLRASIKLMKRHRDEWAIRTKNEGYRPISAVITTLATHAYLDVVAQSVYTAFTPLQAILAIVNRMPDHIHRYGNEYYVCNPEDNGENFAEKWNRPDEGYKYVDAFNKWHASARSALTLGLDSHASTETFAKAVQEQFGIGPTFVREVNESIPANWTMPGRQDGVTRNSVAMGSLFGSSVSSTQSQANVAPVGRLG

SEQ ID NO: 274 - protein, 415 aa, Lonsdalea britannica
MSNEQTKHSSWEYFLLRAARKISLSAAQYSVIDARYSQLEKILSAADDPLLADAHIFPQGSMRLQTTINPVPGAPADLGTIDADAIVWLPHARGIDARTVLEVIERRFQEGSRVQEDIQQLRRGVRIVYADENPGFHIDVTPARPCHHNEQSDGLGMLEVPDREHGWKASSPIPYADWLHDASKQDIMLEHVVEFNKSRAAMDSATQAPLPEYKEYQKDDPLRASIKLMKRHRDEWAIRTKNEGYRPISAVITTLATHAYLDVVAQSEYTAFTPLQAILAIVNRMPDHIHRYSNEYYVCNPEDNGENFAEKWNRPDEGYKYVDAFNKWHASARSALTLGLDSHASTETFAKAVQEQFGIGPTFVREVNESIPANWTMPGRQDGVTRNSVAMGSLFGSSVSSNQSQANVAPVGRLG

SEQ ID NO: 275 - protein, 415 aa, Unknown
  Description of Unknown: Klebsiella sequence
MSNEQTKHRSWEYFLLRAARKISLSAAQYSVIDARYSQLEKILSAADDPLLADAHIFPQGSMRLQTTINPVPGAPADLGTIDADAIVWLPHARGIDARTVLEVIERRFQEGSRVQEDIQQLRRGVRIVYADENPGFHIDVTPARPCHHNEQSDGLGMLEVPDREHGWKASSPIPYADWLHDASKHDIMLEHVVEFNKSRAAMDSATQAPLPEYKEYQKDDPLRASIKLMKRHRDEWAIRTKNEGYRPISAVITTLATHAYLDVVAQSEYTAFTPLQAILAIVNRMPDHIHRYSNEYYVCNPEDNGENFAEKWNRPDEGYKYVDAFNKWHASARSALTLGLDSHASTETFAKAVQEQFGIGPTFVREVNESIPANWTMPGRQDGVTRNSVAMGSLFGSSVSSNQSQANVAPVGRLG

SEQ ID NO: 276 - protein, 415 aa, Unknown
  Description of Unknown: Enterobacteriaceae sequence
MSNEQTKHRSWEYFLLRAARKISLSAAQYSVIDARYSQLEKILSAADDPLLADAHIFPQGSMRLQTTINPVPGAPADLGTIDADAIVWLPHARGIDARTVLEVIERRFQEGSRVQEDIQQLRRGVRIVYADENPGFHIDVTPARPCHHNEQSDGLGMLEVPDREHGWKASSPIPYADWLHDASKHDIMLEHVVEFNKSRAAMDSATQAPLPEYKEYQKDDPLRASIKLMKRHRDEWAIRTKNEEYRPISAVITTLATHAYLDVVAQSEYTAFTPLQAILAIVNRMPDHIHRYSNEYYVCNPEDNGENFAEKWNRPDEGYKYVDAFNKWHVSARSALTLGLDSHASTETFAKAVQEQFGIGPTFVREVNESIPANWTMPGRQDGVTRNSVAMGSLFGSSVSSNQSQANVAPVGRLG

SEQ ID NO: 277 - protein, 415 aa, Cronobacter dublinensis
MSNEQTKHRSWEYFLLRAARKISLSAAQYSVIDARYSQLEKILSAADDPLLADAHIFPQGSMRLQTTINPVPGAPADLGTIDADAIVWLPHARGIDARTVLEVIERRFQEGSRVQEDIQQLRRGVRIVYADENPGFHIDVTPARPCHHNEQSDGLGMLEVPDREHGWKASSPIPYADWLHDASKQDIMLEHVVEFNKSHAVMDSATQAPLPEYKEYQKDDPLRASIKLMKRHRDEWAIRTKNERYRPISAVITTLATHAYLDVVAQSEYTAFTPLQAILAIVNRMPDHIHRYSNEYYVCNPEDNGENFAEKWNRPDEGYKYVDAFNKWHASARSALTLGLDSHASTETFAKAVQEQFGIGPTFVREVNESIPANWTMPGRQDGVTRNSVAMGSLFGSSVSSNQSQANVAPVGRLG

SEQ ID NO: 278 - protein, 415 aa, Klebsiella pneumoniae
MSNEQTKHRSWEYFLLRAARKISLSAAQYSVIDARYSQLEKILSAADDPLLADAHIFPQGSMRLQTTINPVPGAPADLGTIDADAIVWLPHARGIDARTVLEVIERRFQEGSRVQEDIQQLRRGVRIVYADENPGFHIDVTPARPCHHNEQSDGLGMLEVPDREHGWKASSPIPYADWLHDASKQDIMLEHVVEFNKSHAVMDSATQAPLPEYKEYQKDDPLRASIKLMKRHRDEWAIRTKNERYRPISAVITTLATHAYLDVVAQSEYTAFTPLQAILAIVNRMPDHIHRYSNEYYVCNPEDNGENFAEKWNRPDEGYKYVDAFNKWHASARSALTLGLDSHASTETFAKAVQEQFGIGPTFVREVNESIPANWTMPGRQDGVTRNSVAMGALFGSSVSSNQSQANVAPVGRLG

SEQ ID NO: 279 - protein, 415 aa, Enterobacter cloacae
MSNEQTKHSSWEYFLLRAAREISLSAAQYSVIDARYSQLEKILSAADDPLLADAHIFPQGSMRLQTTINPVPGAPADLGTIDADAIVWLPHARGIDARTVLEVIERRFQEGSRVQEDIQQLRRGVRIVYADENPGFHIDVTPARPCHHNEQSDGLGMLEVPDRELGWKASSPIPYADWLDDASKQDIMLEHVVEFNKSRAAMDSATQAPLPEYKEYQKDDPLRASIKLMKRHRDEWAIRTKNEGYRPISAVITTLATHAYLDVVAQSEYTAFTPLQAILAIVNRMPDHIRRYSNEYYVCNPEDNGENFAEKWNRPDEGYKYVDAFNKWHASARSALTLGLDSHASTETFARAVQEQFGIGPTFVREVNESIPANWTMPGRQDGVTRNSVAMGSLFGSSVSSNQSQANVAPVGRLG

SEQ ID NO: 280 - protein, 415 aa, Yersinia rohdei
MSNEQTKHRSWEYFLLRAARKISLSAAQYSVIDARYSQLEKILSAADDPLLADAHIFPQGSMRLQTTINPVPGAPADLGTIDADAIVWLPHARGIDARTVLEVIERRFQEGSRVQEDIQQLRRGVRIVYADENPGFHIDVTPARPCHNNEQSDGLGMLEVPDREYGWKASSPIPYADWLHDASKQDIMLEHVVEFNKSRAAMDSATQAPLPEYKEYQKDDPLRASIKLMKRHRDEWAIRTKNEGYRPISAVITTLATHAYLDVVAQSEYTAFTPLQAILAIVNRMPDHIHRYSNEYYVCNPEDNGENFAEKWNRPDEGYKYVDAFNKWHASARSALMLGLDSHASTETFAKAVQEQFGIGTTFVREVNESIPANWTMPGRQDGVTRNSVAMGSLFGSSVSSNQSQENVAPVGRLG

SEQ ID NO: 281 - protein, 415 aa, Yersinia enterocolitica
MSNEQTKHRSWEYFLLRAARKISLSAAQYSVIDARYSQLEKILSAADDPLLADAHIFPQGSMRLQTTINPVPGAPADLGTIDADAIVWLPHARGNDARTVLEVIERRFQEGSRVQEDIQQLRRGVRIVYADENPGFHIDVTPARPCHNNEQSDGLGMLEVPDREYGWKASSPIPYADWLHDASKQDIMLEHVVEFNKSRAAMDSATQAPLPEYKEYQKDDPLRASIKLMKRHRDEWAIRTKNEGYRPISAVITTLATHAYLDVVAQSEYTAFTPLQAILEIVNRMPDHIHRYSNEYYVCNPEDNGENFAEKWNRPDEGYKYVDAFNKWHASARLALTLGLDSHASTETFAKAVQEQFGIGTTFVREVNESIPANWTMPGRQDGVTRNSVAMGSLFGSSVSSNQSQANVAPVGRLG

SEQ ID NO: 282 - protein, 415 aa, Escherichia coli
MSNEQTKHSSWEYFLLRAARKISLSEAQYSVIDARYSQLQKILSAADDPLLADAHIFPQGSMRLQTTINPVSGAPADLGTIDADAIVWLPHARGLDARTVLAVIERRFKEGSRVQEDIQQLRRGVRIVYADENPGFHIDVTPARPCLHNEQSDGLGMLEVPDREHGWKASSPIPYADWLHDASKQDIILEHSVALNKSSVFMDSATQAPLPEYKEYQKDDPLRASIKLMKRHRDEWAIRTKNAGYRPISAVITTLATHAYLDVVAQSKYTAFTPLQAILAIVDKMPDYVRRYGNQYYVCNPKDNGENFAEKWNRPDEGYKYVKAFTEWHASARSALMLGLDSHASTESFAKAVQEQFGIGPTFVREVNESIPANWTMPGRQAGVTRNSVAMGSLFGSSVSSTHSQANVAPVGRLG

SEQ ID NO: 283 - protein, 200 aa, Pseudomonas aeruginosa
MSVSNEQTKRGSWEHFLLRAAREISLSEAQYEKINDRYSQLEQILNASDNPLLAEAHIFVQGSMRLKTTIKPVSGAPEDLDTIDADAIIWLPHAQGAGAQEVLDAIEERFKAGSRVQEEIKQLRRGIRIIYADENPGFHIDVTPARAINGNSQGNGEGKLEVPDRVTGWKASSPIPYSNWLQVASKQTISLEHLAVAKVS

SEQ ID NO: 284 - protein, 416 aa, Pseudomonas mediterranea
MLLSNEQTKRSSWEYFLLRAAREISLSEAQYEKINDRYSQLEKILSASDNPLLAEAHIFVQGSMRLKTTIKPIPGAPADLDTIDADAIIWLPHAQGASAKEVLEAIEQRFREGSRVQEEVKQLRRGIRIVYADENPGFHIDVTPARAINGNGEANGEGKLEVPDRVTGWKASSPIPYSNWLQVASAQEISLENLVVAKSQRMLDAATQDPLPHYQDYIDQDPLRATIKLLKRHRDEWAINTRSADTRPISAVITTLATHAYLDVVKESQSKPLAPLDAILEIVRRMPQHIAQRGSDCFVCNPADNGENFAEKWNRPGEGQGYRQAFARWHADASASVSLGLESFESNDSFAEAVKKNFGIAPALITAVNNEIPANWTMPGRPDGTTRNSASMGSLFGGASGGGTSQSSVKPVGRLG

SEQ ID NO: 285 - protein, 416 aa, Unknown
  Description of Unknown: Pseudomonas sequence
MLLSNEQTKRSSWEYFLLRAAREISLSEAQYEKINDRYSQLEKILSASDNPLLAEAHIFVQGSMRLKTTIKPIPGAPADLDTIDADAIIWLPHAQGASAKEVLEVIEQRFREGSRVQEEVKQLRRGIRIVYADENPGFHIDVTPARAINGNGEANGEGKLEVPDRVTGWKASSPIPYSNWLQVASAQEISLESLVIAKSQRMLDAATQDPLPHYQDYIDQDPLRATIKLLKRHRDEWAINTRSADTRPISAVITTLATHAYLDVVKESQSKPLAPLDAILEIVRRMPQHIAQRGSDCFVCNPADNGENFAEKWNRPGEGQGYRQAFAKWHADASASVSLGLESFESNDSFAEAVKKNFGIAPALITAVNNEIPANWTMPGRPDGTTRNSASMGSLFGGASGGGTSQSSVKPVGRLG

SEQ ID NO: 286 - protein, 416 aa, Pseudomonas mediterranea; identical to SEQ ID NO: 284

SEQ ID NO: 287 - protein, 416 aa, Unknown
  Description of Unknown: Pseudomonas sequence
MLLSNEQTKRSSWEYFLLRAAREISLSEAQYEKINDRYSQLEKILSASDNPLLAEAHIFVQGSMRLKTTIKPIPGAPADLDTIDADAIIWLPHAQGASAKEVLEAIEQRFREGSRVQEEVKQLRRGIRIVYADENPGFHIDVTPARAINGNGEANGEGKLEVPDRVTGWKASSPIPYSNWLQVASAQEISLESLVVAKSQRMLDAATQDPLPHYQDYIDQDPLRATIKLLKRHRDEWAINTRSADTRPISAVITTLATHAYLDVVKESQSKPLAPLDAILEIVRRMPQHIAQRGSDCFVCNPADNGENFAEKWNRPGEGQGYRQAFARWHADASASVSLGLESFESNDSFAEAVKKNFGIAPALITAVNNEIPANWTMPGRPDGTTRNSASMGSLFGGASGGGTSQSSVKPVGRLG

SEQ ID NO: 288 - protein, 416 aa, Pseudomonas fluorescens
MLLRNEQTKRSSWEYFLLRAAREISLSEAQYEKINDRYSQLEKILSASDNPLLAEAHIFVQGSMRLKTTIKPIPGAPADLDTIDADAIIWLPHAQGAGAKEVLEAIEQRFREGSRVQEEVKQLRRGIRIVYADENPGFHIDVTPARAINGNGEANGEGKLEVPDRVTGWKASSPIPYSNWLQVASAQEISLESLVVAKSQRMLDAATQDPLPHYQDYIDQDPLRATIKLLKRHRDEWAIKTRSADTRPISAVITTLATHAYLDVVKESQSKPLAPLDAILEIVRRMPQHIAQRGSDCFVCNPADNGENFAEKWNRPGEGQGYRQAFTKWHADASASVSLGLESFESNDSFAEAVKKNFGIAPAFITAVNNEIPANWTMPGRPDGTTRNSASMGSLFGGASGGGTSQSSVKPVGRLG

SEQ ID NO: 289 - protein, 416 aa, Pseudomonas sp.
MLLSNEQTKRSSWEYFLLRAAREISLSEAQYEKINDRYSQLEKILSASDNPLLAEAHIFVQGSMRLKTTIKPIPGAPADLDTIDADAIIWLPHAQGAGAKEVLEAIEQRFREGSRVQEEVKQLRRGIRIVYADENPGFHIDVTPARAINGNGEANGEGKLEVPDRVTGWKASSPIPYSNWLQVASAQEISLESLVIAKSQRMLDAATQDPLPHYQDYIDQDPLRATIKLLKRHRDEWAIKTRSADTRPISAVITTLATHAYLDVVKESQSKPLAPLDAILEIVRRMPQHIAQRGSDCFVCNPADNGENFAEKWNRPGEGQGYRQAFTKWHADASASVSLGLESFESNDSFAEAVKKNFGIAPAFITAVNNEIPANWTMPGRPDGTTRNSASMGSLFGGASGGGTSQSSVKPVGRLG

SEQ ID NO: 290 - protein, 416 aa, Pseudomonas marginalis
MLLSNEQTKRSSWEYFLLRAAREISLSEAQYEKINDRYSQLEKILSASDNPLLAEAHIFVQGSMRLKTTIKPIPGAPADLDTIDADAIIWLPHAQGAGAKEVLEAIEQRFREGSRVQEDVKQLRRGIRIVYADENPGFHIDVTPARAINGNGEANGEGKLEVPDRVTGWKASSPIPYSNWLQVASAQEISLESLVIAKSQRMLDAATQDPLPHYQDYIDQDPLRATIKLLKRHRDEWAIKTRSADTRPISAVITTLATHAYLDVVKESQSKPLAPLDAILEIVRRMPQHIAQRGSDCFVCNPADNGENFAEKWNRPGEGQGYRQAFTKWHADASASVSLGLESFESNDSFAEAVKKNFGIAPAFITAVNNEIPANWTMPGRPDGTTRNSASMGSLFGGASSGGTSQSSVKPVGRLG

SEQ ID NO: 291 - protein, 416 aa, Pseudomonas fluorescens
MLLSNEQTKRSSWEYFLLRAAREISLSEAQYEKINDRYSQLEKILSASDNPLLAEAHIFVQGSMRLKTTIKPIPGAPADLDTIDADAIIWLPHAQGASAKEVLEAIEQRFREGSRVQEEVKQLRRGIRIVYADENPGFHIDVTPARAINGNGEANGEGKLEVPDRVTGWKASSPIPYSNWLQVASAQEISLESLVIAKSQRMLDAATQDPLPHYQDYIDQDPLRATIKLLKRHRDEWAIKTKSADTRPISAVITTLATHAYLDVVKESQSKPLAPLDAILEIVRRIPQHIAYRGSDCFVCNPADNGENFAEKWNRPGEGQGYRQAFSKWHADASASVSLGLESFESNDSFAEAVKKNFGIAPAFITTVNNEIPANWTMPGRPDGTTRNSASMGSLFGGASGGGTSQSSVKPVGRLG

SEQ ID NO: 292 - protein, 416 aa, Unknown
  Description of Unknown: Pseudomonas sequence
MLLSNEQTKRSSWEYFLLRAAREISLSEAQYEKINDRYSQLEKILSASDNPLLAEAHIFVQGSMRLKTTIKPIPGAPADLDTIDADAIIWLPHAQGAGAKEVLEAIEQRFREGSRVQEEVKQLRRGIRIVYADENPGFHIDVTPARAINGNGEANGEGKLEVPDRVTGWKASSPIPYSNWLQVASAQEISLESLVVAKSQRMLDAATQDPLPHYQDYIDQDPLRATIKLLKRHRDEWAIKTRSADTRPISAVITTLATHAYLDVVKESQSKPLAPLDAILEIVRRMPQHIAHRGSDCYVCNPADNGENFAEKWNRPGEGQGYRQAFAKWHADASASVSLGLESFESNDSFAEAVKKNFGIAPAFITAVNNEIPANWTMPGRPDGTTRNSASMGSLFGGASGGGTSQSSVKPVGRLG

SEQ ID NO: 293 - protein, 416 aa, Unknown
  Description of Unknown: Pseudomonas sequence
MLLSNEQTKRSSWEYFLLRAAREISLSEAQYEKINDRYSQLEKILSASDNPLLAEAHIFVQGSMRLKTTIKPIPGAPADLDTIDADAIIWLPHAQGAGAKEVLEAIEQRFREGSRVQEEVKQLRRGIRIVYADENPGFHIDVTPARAINGNGEANGEGKLEVPDRVTGWKASSPIPYSNWLQVASAQEISLESLVVAKSQRMLDAATQDPLPHYQDYIDQDPLRATIKLLKRHRDEWAIKTRSADTRPISAVITTLATHAYLDVVKESQSKPLAPLDAILEIVRRMPQHIAQRGSDCYVYNPADNGENFAEKWNRPGEGQGYRQAFAKWHADASASVSLGLESFESNDSFAEAVKKNFGIAPAFITAVNNEIPANWTMPGRPDGTTRNSASMGSLFGGASGGGTSQSSVKPVGRLG

SEQ ID NO: 294 - protein, 416 aa, Pseudomonas fluorescens
MLLSNEQTKRSSWEYFLLRAAREISLSEAQYEKINDRYSQLEKILSASDNPLLAEAHIFVQGSMRLKTTIKPIPGAPADLDTIDADAIIWLPHAQGAGAKEVLEAIEQRFREGSRVQEEVKQLRRGIRIVYADENPGFHIDVTPARAINGNGEANGEGKLEVPDRVTGWKASSPIPYSNWLQVASAQEISLESLVVAKSQRMLDAATQDPLPHYQDYIDQDPLRATIKLLKRHRDEWAIKTRSADTRPISAVITTLATHAYLDVVKESQAKPLAPLDAILEIVRRMPQHIGQRGSDCYVCNPADNGENFAEKWNRPGEGQGYRQAFAKWHADASASVSLGLESFESNDSFAEAVKKNFGIAPAFITAVNNEIPANWTMPGRPDGTTRNSASMGSLFGGASGGGTSQSSVKPVGRLG

SEQ ID NO: 295 - protein, 416 aa, Pseudomonas fluorescens
MLLSNEQTKRSSWEYFLLRAAREISLSEAQYEKINDRYSQLEKILSASDNPLLAEAHIFVQGSMRLKTTIKPIPGAPADLDTIDADAIIWLPHAQGASAKEVLEAIEQRFREGSRVQEEVKQLRRGIRIVYADENPGFHIDVTPARAINGNGEANGEGKLEVPDRVTGWKASSPIPYSNWLQVASAQEISLESLVVAKSQRMLDAATQDPLPHYQDYIDQDPLRATIKLLKRHRDEWAIKTRSADTRPISAVITTLATHAYLDVVKESQAKPLAPLDAILEIVRRMPQHIGQRGSDCYVCNPADNGENFAEKWNRPGEGQGYRQAFAKWHADASASVSLGLESFESNDSFAEAVKKNFGIAPAFITAVNNEIPANWTMPGRPDGTTRNSASMGSLFGGASGGGTSQSSVKPVGRLG

SEQ ID NO: 296 - protein, 340 aa, Pseudomonas syringae
MLLSNEQTKRSSWEYFLLRAAREISLSEAQYEKINDRYSQLEKILSASDNPLLAEAHIFVQGSMRLKTTIKPIPGAPADLDTIDADAIIWLPHAQGASAKEVLEAIEQRFREGSRVQEEVKQLRRGIRIVYADENPGFHIDVTPARAINGNGEANGEGKLEVPDRVTGWKASSPIPYSNWLQVASAQEISLESLVVAKSQRMLDAATQDPLPHYQDYIDQDPLRATIKLLKRHRDEWAINTRSADTRPISAVITTLATHAYLDVVKESQSKPLAPLDAILEIVRRMPQHIAHRGNDCFVCNPADNGENFAEKWNRPGEGQGYRQAFAKWHADASASVSLG

SEQ ID NO: 297 - protein, 416 aa, Unknown
  Description of Unknown: Pseudomonas sequence
MLLSNEQTKRSSWEYFLLRAAREISLSEAQYQKINDRYSQLEKILSASDNPLLAEAHIFVQGSMRLKTTIKPIPGAPADLDTIDADAIIWLPHAQGASAKEVLEAIEQRFREGSRVQEEVKQLRRGIRIVYADENPGFHIDVTPARAINGNGEANGEGKLEVPDRVTGWKASSPIPYSNWLQVASAQEISLESLVVAKSQRMLDAATQDPLPHYQDYIDQDPLRATIKLLKRHRDEWAINTRSADTRPISAVITTLATHAYLDVVKESQSKPLAPLDAILEIVRRMPQHIAHRGNDCFVCNPADNGENFAEKWNRPGEGQGYRQAFAKWHADASASVSLGLESFESNDSFAEAVKKNFGIAPAFISAVNNEIPANWTMPGRPDGTTRNSASMGSLFGGASGGGTSQSSVKPVGRLG

SEQ ID NO: 298 - protein, 416 aa, Unknown
  Description of Unknown: Pseudomonas sequence
MLLSNEQTKRNSWEYFLLRAAREISLSEAQYQKINDRYSQLEKILSASDNPLLAEAHIFVQGSMRLKTTIKPIPGAPADLDTIDADAIIWLPHAQGASAKEVLEAIEQRFREGSRVQEEVKQLRRGIRIVYADENPGFHIDVTPARAINGNGEANGEGKLEVPDRVTGWKASSPIPYSNWLQVASAQEISLESLVVAKSQRMLDAATQDPLPHYQDYIDQDPLRATIKLLKRHRDEWAINTRSADTRPISAVITTLATHAYLDVVKESQSKPLAPLDAILEIVRRMPQHIAHRGNDCFVCNPADNGENFAEKWNRPGEGQGYRQAFAKWHADASASVSLGLESFESNDSFAEAVKKNFGIAPAFISAVNNEIPANWTMPGRPDGTTRNSASMGSLFGGASGGGTSQSSVKPVGRLG

SEQ ID NO: 299 - protein, 416 aa, Unknown
  Description of Unknown: Pseudomonas sequence
MLLSNEQTKRSSWEYFLLRAAREISLSEAQYEKINDRYSQLEKILSASDNPLLAEAHIFVQGSMRLKTTIKPIPGAPADLDTIDADAIIWLPHAQGAGAKEVLEAIEQRFREGSRVQEEVKQLRRGIRIVYADENPGFHIDVTPARAINGNGEANGEGKLEVPDRVTGWKASSPIPYSNWLQVASAQEISLESLVIAKSQRMLDAATQDPLPHYQDYIDQDPLRATIKLLKRHRDEWAINTRSADTRPISAVITTLATHAYLDVVKESQSKPLAPLDAILEIVRRMPQHIAHRGNDCFVCNPADNGENFAEKWNRPGEGQGYRQAFTKWHADASASVSLGLESFESNDSFAEAVKKNFGIAPAFITAVNNEIPANWTMPGRPDGTTRNSASMGSLFGGASGGGTSQSSVKPVGRLG

SEQ ID NO: 300 - protein, 416 aa, Unknown
  Description of Unknown: Pseudomonas sequence
MLLSNEQTKRSSWEYFLLRAAREISLSEAQYEKINDRYSQLEKILSASDNPLLAEAHIFVQGSMRLKTTIKPITGAPADLDTIDADAIIWLPHAQGAGAKEVLEAIEQRFREGSRVQEEVKQLRRGIRIVYADENPGFHIDVTPARAINGNGEANGEGKLEVPDRDTGWKASSPIPYSNWLQVASAQEISLESLVIAKSQRMLDAATQDPLPHYQDYIDQDPLRATIKLLKRHRDEWAINTRSADTRPISAVITTLATHAYLDVVKESQSKPLAPLDAILEIVRRMPQHIAHRGNDCFVCNPADNGENFAEKWNRPGEGQGYRQAFTKWHADASASVSLGLESFESNDSFAEAVKKNFGIAPAFITAVNNEIPANWTMPGRPDGTTRNSASMGSLFGGASGGGTSQSSVKPVGRLG

SEQ ID NO: 301 - protein, 416 aa, Unknown
  Description of Unknown: Pseudomonas sequence
MLLSNEQTKRSSWEYFLLRAAREISLSEAQYEKINDRYSQLEKILSASDNPLLAEAHIFVQGSMRLKTTIKPIPGAPADLDTIDADAIIWLPHAQGASAKEVLEAIEQRFREGSRVQEEVKQLRRGIRIVYADENPGFHIDVTPARAINGNGEANGEGKLEVPDRVTGWKASSPIPYSNWLQVASAQEISLESLVVAKSQRMLDAATQDPLPHYQDYIDQDPLRATIKLLKRHRDEWAINTRSADTRPISAVITTLATHAYLDVVKESQSKPLAPLDAILEIVRRMPQHIAHRGNDCFVCNPADNGENFAEKWNRPGEGQGYRQAFAKWHADASASVSLGLESFESNDSFAEAVKKNFGIAPALITAVNNEIPANWTMPGRPDGTTRNSASMGSLFGGASGGATSQSSVKPVGRLG

SEQ ID NO: 302 - protein, 416 aa, Pseudomonas fluorescens
MLLSNEQTKRSSWEYFLLRAAREISLSEAQYEKINDRYSQLEKILSASDNPLLAEAHIFVQGSMRLKTTIKPIPGAPADLDTIDADAIIWLPHAQGAGAKEVLEAIEQRFREGSRVQEEVKQLRRGIRIVYADENPGFHIDVTPARAINGNGEANGEGKLEVPDRVTGWKASSPIPYSNWLQVASAQEISLESLVVAKSQRMLDAATQDPLPHYQDYIDQDPLRATIKLLKRHRDEWAINTRSSDTRPISAVITTLATHAYLDVVRESQSKPLAPLDAILEIVRRMPQHIAHRGNDCFVCNPADNGENFAEKWNRPGEGQGYRQAFAKWHADASASVSLGLESFESNDSFAEAVKKNFGIAPAFITAVNNEIPANWTMPGRPDGTTRNSASMGSLFGGASGGGTSQSSVKPVGRLG

SEQ ID NO: 303 - protein, 416 aa, Pseudomonas abietaniphila
MLLSNEQTKRSSWEYFLLRAAREISLSEAQYEKINDRYSQLEKILSASDNPLLAEAHIFVQGSMRLKTTIKPIPGAPADLDTIDADAIIWFPHAQGASAKEVLEAIEQRFREGSRVQEEVKQLRRGIRIVYADENPGFHIDVTPARAINGNGEANGEGKLEVPDRVTGWKASSPIPYSNWLQVASAQEISLESLVVAKSQRMLDAATQDPLPHYQDYIDQDPLRATIKLLKRHRDEWAINTRSADTRPISAVITTLATHAYLDVVKESQSKPLAPLDAILEIVRRMPQHIAQRGSDCFVCNPADNGENFAEKWNRPGEGQGYRQAFAKWHADASASVSLGLESFESNDSFAEAVKKNFGIAPAFITAVNNEIPANWTMPGRPEGTTRNSASMGSLFGGASGGATSQSSVKPVGRLG

SEQ ID NO: 304 - protein, 416 aa, Unknown
  Description of Unknown: Pseudomonas fluorescens group sequence
MLLSNEQTKRSSWEYFLLRAAREISLSEAQYEKINDRYSQLEKILSASDNPLLAEAHIFVQGSMRLRTTIKPIPGAPADLDTIDADAIIWLPHAQGAGAKEVLEAIEQRFREGSRVQEEVKQLRRGIRIVYADENPGFHIDVTPARAINGNGEANGEGKLEVPDRVTGWKASSPIPYSNWLQVASAQEISLESLVVAKSQRMLDAATQDPLPHYQDYIDQDPLRATIKLLKRHRDEWAIKTRSADTRPISAVITTLATHAYLDVVKESQSKPLAPLDAILEIVRRMPQHIAHRGSDCYVCNPADNGENFAEKWNRPGEGQGYRQAFAKWHADAGASLSLGLESFESNDSFAEAMKKNFGIAPAFITAVNNEIPANWTMPGRPDGTTRNSASMGSLFGGASGGGTSQSSVKPVGRLG

SEQ ID NO: 305 - protein, 416 aa, Pseudomonas fluorescens
MLLSNEQTKRSSWEYFLLRAAREISLTEAQYEKINDRYSQLQKILSASDNPLLAEAHIFVQGSMRLKTTIKPIAGAPADLDTIDADAIIWLPHAQGAGAKEVLEAIEQRFREGSRVQEEVKQLRRGIRIVYADENPGFHIDVTPARAINGNGEANGEGKLEVPDRVTGWKASSPIPYSNWLQVASAQEIFLESLVIAKSQRMLDAATQDPLPHYQDYIDQDPLRATIKLLKRHRDEWAIKTKSADTRPISAVITTLATHAYLDVVKESQSKPLAPLDAILEIVRRIPQHIAYRGSDCFVCNPADNGENFAEKWNRPGEGQGYRQAFSKWHADASASVSLGLESFESNDSFAEAVKKNFGIAPAFITTVNNEIPANWTMPGRPDGTTRNSASMGSLFGGASGGGTSQSSVKPVGRLG

SEQ ID NO: 306 - protein, 416 aa, Pseudomonas sp.
MLLSNEQTKRSSWEYFLLRAAREISLTEAQYEKINDRYSQLEKILSASDNPLLAEAHIFVQGSMRLKTTIKPIAGAPADLDTIDADAIIWLPHAQGAGAKEVLEAIEQRFREGSRVQEEVKQLRRGIRIVYADENPGFHIDVTPARAINGNGEANGEGKLEVPDRVTGWKASSPIPYSNWLQVASAQEIFLESLVIAKSQRMLDAATQDPLPHYQDYIDQDPLRATIKLLKRHRDEWAIKTKSADTRPISAVITTLATHAYLDVVKESQSKPLAPLDAILEIVRRIPQHIAYRGSDCFVCNPADNGENFAEKWNRPGEGQGYRQAFSKWHADASASVSLGLESFESNDSFAEAVKKNFGIAPAFITTVNNEIPANWTMPGRPDGTTRNSASMGSLFGGASGGGTSQSSVKPVGRLG

SEQ ID NO: 307 - protein, 416 aa, Pseudomonas syringae
MLMSNEQTKRSSWEYFLLRAAREISLSEAQYEKINDRYSQLEKILSASDNPLLAEAHIFVQGSMRLKTTIKPIPGAPSDLDTIDADAIIWLPHAQGAGAKEVLEAIEQRFREGSRVQEEVKQLRRGIRIVYADENPGFHIDVTPARAINGNGEAKGEGKLEVPDRVTGWKASSPIPYSNWLQVASAQEIFLESLVIAKSQRTLDAATQDPLPHYQDYIDQDPLRATIKLLKRHRDEWAIKTRSADTRPISAVITTLATHAYLDVVKESQSKPLAPLDAILEIVRRMPQHIAQRGSDCLVCNPADHGENFAEKWNRPGEGQGYRQAFTKWHADASASVSLGLESFESNDSFAEAVKKNFGIAPAFITAVNNEIPANWTMPGRPDGTTRNSASMGSLFGGASGGGTSQSSVKPVGRLG

SEQ ID NO: 308 - protein, 416 aa, Pseudomonas fluorescens
MLLSNEQTKRSSWEYFLLRAAREISLSEAQYEKINDRYSQLEKILSASDNPLLAEAHIFVQGSMRLKTTIKPIPGAPADLDTIDADAIIWLPHAQGAGAKEVLEAIEQRFREGSRVQEEVKQLRRGIRIVYADENPGFHIDVTPARAINGNGEANGEGKLEVPDRVTGWKASSPIPYSNWLQVASAQEISLESLVVAKNQRMLDAATQDPLPHYQDYIDQDPLRATIKLLKRHRDEWAINTRSADTRPISVVITTLATHAYLDVVKESQSKPLAPLDAILEIVRRMPQHIAHRGNDCFVCNPADNGENFAEKWNRPGEGQGYRQAFAKWHADASASVSLGLESFESNDSFAEAVKKNFGIAPALITAVNNEIPANWTMPGRPDGTTRNSASMGSLFGGASGGGTSQSSVKPVGRLG

SEQ ID NO: 309 - protein, 416 aa, Pseudomonas fulva
MLMSNEQTKRSSWEYFLLRAARDISLSEAQYEKINDRYSQLEKILSASDNPLLAEAHIFVQGSMRLKTTIKPISGAPADLDTIDADAIIWLPHAQGAGAKEVLEAIEERFREGSRVQEEVKQLRRGIRIVYADENPGFHIDVTPARAINGNGEGNGEGKLEVPDRVTGWKASSPIPYSNWLQVASAQEISLESLVIAKSQRMLDAATQDPLPHYQDYIDQDPLRATIKLLKRHRDEWAIKTKSADIRPISAVITTLATHAYLDVVKESKSKPLAPLDAILEIVRRMPHHIAHRGSDCFVCNPADNGENFAEKWNRPGEGHGYRQAFATWHADASASISLGLESFESADSFAEAVKENFGMAPAFITAVNNEIPANWTMPGRPDGTTRNSASMGALFGGASGGGTSQSSVKPVGRLG

SEQ ID NO: 310 - protein, 416 aa, Pseudomonas aeruginosa
MSVSNEQTKRGSWEHFLLRAAREISLSEAQYEKINDRYSQLEQILNASDNPLLAEAHIFVQGSMRLKTTIKPVSGAPEDLDTIDADAIIWLPHAQGAGAQEVLDAIEERFKAGSRVQEEIKQLRRGIRIIYADENPGFHIDVTPARAINGNSQGNGEGKLEVPDRVTGWKASSPIPYSNWLQVASKQTISLEHLAVAKSQRAFDAATQDPLPQYEDYLDQDPLRATIKLLKRHRDEWAIRTKNADHRPISAVITTLATHAYLEVAKESQTAPLKPLDAILEIVRRMPDHVKRQGNECLVCNPADNGENFAEKWNRPLDGHRYRRAFEEWHENASASVSLGLESFESAEAFAKAVKENFGMGPTFISTVNSEIPSNWTMPGRPDGTTRNSTSMGALFGGFSGTASSQEDVKPVGRLG

SEQ ID NO: 311 - protein, 416 aa, Pseudomonas sp.
MSMSNEQTKRGSWEHFLLRAAREISLSEAQYEKINDRYSQLEQILNASDNPLLAEAHIFVQGSMRLKTTIKPVSGAPEDLDTIDADAIIWLPHAQGAGAQEVLDAIEERFKAGSRVQEEIKQLRRGIRIIYADENPGFHIDVTPARAINGNSQGNGEGKLEVPDRVTGWKASSPIPYSNWLQVASKQTISLEHLAVAKSQRAFDAATQDPLPQYEDYLDQDPLRATIKLLKRHRDEWAIRTKNADHRPISAVITTLATHAYLEVAKESQTAPLKPLDAILEIVRRMPDHVKRRGNECLVCNPADNGENFAEKWNRPLDGHRYRRAFEEWHENASASVSLGLESFESAEAFAKAVKENFGMGPTFISTVNSEIPSNWTMPGRPDGTTRNSTSMGALFGGFSGTASSQEDVKPVGRLG

SEQ ID NO: 312 - protein, 416 aa, Pseudomonas aeruginosa
MSMSNEKTKRGSWEHFLLRAAREISLSEAQYEKINDRYSQLEQILNASDNPLLAEAHIFVQGSMRLKTTIKPVSGAPEDLDTIDADAIIWLPHAQGAGAQEVLDAIEERFKAGSRVQEEIKQLRRGIRIIYADENPGFHIDVTPARAINGNSQGNGEGKLEVPDRVTGWKASSPIPYSNWLQVASKQTISLEHLAVAKSQRAFDAATQDPLPQYEDYLDQDPLRATIKLLKRHRDEWAIRTKNADHRPISAVITTLATHAYLEVAKESQTAPLKPLDAILEIVRRMPDHVKRRGNECLVCNPADNGENFAEKWNRPLDGHRYRRAFEEWHENASASVSLGLESFESAEAFAKAVKENFGMGPTFISTVNSEIPSNWTMPGRPDGTTRNSTSMGALFGGFSGTASSQEDVKPVGRLG

SEQ ID NO: 313 - protein, 416 aa, Pseudomonas aeruginosa
MSMSNEQTKRGSWEHFLLRAAREISLSEAQYEKIKDRYSQLEQILNASDNPLLAEAHIFVQGSMRLKTTIKPVSGAPEDLDTIDADAIIWLPHAQGAGAQEVLDAIEERFKAGSRVQEEIKQLRRGIRIIYADENPGFHIDVTPARAINGNSQGNGEGKLEVPDRVTGWKASSPIPYSNWLQVASKQTISLEHLAVAKSQRAFDAATQDPLPQYEDYLDQDPLRATIKLLKRHRDEWAIRTKNADHRPISAVITTLATHAYLEVAKESQTAPLKPLDAILEIVRRMPDHVKRQGNECLVCNPADNGENFAEKWNRPLDGHRYRRAFEEWHENASASVSLGLESFESAEAFAKAVKENFGMGPTFISTVNSEIPSNWTMPGRPDGTTRNSTSMGALFGGFSGTASSQEDVKPVGRLG

SEQ ID NO: 314 - protein, 416 aa, Pseudomonas aeruginosa
MSMSNEQTKRGSWEHFLLRAAREISLSEAQYEKINDRYSQLEQILNASDNPLLAEAHIFVQGSMRLKTTIKPVSGAPEDLDTIDADAIIWLPHAQGAGAQEVLDAIEERFKAGSRVQEEIKQLRRGIRIIYADENPGFHIDVTPARAVNGNSQGNGEGKLEVPDRVTGWKASSPIPYSNWLQVASKQTISLEHLAVAKSQRAFDAATQDPLPQYEDYLDQDPLRATIKLLKRHRDEWAIRTKNADHRPISAVITTLATHAYLEVAKESQTAPLKPLDAILEIVRRMPDHVKRQGNECLVCNPADNGENFAEKWNRPLDGHRYRRAFQEWHENASASVSLGLESFDSAEAFAKAVKENFGMGPTFISAVNSEIPSNWTMPGRPVGTTRNSTSMGALFGGFSGTANSQEDVKPVGRLG

SEQ ID NO: 315 - protein, 416 aa, Unknown
  Description of Unknown: Pseudomonas sequence
MSMSNEQTKRVSWEHFLLRAAREISLSEAQYEKINDRYSQLEQILNASDNPLLAEAHIFVQGSMRLKTTIKPVSGAPEDLDTIDADAIIWLPHAQGAGAQEVLDAIEERFKAGSRVQEEIKQLRRGIRIIYADENPGFHIDVTPARAVNGNSQGNGEGKLEVPDRVTGWKASSPIPYSNWLQVASKQTISLEHLAVAKSQRAFDAATQDPLPQYEDYLDQDPLRATIKLLKRHRDEWAIRTKNADHRPISAVITTLATHAYLEVAKESQTAPLKPLDAILEIVRRMPDHVKRQGNECLVCNPADNGENFAEKWNRPLDGHRYRRAFQEWHENASASVSLGLESFDSAEAFAKAVKENFGMGPTFISAVNSEIPSNWTMPGRPVGTTRNSTSMGALFGGFSGTANSQEDVKPVGRLG

SEQ ID NO: 316 - protein, 417 aa, Unknown
  Description of Unknown: Pseudomonas sequence
MSMSNEQTKRGSWEHFLLRAAKEISLSEAQYEKINDRYSQLEKILNASDNPLLAEAHIFVQGSMRLKTTIKPVSGAPEDLDTIDADAIIWLPHAQDAGAREVLDAIEERFKAGSRVQEEIKQLRRGIRIVYADENPGFHIDVTPARAINGNSQGNGEGKLEVPDRETGWKASSPIPYSKWLQVASTQTISLAEHMAVAKSQRAFDAATQDPLPQYQDYLDQDPLRATIKLLKRHRDEWAIRTKNTDHRPISAVITTLATHAYLDVAKESQSTPLRPLDAILEIVRRMPDHVKYRGNECQVCNPADSGENFAEKWNRPLDGHRYRRAFQEWHENASVSVSLGLESFESAEAFAKAVNENFGIGPTFISAVNSEIPPNWTMPGRPDGTTRNATLMGTMFGGASGTASSQEDVKPVGRLG

SEQ ID NO: 317 - protein, 417 aa, Pseudomonas stutzeri
MSMSNEQTKRGSWEHFLLRAAKEISLSEAQYEKINDRYSQLEKILNASDNPLLAEAHIFVQGSMRLKTTIKPVSGAPEDLDTIDADAIIWLPHAQGAGAQEVLDAIEERFKAGSRVQEEIKQLRRGIRIIYADENPGFHIDVTPARAINGNSQGNGEGKLEVPDRETGWKASSPIPYSKWLQVASTQTISLAEHMAVAKSQRAFDAATQDPLPQYQDYLDQDPLRATIKLLKRHRDEWAIRTKNTDHRPISAVITTLATHAYLDVAKDSQSTPLRPLDAILEIVRRMPDHVKYRGNECQVCNPADSGENFAEKWNRPLDGHRYRRAFQEWHENASVSVSLGLESFESAEAFAKAVNENFGIGPTFISAVNSEIPPNWTMPGRPDGTTRNAMLMGTMFGGVSGTANSQEDVKPVGRLG

SEQ ID NO: 318 - protein, 417 aa, Pseudomonas aeruginosa
MSMSNEQTKRGSWEHFLLRAAKEISLSEAQYEKINDRYSQLEKILNASDNPLLAEAHIFVQGSMRLKTTIKPVSGAPEDLDTIDADAIIWLPHAQGAGAQEVLDAIEERFKAGSRVQEEIKQLRRGIRIIYSDENPGFHIDVTPARAINGNSQGNGEGKLEVPDRETGWKASSPIPYSKWLQVASTQTISLAEHMAVAKSQRAFDAATQDPLPQYQDYLDQDPLRATIKLLKRHRDEWAIRTKNTDHRPISAVITTLATHAYLDVAKDSQSTPLRPLDAILEIVRRMPDHVKYRGNECQVCNPADSGENFAEKWNRPLDGHRYRRAFQEWHENASVSVSLGLESFESAEAFAKAVNENFGIGPTFISAVNSEIPPNWTMPGRPDGTTRNAMLMGTMFGGVSGTANSQEDVKPVGRLG

SEQ ID NO: 319 - protein, 417 aa, Pseudomonas panipatensis
MSMSNEQTKRGSWEHFLLRAAKEISLSEAQYEKINDRYSQLEKTLNASDNPLLAEAHIFVQGSMRLKTTIKPVSGAPEDLDTIDADAIIWLPHAQGAGAQEVLDAIEERFKAGSRVQEEIKQLRRGIRIIYADENPGFHIDVTPARAINGNSQGNGEGKLEVPDRVTGWKASSPIPYSKWLQVASTQTISLAEHMAVAKSQRAFDAATQDPLPQYEDYLDQDPLRATIKLLKRHRDEWAIRTKNTDHRPISAVITTLATHAYLDVAKESQSTPLRPLDAILEIVRRMPDHVKYRGNECQVCNPADSGENFAEKWNRPLDGHRYRRAFQEWHENASASVSLGLESFESAEAFAKAVKENFGMGPTFISAVNSEIPSNWTMPGRPDGTTRNSTSMGALFGGFSGTASSQEDVKPVGRLG

SEQ ID NO: 320 - protein, 417 aa, Unknown
  Description of Unknown: Pseudomonas sequence
MSMSNEQTKRGSWEHFLLRAAREISLSETQYEKINDRYSQLEKILNASDNPLLAEAHIFVQGSMRLKTTIKPVSGAPEDLDTIDADAIIWLPHAQGAGAQEVLDAIEERFRAGSRVQEEIKPLRRGIRIIYADENPGFHIDVTPARAINGNSQGNGEGKLEVPDRETGWKASSPIPYSNWLQVASTQTISFEKHLAVAKSQRAFDAATQDPLPQYEEYLDQDPLRATIKLLKRHRDEWAIRTKNENCRPISAVITTLATHAYLDVVKESQSKPLRPLDAILEIVRRMPDHVRHRGNECLVCNPADSGENFAEKWNRPSEGYRYRRAFQDWHSNASASVSLGLESFESAEAFATAVKENFGMGPSFISAVNREIPSNWTMPGRPDGTTRNATSMGALFGGVSGTANSQEDVKPVERLG

SEQ ID NO: 321 - protein, 416 aa, Dickeya paradisiaca
MSISNEQTKRGSWEHFLLRAAREISLSEAQYEKINDRYSQLERILNASDNPLLAEAHIFVQGSMRLKTTIKPVSGAPEDLDTIDADAIIWLPHAQEAGAQEVLDAIEERFKAGSRVQEEIKQLRRGIRIIYADENPGFHIDVTPARAINGNSQSNGEGKLEVPDRVTGWKASSPIPYSNWLQVASKQTISLEHLVVAKSQRTFDAATQDPLPQYEDYLDQDPLRATIKLLKRHRDEWAIRTKNADHRPISAVITTLATHAYLDVANESQSTPLRPLDAILEIVRRMTDHIKHRGNECFVCNPADSGENFAEKWNRPLDGQRYRRAFQEWHENASASVSLGLESFDSAEAFAKAVKENFGMGPAFISAVNREIPSNWTMPGRSDGTTRNSTSMGALFGGLSGTASSQEDVKPVGRLG

SEQ ID NO: 322 - protein, 416 aa, Pectobacterium parmentieri
MSISNEQTKRGSWEHFLLRAAREISLSEAQYEKINDRYSQLERILNASDNPLLAEAHIFVQGSMRLKTTIKPVSGAPEDLDTIDADAIIWLPHAQGAGAQEVLDAIEERFKAGSRVQEEIKQLRRGIRIIYADENPGFHIDVTPARAINGNSQSNGEGKLEVPDRVTGWKASSPIPYSNWLQVASKQTISLEHLVVAKSQRTFDAATQDPLPQYEDYLDQDPLRATIKLLKRHRDEWAIRTKNADHRPISAVITTLATHAYLDVAKESQSAPLRPLDAILEIVRRMTDHIKHRGNECFVCNPADSGENFAEKWNRPLDGQRYRRAFQEWHENASASVSLGLESFDSAEAFAKAVKENFGMGPAFISAVNREIPSNWTMPGRPDGTTRNSTSMGALFGGLSGTASSQEDVKPVGRLG

SEQ ID NO: 323 - protein, 416 aa, Pectobacterium carotovorum
MSISNTQTKRGSWEHFLLRAAREISLSEAQYKTINDRYSQLERILNASDNPLLAEAHIFVQGSMRLKTTIKPVSGAPEDLDTIDADAIIWLPHAQGAGAQEVLDAIEERFKSGSRVQEEIKQLRRGIRIIYADENPGFHIDVTPARAINGNSQSNGEGKLEVPDRVTGWKASSPIPYSNWLQVASKQTISLEHLVVAKSQRTFDAATQDPLPQYEDYLDQDPLRATIKLLKRHRDEWAIRTKNSDHRPISAVITTLATHAYLDVAKESQSTPLRPLDAILEIVRRMTDHIKHRGNECFVCNPADSGENFAEKWNRPLDGQRYRRAFQEWHENASASVSLGLESFESAEAFAKAVKENFGMGPAFISAVNSEIPSNWTMPGRPDGTTRNSTSMGALFGGFSGTASSQEDVKPVGRLG

SEQ ID NO: 324 - protein, 417 aa, Pseudomonas sp.
MSMSNEQTKRGSWEHFLLRAAREISLSEAQYEKISDRYAQLQKVLSASDNPLLAEAHIFPQGSMRLKTTIKPVSGAPEDLDTIDADAIIWLPHAQGAGAQEVLDAIEERFRAGSRVQEEIKPLRRGIRIVYADENPGFHIDVTPARAINGNSQGNGEGKLEVPDRETGWKASSPIPYSNWLQVASTQTISFEEHLAVAKSQRAFDAATQDPLPHYEEYLDQDPLRATIKLLKRHRDEWAIRTKNESFRPISAVITTLATHAYLDVAKESQSKPLSPLDAILEIVRRMPDHVKYRGNECLVCNPADSGENFAEKWNRPSEGHRYRRAFQDWHSNASASVSMGLESFESAEAFAKAVKENFGIGPTFISAVNSEIPPNWTMPGRPDGTTRNATSMGALFGGVSGTANSQEDVKPVERLG

SEQ ID NO: 325 - protein, 417 aa, Pseudomonas syringae
MSVIAEQTKRGSWEHFLLRAARDISLSQAQYEKIDSRYSQLQKILNASDNPLLAEAHIFVQGSMRLKTTIKPVSGAPEDLDTIDADAIIWLPHAQGAGAKEVLDAIEQRFTAGSRVQEEIKQLRRGIRIVYCDENPGFHIDVTPARAITRNAEGNGEGKLEVPDRETGWKASSPIPYSNWLQVASTQTISLEERLIVAKSHRTFDAATQDPLPNYDEYLDQDPLRATIKLLKRHRDEWAIRTKNENYRPISAVITTLATHAYLEVAKESKLKPLRPLEAILEIVRRMPNHVKQRGNECLVCNPTDSGENFAEKWNRPREGHHYRRAFEDWHSNASASVSLGLESFESADAFAKAVKESFGMGTAFISAVNSEIPPNWTMPGRPDGTTRNNTSMSSLFGGVSGTEKPQEDVKPVGRLG

SEQ ID NO: 326 - protein, 417 aa, Unknown
  Description of Unknown: Pseudomonas syringae group sequence
MSVIAEQTKRGSWEHFLLRAARDISLSQAQYEKIDSRYSQLQKILNASDNPLLAEAHIFVQGSMRLKTTIKPVSGAPEDLDTIDADAIIWLPHAQGAGAKEVLDAIEQRFTAGSRVQEEIKQLRRGIRIVYSDENPGFHIDVTPARAITRNAEGNGEGKLEVPDRETGWKASSPIPYSNWLQVASTQTISLEERLIVAKSHRTFDAATQDPLPNYDEYLDQDPLRATIKLLKRHRDEWAIRTKNENYRPISAVITTLATHAYLEVAKESKLKPLRPLEAILEIVRRMPNHVKQRGNECLVCNPTDSGENFAEKWNRPREGHHYRRAFQDWHSNASASVSLGLENFESADAFAKAVKESFGMGTAFISAVNSEIPPNWTMPGRPDGTTRNNTSMSSLFGGVSGTEKPQEDVKPVGRLG

SEQ ID NO: 327 - protein, 417 aa, Unknown
  Description of Unknown: Pseudomonas syringae group sequence
MSVIAEQTKRGSWEHFLLRAARDISLSQAQYEKIDSRYSQLQKILNASDNPLLAEAHIFVQGSMRLKTTIKPVSGAPEDLDTIDADAIIWLPHAQGAGAKEVLDAIEQRFTAGSRVQEEIKQLRRGIRIVYSDENPGFHIDVTPARAITRNAEGNGEGKLEVPDRETGWKASSPIPYSNWLQVASTQTISLEERLIVAKSHRTFDAATQDPLPNYDEYLDQDPLRATIKLLKRHRDEWAIRTKNENYRPISAVITTLATHAYLEVAKESKLKPLRPLEAILEIVRRMPNHVKQRGNECLVCNPTDSGENFAEKWNRPREGHHYRRAFQDWHSNASASVSLGLENFESADAFAKAVKESFGMGTAFISAVNSEIPPNWTMPGRPDGTTRNNTSMSSLFGGVSGTETPQEDVKPVGRLG

SEQ ID NO: 328 - protein, 416 aa, Serratia marcescens
MILTNEQNKRAGWEHFLLRAAREISLSEAQYKTINGRYSQLEGILSASDNPLLADAHIFVQGSIRLKTTVKPVSGAPDDLNTIDADAIIWLPHAQGAGADDILAAIEERFREGSRVQEDIQQLRRGIRIVYSDENPGFHIDVTPARAIAGNYESNGEGKLEVPDRVAGWKASSPIPYSNWLQVASTQEIVLENLILAKNHATADSATQAPLPEYGEYLDQDPLRATIKLLKRHRDEWAIRTENEEHRPISAVITTLATHAYLDMVEASKSTPLRPLDAILGIVQRMQRHVKYDGVRYFVCNPADNGENFAEKWNRPLDGPMYHKAFCDWYLDAGAAISLGLESFASADDFTKAINESFGIGNTFITAINNEIPANWTLPGRTDGTTRNTVSMGALFGGTSTAGSSQAKVKPVERLG

SEQ ID NO: 329 - protein, 416 aa, Halomonas xinjiangensis
MILRKEDTKRGSWEHFLLRAAREISLSEAQYEKIDSRYSQLESILSSSNDPLLAEAHIFVQGSMRLKTTVKPVSEAPEDLDTIDADAIVWLPHAQGAEAHEVLEAIEQRFKDGSRVQEGIKPLRRGVRIVYADENPGFHIDVTPARAINGNSEEKGEGKLEVPDREMGWKASSPIPYSNWLQAASEQEVTLESLVVAKSERSIDAATQDPLPDYQDYLDQDPLRASIKLLKRHRDEWAIRTNNADHRPISAVITTLATHAYLDVVAESKSKPLQPLDAILEIVHRMPRHVDYTELGYQVCNPGDKGENFAEKWNRPRDGESYRQAFYDWHANASSSISLGLESFETADSFAKAVKESFGMGPAFITEVNNEIPGDWTIPGRQDGVTRNSLSMGALFGGASGDESSQAEVKPVERLG

SEQ ID NO: 330 - protein, 419 aa, Pseudomonas putida
MITQDELTRRRSWERLLLRAASSISLTVSQYKLIEDRYSELQNILSASKDPLLAGAHIFPQGSMRLRTTINPVKDAPKDLGTIDADAIVWLPHAGHADADTVLAAIEQRFREGSRVRSEIVQLRRGIRIEYADENPGFHIDVTPARAVQGNDESNGQGKLEVPDRVTGWKASSPIPYADWLHSASEQKISLELFKSLVGNESRGMVMDSATQEPLPSYQDYDTLDPLRATIKLLKRHRDEWAIETRNEDYRPISAVITTLATHAYLKVVKESHHTPLTPIDAILKIVEKIPEEIRVFGGNYYVLNPRDAGENFAEKWNRPDEGHKYSQAFDNWHASAMVAFMLGLQPHNSADAFAQVMKRSFGIGQTIINESNNEIPGNWTMAGRKAGTTKNVLAATAIFGSSSHATPQANVKPVERLG

SEQ ID NO: 331 - protein, 417 aa, Pseudomonas sp.
MITQDESTRRSSWERLLLRAASSISLTASQYKVIEDRYSQLQSILSASKDPLLEGAHIFPQGSMRLKTTINPVKDAPKDLGTIDADAIVWLPNAGDADADTVLAAIEQRFREGSRVQSDIVQLRRGIRIEYADENPGFHIDITPARAVQGNNESNGQGKLEVPDRVTGWKASSPIPYADWLHSASEQKISLELLKSFVANESRAMDSATQEPLPSYQEYDKLDPLRATIKLLKRHRDEWAIETRNEDYRPISAVITTLATHAYLKVVKESHHTPLTPIDAILKIVEKIPEEIKVFAGKYYVVNPRDPGENFAEKWNRPEEGHKYCQAFDNWHASALVAFMLGLQPHDSADSFANVMKRSFGIGQSVITEVNNEIPGHWTMAGRKVGTTKNILAATAIFGSSSHATPQTNVKPVERLG

SEQ ID NO: 332 - protein, 419 aa, Unknown
  Description of Unknown: Pseudomonas sequence
MITQDESTRRSSWERLLLRAASSISLTASQYKVIEDRYSQLQSILSASKDPLLEGAHIFPQGSMRLKTTINPVKDAPKDLGTIDADAIVWLPNAGDADADTVLAAIEQRFREGSRVQSEIVQLRRGIRIEYADENPGFHIDVTPARPVQGNDESDGQGKLEVPDRVTGWKASSPIPYADWLHSASEQNISLELFKSLAINASRGAIMDSATQEPLPSYQDYDKLDPLRATIKLLKRHRDEWAIETRNEDYRPISAVITTLATHAYLKVVKESHHTPLTPIDAILKIVEKIPEEIRVFAGQYYVLNPRDAGENFAEKWNRPEEGHKYRQAFDNWHASALVAFMLGLHPHDSADSFANVMKRSFGIGQSVITEVNNEIPGHWTMAGRKVGTTKNILAATAIFGSSSHATPQTNVKPVERLG

SEQ ID NO: 333 - protein, 419 aa, Pseudomonas donghuensis
MITQDESTRRSSWERLLLRAASSISLTASQYKVIEDRYSQLQSILSASKDPLLEGAHIFPQGSMRLKTTINPVKDAPKDLGTIDADAIVWLPNAGDADADTVLAAIEQRFREGSRVQSEIVQLRRGIRIEYADENPGFHIDVTPARPVLGNDESDGQGKLEVPDRVTGWKASSPIPYADWLHSASEQNISLELFKSLAINASRGAIMDSATQEPLPSYQDYDKLDPLRATIKLLKRHRDEWAIETRNEDYRPISAVITTLATHAYLKVVKESHHTPLTPIDAILKIVEKIPEEIRVFAGQYYVLNPRDAGENFAEKWNRPEEGHKYRQAFDNWHASALVAFMLGLHPHDSADSFANVMKRSFGIGQSVITEVNNEIPGHWTMAGRKVGTTKNILAATAIFGSSSHATPQTNVKPVERLG

SEQ ID NO: 334 - protein, 419 aa, Unknown
  Description of Unknown: Pseudomonas sequence
MIKQDELTRRRSWEHLLLRAASSISLTASQYELIEDRYSQLEKILSASTDPLLAGAHIFPQGSMRLRTTINPVKDAPKDLGTIDADAIVWLPNAGNADADTVLAAIEQRFREGSRVQSDIVKLRRGIRIEYADENPGFHIDVTPARAVQGNGESDGQGKLEVPDRETGWKASSPIPYADWLHSASEQKISLELYKSLAINESRGAVMDSATQEPLPSYQDYDKLDPLRATIKLLKRHRDEWAIETRNENYRPISAVITTLATHAYLKVVKESHHTPLTPIDAILKIVEKIPEEIRVFAGQYYVLNPRDAGENFAEKWNRPEEGHKYCQAFDNWHASALVAFTLGLQPHDSAGSFAQVMKRSFGIGESLITESNNEIPGNWTMAGRKAGTTRNILAATAIFGSSSHATPQTNVKPVERLG

SEQ ID NO: 335 - protein, 421 aa, Pseudomonas putida
MTTQDEQTRRLSWEHLLLRAARDISLSESQYAIIDSRYETLRNILSASNDPLLAEAHIFPQGSMRLKTIINPVKDAPEGLDTIDADAIVWLPNAGGADAIAVLDAIEKRFSEGSRVTAKIERLRRGIRIVYADENPGFHIDVTPARAINGNRETKGEGKLEVPDREMGWKPSSPISYANWLNSASEQHILLKSVEGLEAFAIDSRDLVVGSATQDPLPTYQDYDDNDPLRATIKLLKRHRDEWAIETRNESHRPISAVITTLATHAYLQVVQESRFSPLRPLDAIIKIVEKMPSFVTQVFGQYQVLNPKDPGENFAEKWNRPDEGARYRQAFYNWHASATVSIMLGLRAHESEEAFARAMNSSFGIGKKLINEANRELPKNWTLPGRKEGITQNSVALAALTGIAISSKPQASVKPVERLG

SEQ ID NO: 336 - protein, 421 aa, Unknown
  Description of Unknown: Pseudomonas sequence
MTIQDEQTRRFSWEHLLLRAARDISLTKSQYETIDGRYNQLEKILSASADPLLAGAHIFPQGSMRLKTTINPVDDAPEDLGTIDADAIVWLPNAGGAEATAVLNAIEKRFSEGTRVTAKIVPLRRGIRIVYADENPGFHIDVTPARAINGNRETKGEGKLEVPDREMGWKPSSPIPYANWLNDASDKHIVLKSLAGFEAFTMDSRDLVVGSATQDPLPTYQDYDDNDPLRATIKLLKRHRDEWAIETRNESHRPISAVITTLATHAYLQVVQESHFLPLRPLDAIIKIVEKMPSFVSQAFGQYQVLNPQDSGENFAEKWNRPKDGAEYRQAFYNWHASATVSMMLGLKTHESEEAFARAMNSSFGIGKKLINEANREIPKNWTLPGRKEGTTHNSVTLAALTGITASSKPQASVKPVERLG

SEQ ID NO: 337 - protein, 420 aa, Pseudomonas sp.
MITQDERTRQRSWELLLLRAANRISLTPSQYQTIDDRYTQLQKILSVSTNPLLAGAHIFVQGSMRLRTTINPVTGAPKDLGTIDADAIIWLPNAANADAMTVMNAIEERFKEGSRVQSAIKPLRRGIRIEYADENPGFHIDITPARNVRGNFERDGKGKLEVPDRDIQDWKPSSPISYADWLNDASEQHITLERELVAAMESYSRTLDSATTQEPLPTYQEYDKLDPLRATVKLLKRHRDEWAIETGATNHRPISAVITTLATHAYLRVVQESKASPLTPVEAIIKIVQKMRQFIGFNEGEYQVLNPEDRGENFAEKWNKPGEGEKYRAAFNNWHASAEVAIQLGLKSHESEDAFARAMNSTFGIGNALISEVNRQIPGSWTMPGRTPGTTRNKAAAAVFYSGASQSKSQSGVEPVERLG

SEQ ID NO: 338 - protein, 419 aa, Xanthomonas perforans
MTLLSDYDSKRGSWEYFLLRAAREISLSERQYDKINARYEVLEGILNAATSPLLHSAHIFVQGSIGLRTTIKPVNGAPADLGTVDADAIVWLPNAGGASAQSVLDEIQKRIEDGTRVDAKVEKLRRGVRIIYADETPGFHIDITPARAIHGNQETHGKGKLEVPDRELQAWKASSPIPYLGWLEQASEKQISLESTQVLATRAIAMDEATQAPLPDYEKYIDNDPLRATIKLLKRHRDEWAIRNNDPSHRPISAVITTLATRAYEEVAAESSRHPRRPLDAIVEIVTKMSSYVQHVGGKYLVCNPKDDAENFAEKWNRPSEGSLYVNAFRKWHEDAKNSITLGLQEFPSLESFNEAVKERFALGSTFVASVNNEIPANWTLPGRKLGHTRNVSMIGSVFGSGVAGNQAQDGAGSPERLG

SEQ ID NO: 339 - protein, 419 aa, Xanthomonas perforans; identical to SEQ ID NO: 338

SEQ ID NO: 340 - protein, 419 aa, Stenotrophomonas maltophilia
MTLLSDFESKRGSWEYFLLRAAREISLSEPQYEKINARYKVLERILNAADSPLLQSAHIFVQGSIGLRTTIKPVNGAPADLGTVDADAIVWLPNAGGASAQSVLDEIHKRIEEGTRVEAKVEKLRRGVRIVYADESPGFHIDITPARAISGNEETHGEGMLEVPDREIQAWKASSPIPYLGWLQQASEQQISLESTEVLATKAIAMDEATLAPLPDYEKYIDNDPLRATIKLLKRHRDEWAIRNGDASHRPISAVITTLATRAYEEVAADSSRRPRRPLDAIIEIVTNMSNHIQYASGKYLVCNPADAAENFAEKWNRPDEGIRYVNAFRKWHDDAKHSISLGLQEFPSVESFSEAVKERFALSSNFVVSVNNDVPANWTLPGRKLGLTRNVSTMGSVFGGGVAGHQAQEGAGSPERLG

SEQ ID NO: 341 - protein, 419 aa, Stenotrophomonas maltophilia
MTLLSDFESKRGSWEYFLLRAAREISLSEPQYEKINARYKVLERILNAADSPLLQSAHIFVQGSIGLRTTIKPVNGAPADLGTVDADAIVWLPNAGGASAQSVLDEIHKRIEEGTRVEAKVEKLRRGVRIVYADESPGFHIDITPARAISGNEETHGEGKLEVPDREIQAWKASSPIPYLGWLQQASEQQISLESIEVLATKAIAMDEATLAPLPDYEKYIDNDPLRATIKLLKRHRDEWAIRDGDASHRPISAVITTLATRAYEEVAADSSRRPRRPLDAIIEIVTNMSNHIQYASGKYLVCNPKDAAENFAEKWNRPDEGIRYVNAFRKWHDDAKHSISLGLQEFPSVESFSEAVKERFALSSNFVVSVNNDVPANWTLPGRKLGLTRNVSTMGSVFGGGVAGHQAQEGAGSPERLG

SEQ ID NO: 342 - protein, 419 aa, Unknown
  Description of Unknown: Stenotrophomonas sequence
MTLLSDFESKRGSWEYFLLRAAREISLSEPQYEKINARYKVLERILNAADSPLLQSAHIFVQGSIGLRTTIKPVIGAPADLGTVDADAIVWLPNAGGASAQSVLDEIHKRIEEGTRVEAKVEKLRRGVRIVYADESPGFHIDITPARAIYGNEETHGEGKLEVPDREIQAWKASSPIPYLGWLQQASEQQISLESIEVLATKAIAMDEATLAPLPDYEKYIDNDPLRATIKLLKRHRDEWAIRDGDASHRPISAVITTLATRAYEEVAADSSRRPRRPLDAIIEIVTNMSNHIQYASGKYLVCNPKDAAENFAEKWNRPDEGIRYVNAFRKWHDDAKHSISLGLQEFPSVESFSEAVKERFALSSNFVVSVNNDVPANWTLPGRKLGLTRNVSTMGSVFGGGVAGHQAQEGAGSPERLG

SEQ ID NO: 343 - protein, 414 aa, Stenotrophomonas maltophilia
MNILTEVPDPRAAGWEHVLFKAADDISLSEALYQKINDRYDTLQDALRATNHPLLKSAHVFPQGSIRLRTAITPCGTSDELGTVDADAVIWLEHAGDASAADVLGAIEERFSESSRVQAPIEQLRRGIRIVYADENPGFHIDVTPARNIATNFNECGHGRLVVPDRKLKDWKASAPIDYCAWLEEVAELSLPVLSVEARAMDSASQEDLPSYSDYISRNVLRAAIKLLKRNRDTWAQQNTDLCADRPISAVITTLAALAYQSIAKDSNHRFLRPIDALLEVVERMPDFIGGSSGNWLVLNPVEPSENFAEKWNRPEGANGRRTFDKWHAQATNAFSLGLREHASMESFREEVSSAFGVGRNFVKDAVNEIPATFDLPGASVGTTRSKQLLEAFSGAAVAGRESQANIQPIKRLG

SEQ ID NO: 344 - protein, 421 aa, Acinetobacter lwoffii
MNLLAQAQHPTQIDSWEVVLMSIVEKISLTTTEYEKITSRYNTLQGILNAAREPVLQDAYIFVQGSIGLKTTIKPLSNAEGDMANVDADAIVLLPNAQNADSAEVLDALKTRFEEGTRTEHPVQELRRGVRVVYADENPGFHIDITPARKVLGNDKEDGYGNLEVPDRVTGWKNSTPRDYSNWLENLSKLEIKIIRKMAAGDSVMMESATQEPLPLYEDYVEHNPLRATIKLLKRHRDKWASNQDDPLCRPISAVITTLAAKAYQKVAYESQNQPLRPIEAILKIIAYMPEFIAETEDGFAVLNPMDQGENFAEKWNRPNGEGESYQKAFFAWHSQALESMQIGLYDLENQKNFEDRLIESFGVPRIFIQDQIKNIPNKSWVLPGRNSKVSLNTISLGALAGTSSTAASVHTSTEPVGRLG

SEQ ID NO: 345 - protein, 420 aa, Acinetobacter sp.
MDLVAQAQHPTQIDSWEVVLMNIVQKISLTPAQYDLITDRYNNLQAILNGAEDEILKDAHIFVQGSIGLKTTIKPAPQAEGDMANIDADAIILLPNAQNVDSKEVLDALTRRFEEGTRTSTPIKPLRRGIRIVYADENPGFHIDVTPSRNARGNGQSAGYGNLEVPDRETGWKCSTPRDYSLWLENLAKLEIQIIRKMAGNKVLMDSATQDPLPLYEDYAEHNPLRATIKLLKRHRDQWALNSESPEYRPISAVITTLAAKAYEKVYKESQAQALRPIEAIVKIIAYMPQFITQVDEGFAVLNPQDSGENFAEKWNRPNGEGESYREAFFAWHSQALESVLIGLNDLGNSASFENKLMESFGVPRAFIKEQIINVPDKSWTLPGRSSQITLNALALNALTGSSSSAASIHTSNEPVGRLG

SEQ ID NO: 346 - protein, 420 aa, Acinetobacter baumannii
MNLVAQAQHPTQIDSWEVVLMNIVQKISLTPAQYDLITDRYSNLQAILNVAEDEILKDAHIFVQGSIGLKTTIKPAPEAEGDLANVDADAIVLLPNAQNVDSKEVLDALTRRFEEGTRTSTPIKPLRRGIRIVYADENPGFHIDVTPARNARGNGQSAGYGNLEVPDRETGWKCSSPRDYSLWLESLAKLEIQIIRKMADNKVLMDSATQDPLPLYEDYAEHNPLRATIKLLKRHRDQWALNSESPEYRPISAVITTLAAKAYEKVYKESQAQALRPIEAIVKIIAYMPQFITQVDEGFAVLNPKDSGENFAEKWNRPDGEGESYREAFFVWHSQALESVLIGLNDLGNSESFENKLMESFGVPRAFIKEQIINVPDKSWTLPGRNSQITLNALALNALTGSSSSAASIHTSNEPVGRLG

SEQ ID NO: 347 - protein, 420 aa, Unknown
  Description of Unknown: Acinetobacter sequence
MNLVAQAQHPTQIDSWEVVLMNIVQKISLTPAQYDLITDRYSNLQAILNVAEDEILKDAHIFVQGSIGLKTTIKPAPEAEGDMANVDADAIVLLPNAQNVDSKEVLDALTKRFEEGTRTSTPIKPLRRGIRIVYADENPGFHIDVTPARNARGNGQSAGYGNLEVPDRETGWKCSTPRDYSLWLENLAKLEIQIIRKMADNKVLMDSATQDPLPLYEDYAEHNPLRATIKLLKRHRDQWALNSESPEYRPISAVITTLAAKAYEKVYKESQAQALRPIEAIVKIIAYMPQFITQTEDGFAVLNPMDKGENFGEKWNRPNGEGESYQEAFFAWHSHALKSVQLGLYDLENQKNFEDRLIESFGIPRTFIQEQIRNVPDKSWTLPGRNSNVSLNTISLGALTGTSSTAASVHTSTEPVGRLG

SEQ ID NO: 348 - protein, 418 aa, Acinetobacter gerneri
MTLLAQAPSQIDSWELLLFKTAHRISLSESQYEVINSRYSQLQKILDVANEEILQDAHIFVQGSIGLKTTIKPASEAEGDMATIDADAIVLLPYARNATSEEVLATLQKRFMIGSRVSTPIQQLRRGIRIIYADENPGFHIDVTPARCAKYNNEFRGYGYLEVPDRHIGWKCSSPREYSKWLEDISQREIKIIKSLNERSIIMDSASQEPIPLYGDYINHNPLRATIKLLKRHRDEWAISTENEDVRPISAIITTLAAQAYEKVVEESLFQALRPIEAMIKIVDYMPRFVSNNDEGYAVLNPKDAGENFAEKWNRPNGEGINYIRAFHNWHIHALESMKLGLNDLKSSNAVEDAIMERFGLNRAFTKELINETPRNWTLPGRSANTTLNSLSLATFAGISTSAAVASQEIIKPVDRLG

SEQ ID NO: 349 - protein, 419 aa, Acinetobacter baumannii
MNITAQTPSQIDSWEIFLLKAIHKISLTPNQYSLIDERYKQLQRILDVASDDILNNAHIFVQGSIGLRTTIKPSPNADGDMATVDADAIVWLPNARNISSEEVLTVLETRFKEGSRVTTPIKRLRRGIRIIYADENPGFHIDVTPARCAKDNNEMNGYGCLEVPDRITGWKCSSPREYSKWLTDVSNRQIRIVAKSVDNRTIVLDSATQDPMPEYAEYIEHNPLRATIKLLKRHRDEWAINSGNEDTRPISAILTTLATHAYERVAEESLHQALRPIEAIIRIIAYMPDFITRNYEGFAVLNPKDTGENFAEKWNRPNGEGSSYVQSFLAWHTHALESVQIGLKDLGSQTAFENAFIERFGVGRAFIQQLIDETPDSKWTLPGRKENISLNFIRLSALAGTSTASIASQENTETVGRLG

SEQ ID NO: 350 - protein, 423 aa, Herminiimonas arsenitoxidans
MDTTLLNKPQVDSWESLLLRSAAQISLSAPQYEKIKTRYENLQNILDATTDPLLQGAHIFIQGSIGLGTTLKPVPYAVNEMATIDADAIVLLPNAANASADQVLEAIEQRFRAGSRVGQPIKPLRRGVRIVYGDENPGFHIDITPARVVAGNTDQKGLGKLQVPDRETGWKASSPREYCNWLGEIAELKVITETHSFALDSSSRADTALAKSTQDPVPDYGEYMDSNPLKAAIKLLKRHRDVWAIANRKESIRPISAIITTLATHAYEEIARESAHRPLRPIEAMIEIVRRMPDFIDPIPAGYAVFNPKDDGENFAEKWNRPNGEGSKYRDAFYVWHARAVVDMKLGLEDFGKAETFENAMNEQFGVSKAFVNDAIKKLPADWTLPGRKAGVTLNSISYAIFAGAAAASSASQAAIKPVDRLG

SEQ ID NO: 351 - protein, 420 aa, Xanthomonadaceae bacterium
MRFDQFDSTQLQSWELLLLRATQEMSLTAPQYTTIEDRYATLQEILATSAHPLLQGAHVFVQGSIELRTTIKPAPGAKGAMGTIDADAVVWLPNATNASASEVLRVIEERFREGTRVDAPIVQLRRGIRIEYADEKPGFHIDITPARCAPGNADCNGVGALEVPDRELGWKASSPREYSAWLQGVSKMRISVQGLDLLKGRGIVLDEASQDPLPAYGDYIDGNPLRAAIKLLKRHRDVWALRNRREDERPISAIITTLATRSYEEMAASGATASLRPVEIILRLVDGMRRFINFSTISGYEVLNPKDPGENFAEKWNRLGSEGVAYRTAFEEWHVQAVGDLQLGLMDLGGDGALRDRFTERFAVTETMVRDVIRDLPGNWTLPGRTPGYTRAAASLAALAGPHAASSAPQGAVVSTGRLG

SEQ ID NO: 352 - protein, 425 aa, Cedecea davisae
MSSQVLDFTAQDSTQVNSWEQMLLEASKKISLSQTQYDLIESRYAQLQKVLDKAQEYFLSGAHIFIQGSIGLKTTVKPAPEAKGDMATIDADAIILLPNASNSSSEDVLLAIEALFKAESTVKAEPEQLRRGIRIVYSDENPGFHIDITPAIKTYGNNEDDGYGKLLVPDRVDGWKASSPRSYSQWLESVSTEKIVMISESTRTMDSIVSNEEFAKSTMDPIPQYQEYTDSHPLGATIKLLKRHRDRWAIRSSSELYRPISAVITTLATQAYYNIALRSASKPMRPIDVMFSIVSDMTQYVNYVNNEYQVLNPCDEGENFAEKWNRNNGEGDMYMSAFYEWHADAITDIALGLSDWGTQHRFEQEVSDKFGVPQSMINEISKEFGRSWTLPGRKSGETLNKTVLSAFGTLSGTGQANAGTVERLG

SEQ ID NO: 353 - protein, 425 aa, Escherichia coli
MTSSVLEFTAQDSSQVNSWEKMLLEASKKISLSQAQYDLIESRYSQLQKVLDSAQDYCLSGAHIFIQGSIGLKTTVKPAPEARGSMATIDADAVVLLPNASNCSAIYVLNAIKKLFKDESAVKAEPVELRRGIRIIYADENPGFHIDITPAIKVNGNQEESGYGKLLVPDREDGWKASAPRSYSRWLENVSNEKIVMISESVITMDSLTGNEHFAKSTMDPIPEYQEYSDSHPLGATIKLLKRHRDRWAIRSSSEEYRPISAVLTTLATKAYYQIALRSVEKPMRPIDVMFSIVSEMASHVDYNNNEYQVLNPCDEGENFAEKWNRVSGEGDKYKTAFYQWHADAITDIALGLSDWGTQQQFEQEVSDKFGVPQSMLKEISKKFGTSWTLPGRKSGETYNKAVLGAFGMLSGISQSNAGTVERLG

SEQ ID NO: 354 - protein, 418 aa, Vibrio cholerae
MDLIQQDSGQVDNWELMLLAAVEKISISAPQYSLIEQRYEVLQDILSGSDDPILQDAHIFIQGSICLKTTIKPVQEAKGEMATIDADAVVLLPYAHGYSADEVLKSIEKIFSERSRVQSPIVPLRRGIRIEYADENPAFHIDITPAISASTDSDQKGYGNLKVPDREQGWKASTPRDYSVWLEELSNQQITIAMESLTMLKAGNEMYSNATQDPMPSYDDYTSHNPLRATIKVLKRLRDVWAISTEKTDRRPISAVITTLAAQSYEAVVAASVSKPLRPLQAITMIIEGMPRFIKQDQATGEYFVLNPKDAGENFAEKWNRQGGHEYRQAFYEWHGFVMDALRIGFVQHRSELEFESNFSTRFGLPKAWVSDFIEKTLPSNKTLPGLKKGVTKNTLAIGLFSAGAAAQENITSVDRLG

SEQ ID NO: 355 - protein, 420 aa, Rheinheimera sp.
MDLVQQDLGQVDNWELMLLAAIDKISITEPQYSLIEKRYDVLQDILSGSDDPILQDAHIFIQGSICLKTTIKPAPEAKDEMATIDADAVVLLPRARGYSADEVLKSIKKIFSERSRVQSPIVELRRGIRIEYADENPAFHIDVTPAISTSVYCDPKGFGNLQVPDRVQGWKASTPRDYSDWLDELSKQQITIALESRTMMKGDAYDAIFSNVTQDPMPSYDDYTSHNPLRATIKVLKRLRDVWAISTEKTDQRPISAVITTLAALSYEAVVAASVIRPLRPLEAITMIIEGMPKFIKMNQATGEYFVLNPKDAGENFAEKWNRKGGHEYRQAFYEWHGFVMDALRIGLVQHTSELEFESNFSSRFGLPKAWVSDFIEKTLPSNKTLPGLKKGVTKNTLAIGLFSGGTAAQENITSVDRLG

SEQ ID NO: 356 - protein, 401 aa, Thermomonas fusca
MLLNIVEAVSVPASEYQRIENHYQAISEILVDPDDPALADGYVFPQGSFLTRTVVRALGNGEIDVDAILLLRETALTPCELLEALYTELEARARTQGGVERRNRCVTVHYADASLPAHLDVTPAIASDGNEDDEGWGPLEVPDYKQADWHPTNPRDFADWFNDISETSIALNQDSVTFAEATKRADAEDLPSHAAINAFDPLRATVKLMKRHRDAFRERHGADAPVPISVVITTLAAKAYMEVAALSQQQPMTALQAIREIIARMPNQFDQDARTGQSWVLCNPRRPAENFAEKWNRDPAYAAMFAKWHGELANAVGLGFVEFSEERDFEEAVLTAFGPEARKRARTFLLEEAGLGHPLPGLNDTTADRLRKAGAVSTTFRGLAPAEPREAAQPKSLGRLG

SEQ ID NO: 357 - protein, 407 aa, Burkholderia sp.
MNAPTSQTLLQKSGPIFDSLRARRQDKRWESFIEGLLKRLELPKEHRARADREYMRIGEHIASYLDLPAERVEVFPQGSMRTCTTIKPRGNTKFDLDIVALVSGPEFETMTPEVFFATFEGALKGLPEICGEPEAKNRCWRLPYERLPFYFDVTPALPAGFYVPQAPLRVRDRTRGWSASNPRELATWFEQIADMQFYFQTNRSYVAMDAAKSITPLPDPDVDIDDILRRAIQLMKLHRDNYYFYAEPERKEAAPISIIIMTLAAHSYRYLAKTRSMTASDSLEVVLELIELMPNFIEYDSRGPRIPNPRLEHENFADRWTTDNGARMREFGLWHSRLMGDLELMFSEDAGRSSESRIRSVFGEDGVTAWKAMQPGNGRMFASLLSAAPLSAAPAPNRSGAARTTLS

SEQ ID NO: 358 - protein, 411 aa, Burkholderia sp.
MEVLVNAPTSQTLLQKSGPIFDSLRARRQDKRWESFIEGLLKRLELPKEHRARADREYMRIGEHIASYLDLPAERVEVFPQGSMRTCTTIKPRGNTKFDLDIVALVSGPEFETMTPEVFFATFEGALKGLPEICGEPEAKNRCWRLPYERLPFYFDVTPALPAGFYVPQAPLRVRDRTRGWSASNPRELATWFEQIADMQFYFQTNRSYVAMDAAKSITPLPDPDVDIDDILRRAIQLMKLHRDNYYFYAEPERKEAAPISIIIMTLAAHSYRYLAKTRSMTASDSLEVVLELIELMPNFIEYDSRGPRIPNPRLEHENFADRWTTDNGARMREFGLWHSRLMGDLELMFSEDAGRSSESRIRSVFGEDGVTAWKAMQPGNGRMFASLLSAAPLSAAPAPNRSGAARTTLS

SEQ ID NO: 359 - protein, 405 aa, Rugosibacter aromaticivorans
MSFSERLLKSLGLTRDAGRWEQLIMSLLKRLELNDSERRDAEREYLKLADDIATKLDIPRHEVDVYPQGSMRTQTTISPRGNAKFDIDVVVELSGPKYQNPDSEQMFEEFGRALLGREEVTGDPEPRRRCWKLNYPQKPYYFDVTPAVADRNQAYGAGLRVRDPDTFWSPSNPKEFADWFCELAELRFPFKDMASLAAFVEARKSIDPLPAEPVGIDDILRRAIQLMKLHRDNFYHFATEEQKAAMPISVIIVTAATHAFENIWRTRQHTMNSPIEVVLAVVDEMPRYVKPDAAGKYLVPNPKLPSENFADRWNSDKGARAREFKHWHAELEGHLEALLTDEYSTSTEGKLKSVFGQAGIDAWRDSLGVTSQGSPLLKSLVAASGVPLANPSVATPVGRKTNTLA

SEQ ID NO: 360 - protein, 413 aa, Acidovorax sp.
MTTNPPNKITFTTRLQKSLGMTRDAGRWEQLIMSLLQRLELDKVDRAKAIKQYEHLADDIATKLDIPRHNVDVYSQGSMRTQTTIRPRGNAKFDIDIMVELSGPKYNNPDSEAMFEEFGRALEGNEEVTGDPDPRRRCWRLQYPGEAFYFDVTPAVADMYKAYGAGLRVRDPDTVWSPSNPKEFADWFCERAELRFEFQQEAVLSSVVEARKSVDPLPSAPVGIDDILRRAVQLMKLHRDNFYFYASPDQKDTMPISVIIVTLATHAFENIWRTRQRSFSSPIEVVLAILEEMPDYIKRDAAGRFYVENPKLSTENFADRWNSDQGARAREFKRWHKQLETHLEALLTDEYSKSTEEKLRGVFGQAGVEAWRDSLGSSTESTPLLKSLVAASGGQMVNPSVATPVSHRTNTLA

SEQ ID NO: 361 - protein, 413 aa, Acidovorax sp.
MTTNPPNKISFTTRLQKSLGMTRDAGRWEQLIMSLLRRLEIDKVDRAKAIKQYELLADDIATKLDIPRHNVDVYSQGSMRTQTTTRPRGNAKFDIDIMVELSGPKYNNPDSEAMFEEFGKALEGNEEVTGDPDPRRRCWRLQYPGEAFYFDVTPAVADMYKTYGAGLRVRDPDTVWSPSNPKEFADWFCERAELRFEFHQEAVLSSLVEARKSVAPLPSAPVGIDDILRRAVQLMKLHRDNFYFYASPDQKDTMPISVIIVTLATHAFENMWRTRQRSFSSPIEVVLAIVEEMPDYIKRDAAGRFYVENPKLSTENFADRWNSDQGARAREFKRWHKQLETHLEALLTDEYSRSTEEKLRGVFGQAGVEAWRDSLGSPTEPTPLLKSLVAASGGQVVNPSVATPVSHRTNTLA

SEQ ID NO: 362 - protein, 413 aa, Curvibacter lanceolatus
MTANPPNNITFTTRLQKSLGMTRDAGRWEQLIMSLLRRLELDKVDRAKAIKQYELLADDIATKLDIPRHNVDVYSQGSMRTQTTIRPRGNAKFDIDIMVELSGPKYNNPDSEAMFEEFGKALEGNEEFTGAPDPRRRCWRLQYPGEAFYFDVTPAVADMYKTYGAGLRVRDPDTVWSPSNPKEFADWFCERADLRFEFQQEAVLSSVVEARKSVDPLPSAPVGIDDILRRAVQLMKLHRDNFYFYASPDQKDTMPISVIIVTLATQAFENIWRTRRHSFNSPIEVVLAIVEEMPDYIKRDAAGRFYVENPKLSTENFADRWNSDQGARAREFKRWHKQLETHLEALLTDEYSRSAEEKLRGVFGQAGVDAWRDSLGSSTESTPLLKSLVVASGGQVANPNVATPVSHRTNTLA

SEQ ID NO: 363 - protein, 413 aa, Comamonas testosteroni
MTTNPPNNITFTTRLQKSLGMTRDAGRWEQLIMSLLQRLELDKVDRAKAIKQYELLADDIATKLDIPRHNVDVYSQGSMRTQTTIRPRGNAKFDIDIMVELSGPKYNNPNSEAMFEQFGKALEGNEEVTGDPDPRRRCWRLQYPGEAFYFDVTPAVADMYKTYGAGLRVRDPDTVWSPSNPKEFADWFCERADLRFSFQEKTALAAVVEARKSIDPVPSDPVGIDDMLRRAVQLMKLHRDNFYFYASPDQKDTMPISVIIVTLATQAFENIWRTRRHSFNSPIEVVLAIVEEMPDYIKRDAAGRFYVENPKLSTENFADRWNSDQGVRAREFKRWHKQLETHLEALLTDEYSRSTEEKLRGVFGQAGVDAWRDSLGSSTEATPLLKSLVVASGGQVANPNVATPVSHRTNTLA

SEQ ID NO: 364 - protein, 408 aa, Cupriavidus necator
MTTNPPTFSKRAMDALLARNDAKQWEFLIGNLLKRLELPPATRAAAEADYLRLADSIANKLGILPGEIQIFAQGSMRTQTTIPQRAPAKLFDLDIVVKLKSGWLAQMNPHDLFRIFGEALEGNESVTGVPEEKRRCWFLNYPGKDYCFDVTPAVQEPAAHSESVLRVRDPDSDWSPSNPIDFADWFCTRAKLRFEFQRVVTRKAFDATASVEPLPDEDIGMDDILRRAVQLMKLHRDGMYWYKDKEIKRAQPISVILVTLAGHACEKLWIEEQRGQRKFSSAIEVALAIVEELPNFIHRESGVFKVCNPGLSTENFADKWNNDEGVRAKQFALWHTQLEQDLDALLHQGEAYVSEEKLRAVFGQAGVDAWKASKPKVSVMDGLLGTASAHVKTNPTTPTRLGSSGTLG

SEQ ID NO: 365 - protein, 403 aa, Burkholderia cenocepacia
MTTNPPLSKRVADALNARRETQQWEQLIAKLLRRLELDPNDRAKAEIDYEELADDLAQKLDVPRYDVHIFPQGSMRTQTTISQRYPVKFDLDLVVKLSGPKYVWPDPEVMFEAFGKALEGNETVTGQPEAKRRCWRLAYPGKPYYFDLTPAIHDQTGREGSSLSVRDPDTRWAPSNPEEFADWFCEHAAKRFEFQTALRQFAMDARTTVTPLPDGDVGLDDILRRTVQLMKLHRDTMYWGVDEKKKERMPISVIIVTLATKAYAALHAQRRTTFSSPIEVVLALVEAMPQFIQRDHTGWRVENPKLKSENFADKWNSEGGARAQEFLRWHAQLERDLDALFHQSHRAPSEDKIRSVFGSAGVEAWKASRPKISVLDSLIGSADGFTKTNPDQPVKTGSSNTLG

SEQ ID NO: 366 - protein, 403 aa, Burkholderia cenocepacia
MTTNLSLSKRVIAALNARSETQQWETLIARLLRRLELDAADRARAEADYARLADDLARKLDIPRHDVHIFPQGSMRTQTTISQRYPVNFDLDLVVKLTGPHYDSPDPELMFALFGKALEGNEAVTGKPEAKRRCWRLPYPGRPYYFDLTPAVRDQTGRQGSSLSVRDPDTRWAPSNPEEFADWFCTHAARRFQFQTILLKSKVEARTTVAPLPDGDVGLDDILRRSVQLMKLHCDTMYWGADEKKKEAMPISVIIVTLATKAYADLHARRGAEFTSPIEVVLALVEAMPDFIERDHRGWRVENPKLTSENFADKWNEDDGARAKEFVRWHAALERDLDALLHQSHRAPSEDRIRSIFGSAGLEAWKESRPKANVLDGLVNSADGYRKANPDHPVKTGSSNTLG

SEQ ID NO: 367 - protein, 400 aa, Caballeronia sordidicola
MTTNPSLSKRLIASLNARAEAQQWEQLIAKLLQRLELNPEDRASAVADYEKVADRLAQKLSIPRHDVHIFPQGSMRTQTTISQQHPVKFDLDLVVKLTGPAYDSPDPETMFEAFGLALEGNETVTGKPDPKRRCWRLQFPGKPYYFDLTPAVRDQTGREGSSLSVRDPDIRWAPSNPEEFANWFCMRAAKRFEFERQLMKAVMDSATITPLPDEEIGLDDILRRTVQLMKLHRDTMYRGNPKQDLMPISVIIVTLATNAYADLYAARRTSFSSPIELVLALVEAMPHYIQKDHTGWRVENPKLKGENFADRWNSDEDARALEFERWHARLETDLEALLHQSHRAPSEDRIRSIFGTTGLEAWKASRPRVSVLDGLIGSADGFTRSNPDKPVRTGSSNTLG

SEQ ID NO: 368 - protein, 403 aa, Lysobacter capsici
MTTQYPMSKRVVAALDARNESRQWEALITNLLKRLELDPKERAMAEADYEQLANQLAAKLSIPRHDVHIFPQGSMRTQTTISQRYPTNFDLDLVVKLSGPKYAQAEPETMFAAFGKALEGNESETGDPSAKRRCWRLPYPGKAYYFDLTPAVPDRTGYWGSSLSVRDPDTRWAPSNPEEFALWFCLHAEKRFSFTRIAQDRQIEAKTTVTPLPNENVGIDDILRRTVQLMKLHRDSLYREESDARKEAMPISVILVTLAAHAYADLHAKRRTEFSSPIEVVLALVEAMPSYIQRAGAGWSVTNPQLPGENFADKWNSDRGLRAAEFHRWHTRLETDLEALLHQKARAVTADQIRSVFGSVGVEAWQASKPANNVFEGLISSAAGVPGRNPAQPVQAGSSNTLG

SEQ ID NO: 369 - protein, 403 aa, Unknown
  Description of Unknown: Variovorax sequence
MSEQPKLSKRVLEQLIARRESQQWEVLIARLLKRLEIDEQDLADAKREYARLADRIAAKLQIPRHDVNIFPQGSMRTQTTISQRYPLKFDLDTVAHLSGPLYDSPNPEIMFAAFGKALEGDEQVTGTPDPKRRCWRLSYPNKRYYFDVTPAVRDQTGKEGSALSVRDPDTGWSPSNPIEFADWFCAWASKKFPFLERRSFSFAEAKANVEEIPDEEIALDDILRRVVQLMKLHRDTMYWGASEKKQEFQPISVIIVTLATKAYAHLLSTRPNDFNSPIEVALAIVEEMANHFDSKAPAWRVDNPALKSENFADRWNKDEGARAREFFLWHAKLETDLEALLHQGARAPAEERIRAVFGSAGLEAWKESHPKENVLDGLLATGASLAKSNPSGPVPVGSKNTLG

SEQ ID NO: 370 - protein, 411 aa, Stenotrophomonas maltophilia
MDNNRFSKRLTASLLERHETDQWTALIGQLLRRLELKPEDFEKAKKEYEALADRIARRLDLPRHDVHIFPQGSMRTQTTISPQWPTKFDLDVVVHLEGLRYQSPDPEKMFQDFGKALEGHEGLTGSPVAKRRCWRLNYPNERFYFDVTPAVDDQTGLQGSSLSVRDPDTYWSPSSPGEYANWFCERASKRFPFQTRLTEFSADARSQVDPLPDSEVGLDDILRRTVQLVKLHRDTIYRGEPAEKQSIMPISVIIVTLLAHAYEKLLAERAHSFNSPIEVVLELIEIMPSMIEQHGGGWCVPNPTLPDENFAHRWNDDHGAREREFRKWHKQLEGDLESLLHQSDRTPQEESIRRVFGPAGVEAWKASKPNVLNGLLSSAGPAATNPKAPMRVGSSNTLASTSGRGPNNTIV

SEQ ID NO: 371 - protein, 401 aa, Unknown
  Description of Unknown: Massilia sequence
MTTSLTLSKRIVDSLITRQEEQQWELLISSLLRRLELNAKDRADAEEEYEVLGDSIAEKLSLPRHDVIVSAQGSMRTQTTISPRYPVKFDIDIFVELAGPGYNALPPETMFHKFGEALDGNEEVTGKREEKRRCWRLGYPGKPFYFDVTPAVRGISYAGGTLRVRDPETRWAPTNPGEFAEWFCKHAEQRFIFAMPLQKSEGVVARSNVEPLPDEPIGLDDILRRTVQLMKLHRDNMYWFADEKRKAAQPISIIVVTLVTRAYGELIRTQRAGFRSPLEVVLKLVEMMPKYIGHDGSKYLIPNPMLPLENFADRWNSDGGARAAEFKRWHARLEGDLDKLLHNGVKTAPEADIREVLGNVGVEAWKASRPKANVLDGLLASAGPLSNPLAPIKPGSSDTLG

SEQ ID NO: 372 - protein, 400 aa, Unknown
  Description of Unknown: Massilia sequence
MTTSQTLSKRIVDSLIARQEEQQWEQLISSLLRRLELNAADKAVAEREYEILGDSIAEKLSLPRHDVIVSPQGSMRTQTTISPRHPVNFDIDIFVELAGPGYDALPPETMFHKFGEALDGNEEVTGKREEKRRCWRLGYPGKPFYFDVTPAVRGTSYAGGTLRVRDPETYWAPTNPGEFAEWFCNHADERFIFATPLQKSEGVVARSNVEPLPDEPVGLDDILRRTVQLMKLHRDNMYWFADEKRKVAQPISIIIVTLVTRAYEELIRTQRAGFRSPLEVVLKLVEMMPKYIGHNGVKYLIPNPKLPFENFADRWNSDEGARAAEFKRWHARLEGDLDKLLHNGAKTAPEADIREVFGNVGVEAWKASWPRANVLDGLLASAGPLNPSAPIKPGSSDTLG

SEQ ID NO: 373 - protein, 400 aa, Massilia namucuonensis
MKNPPVVAQRILKSLTDRSELRQWEVLIGGLLHRLELDADARADAERAYKALGASIARKLNIPEHDVIVSPQGSMATQTTIRPRGNTNFDLDIFVELLGPGYDRLGPEQMFSLFGKALEGNESVTGVPEEKRRCWRLPYTGKPYYFDVTPAVKGLTYAGQGMRVRDPDTQWAPTNPREFADWFCEIAKHRFQFSETFYRSLVMDSATVNPLPSEKIGIDDVLRRAVQLMKLHRDNMYWEASQHDKDTNPISIIIVTLAAQAYDDLRASGAVFSSPLDAALTLVAKMPEFIDQTNGIYKVLNPKLAGENFADKWNHDGKARANQFGRWHNTLLDDLENLTHLNADRADEATIRKVFGAAGVDAWNASRPAAPTQLGGLISSGLASANPKAPINPGSSNTLG

SEQ ID NO: 374 - protein, 397 aa, Alphaproteobacteria bacterium
MQQVKYPQRPGNKEAKQWEKLIVGLLQRLELPEDDKQKAIAEYNKLGKWIGEKLDVPEGGVTIIPQGSMRTQTTIKKPAGKFDIDIVVRLTDGAISKMDPENMFKTFGEALQGREGLTGIPRPKNRCWRLQYEGKPYYFDVTPAVPDATKSLGSSFRARDKDKGWTPTNPIDFAKWFCDHADQRFPFQQESIANDRAAKAAEIIPIPTKEIGLDDILRRTVQLIKLHRDNMYWFEEERAKELQPISIILVTLATHAYSEILRTRPFEFFSAIDVVQEVVAKMPDYISYDPSSGFPCVWNPKLLHQENFADKWHLENGARAKEFMRWHEQLEADISALLHQSSTDPAPEDIQKVFGSAGLKAWKESRPSNSGVFKSILTDENTQPARAVRVGSTTTLG

SEQ ID NO: 375 - protein, 413 aa, Pseudomonas syringae
MTSMTQPRRSRAIAQQLRALNEDKQWETFIVSMLKKLELPEEKRRAAQKRYEQFAHHVATKMGLDIANVHVVVQGSMRTQTTIAGDGREKFDLDVVVKLSGPRFTPLRESEWFFQAFGKALEGIEGAGQPQPKNRCWRLQYPGEPFYFDVTPAIPNSLAIIGTDLRVRDPKTVWSPSNPEDFAEWFCDIADQRFPFQYVMLEKSLEARSHADPIPSEPIGLDDILRRMVQLMKLHRDYHFKRQPDEIRETMPISVILVTLAGHAYKELVENEAASFSSAIEVALELVSRMPDYIDRSTHIKIDNPAMQGQVRENFADRWNGDGGARDKSFRNWHKRLTLDLEALFSESYSKKAEERVREIFGQQGVRAWKGSHEEVPDLLVGAGILQGLKATSPSHSAQPQQPRKTGAGDTLA

SEQ ID NO: 376 - protein, 410 aa, Pseudomonas corrugata
MTQPRRSRAIAQQLRALNEDKQWESFIVSMLKKLELPEEKRRAAQKRYEQFAQHVATKMGLDIANVHVVVQGSMRTQTTIAGDGREKFDLDVVVKLSGPRFTPLRESEWFFQAFGKALEGIEGAGQPQPKNRCWRLQYPGEPFYFDVTPAIPNSLVIIGTDLRVRDPKTVWSPSNPEDFAEWFCDIADQRFPFQYVMLEKSLEARSHADPIPSEPIGLDDILRRMVQLMKLHRDYHFKRQPDEIRETMPISVILVTLAGNAYKELVENEAPSFSSAIEVALELVSRMPDYIDRSTHIKIDNPAMQGQVRENFADRWNGDGGARDKSFRNWHKRLTLDLEALFSESYSKKAEERVREIFGQQGVRAWKGSHEEVPDLLVGTGILQGLKATSPSHSAQPQQSRKTGAGDTLA

SEQ ID NO: 377 - protein, 414 aa, Pseudomonas syringae
MKMAIQSQRRSKVLPGLRDISEARQWESFIVSMLKKLELPEAKRQAAERSYKRFGMHIAHKLGMSTDDVHVVVQGSMRTQTTIAGDGRENFDLDVVVKLSGSRFTNLIESEDFFQLFGAALQGINGAGEPEPKNRCWRLPYPGEPFYFDVTPAIPSSAHITGTDLRVRDKNTVWSPSNPEDFANWFCTIAAKRFPFQMVAMDEAINMRTHVDPIPSAPVALDDILRRLVQLMKLHRDYHFKRQPAHIRETSPISIILVTLAGQAYDDLLHNRPYGLRSSIEVVMELIARMPDFIDRRQGIRVNNPAMPGLAKENFADRWNTDGGARNKSFNEWHDRLTEDLEALFSVGQSTAAEERVRAIFGEAGVRAWKGSQEAAAATIGAPAILAGLKGSSPSSASGQPQQPRKVGSRDTLA

SEQ ID NO: 378 - protein, 412 aa, Pseudomonas syringae
MAIQSQRRSKVLPGLRDISEARQWESFIVSMLKKLELPEAKRQAAERSYKRFGMHIAHKLGMSTDDVHVVVQGSMRTQTTIAGDGRENFDLDVVVKLSGSRFTNLIESEDFFQLFGAALQGINGAGEPEPKNRCWRLPYPGEPFYFDVTPAIPSSAHITGTDLRVRDKNTVWSPSNPEDFANWFCTIAAKRFPFQMVAMDEAINMRTHVDPIPSAPVALDDILRRLVQLMKLHRDYHFKRQPAHIRETSPISIILVTLAGQAYDDLLHNRPYGLRSSIEVVMELIARMPDFIDRRQGIRVNNPAMPGLAKENFADRWNTDGGARNKSFNEWHDRLTEDLEALFSVGQSTAAEERVRAIFGEAGVRAWKGSQEAAAATIGAPAILAGLKGSSPSSASGQPQQPRKVGSRDTLA

SEQ ID NO: 379 - protein, 412 aa, Pseudomonas putida
MAIQSQRRSKVLPGLRDISEAKQWESFIVSMLKKLELPEAKRQAAERSYKRFGLHIAHKLGMSTDDVHVVVQGSMRTQTTIAGDGRENFDLDVVVKLSGSRFTNLTESEDFFQLFGGALQCIDGAGEPEPKNRCWRLPYPGEPFYFDVTPAIPLSAHITGTDLRVRDKNTVWSPSNPEDFANWFCAIAAKRFPFQMVAMDEAINMRTQVDPIPSAPVALDDILRRLVQLMKLHRDYHFKRQPAHIRETSPISIILVTLAGQAYDDLLQNHPYGLRSSIEVVMEIIARMPDFIDRRQGIRVNNPAMPGLVKENFADRWNTDGGARNKSFNEWHDRLSQDLEALFSVGQSTAAEERVRAIFGEAGVRAWKGSQEAAAATIGAPAILAGLKGSSPSSASGQPQQPRKVGSRDTLA

SEQ ID NO: 380 - protein, 414 aa, Pseudomonas putida
MNMAIQSQRRSKVLPGLRDISEAKQWESFIVSMLKKLELPEAKRQAAERSYKRFGLHIAHKLGMSTDDVHVVVQGSMRTQTTIAGDGRENFDLDVVVKLSGSRFTNLTESEDFFQLFGGALQCIDGAGEPEPKNRCWRLPYPGEPFYFDVTPAIPLSAHITGTDLRVRDKNTVWSPSNPEDFANWFCAIAAKRFPFQMVAMDEAINMRTQVDPIPSAPVALDDILRRLVQLMKLHRDYHFKRQPAHIRETSPISIILVTLAGQAYDDLLQNHPYGLRSSIEVVMEIIARMPDFIDRRQGIRVNNPAMPGLVKENFADRWNTDGGARNKSFNEWHDRLSQDLEALFSVGQSTAAEERVRAIFGEAGVRAWKGSQEAAAATIGAPAILAGLKGSSPSSASGQPQQPRKVGSRDTLA

SEQ ID NO: 381 - protein, 412 aa, Pseudomonas syringae
MAIQSQRRSKVLPGLRDISEAKQWESFIVSMLKKLELPEAKRQAAERSYKRFGLHIAHKLGMSTDDVHVVVQGSMRTQTTIAGDGRENFDLDVVVKLSGSRFTNLTESEDFFQLFGAALQGIEGAGEPEPKNRCWRLPYPGEPFYFDVTPAIPSSAHITGTDLRVRDKNTVWSPSNPEDFANWFCAIAAKRFPFQMVAKDEAINMRTQVDPIPTAPVALDDILRRLVQLMKLHRDYHFKRQPAHIRETSPISIILVTLAGQAYDDLLQNHPYGLRSSIEVVMEIIARMPDFIDRRQGIRVSNPAMPGLVKENFADRWNTDGGARNKSFNEWHDRLTQDLEALFSVGQSTAAEERVRAIFGEAGVRAWKGSQDAAAATIGAPAILAGLKGSSPSSASGQPQQPRKVGSRDTLA

SEQ ID NO: 382 - protein, 412 aa, Pseudomonas sp.
MAVQSQRRSKVLPGLREKSEARQWESFIVSMLKKLELPEAKRQAAERSYKRFGLHIAHKLGMSTDDVHVVVQGSMRTQTTIAGDGRENFDLDVVVKLSGSRFTNLTQSEGFFQLFGAALEGIDGAGEPEPKNRCWRLPYPGEPFYFDVTPAIPLSAHITGTDLRVRDKTSVWSPSNPEDFANWFCAIAAKRFPFQMIAMDEAINMRTQVDPIPNAPVALDDILRRLVQLMKLHRDYHFKRQPDHIRETSPISIILVTLAGQAYDDLLQNHPYGLHSSIEVVMEIIARMPDFIDRSHGIRVNNPAMPGFVKENFADRWNTDGGARNKSFNEWHERLTQDLEALFSVGQSKAAEERVRAIFGETGVRAWKGSQAAAAPAVTAPAILAGLKASSPTSSSGQPVQPRKTGSRDTLA

SEQ ID NO: 383 - protein, 407 aa, Pseudomonas syringae
MNMQLQRNSKILAKALKLRHEDKQWEIFIVSMLKKLELSTEKRSAAEARYEKFGHHVASKLGMNDDDVHVVVQGSMRTQTTIAGDGREKFDLDVVVKLSGPRFTGLRESEAFFQLFGESLRGIEGAGVPEAKSRCWRLPYPGERFYFDVTPAIPMSQGIIGTFLRVRDKETVWSPSNPEEFADWFCAIAGKKFPFQRTLLIKAEDARAKVDPIPQTPIGLDDILRRLVQLMKLHRDNYYRKLPDARGDARPISVILVTLATKAYDKMVSEEPNAFDSSIEVVLEVVARMPEFIERHALIRVDNPAMQGAHIENFADRWNKDGGARNREFEVWHNRLTQDLEALFSEEYSKRSEERVRAVFGELGVQAWKNTQPSASPNILSGLLASSGTASAQPQQPRKIGSRDTLA

SEQ ID NO: 384 - protein, 416 aa, Acidovorax delafieldii
MDLTTQSPQPRRRLRPVLESLAARNENQQWEDFIARMLLKLELSPEKRAAAVKRYEELGRHVARNMGIGETDAHVVVQGSMRTQTTIAGDGREKFDLDIVVKLCGAEFEGLRHSEDFFQNFGAALHGIEGAGPPKPKNRCWRLQYPGEPFYFDVTPAVPLSEEITGADLRVRDEKKVWSPSNPEEFADWFCTIANKRFTFQDRMVKSAIAVLDEARTTVDPLPQTKVPLDDILRRLVQLMKLHRDGYYKNLPEVRGDARPISVILVTLAAHAYNEMVLKERGNYSSAIEVALEVIDRMPKFIRRVNELAFVDNPALPGNAGENFADRWNTDGGLRAREFRTWHTQLVEDLEALFSEEYSKRSEGRVRAIFGEPGVKAWKDSQHKPGILGGLLATAPSQPRTQPQAPRSTGSRDTLA

SEQ ID NO: 385 - protein, 404 aa, Bordetella genomosp. 12
MSSYPAIPQKRSRVIAKAIALRNESQQWEEFIVRMLKKLELSEDKRDAATRRYKEFSNHIARAFDIETSDVHVVVQGSMRTQTTIAGDGREKFDLDVVVKLTGPKFSNLVYSEPFFQDFGAALRGIRDAGDPKAKSRCWRLQYPGEPFYFDVTPAIPMQAWIEGTILKVRDPELVWSPSNPEEFADWFCAIANRRFPFQTIRKAFAVDARTTVDPIPQERIGLDDILRRLVQLMKLHRDSYYKQQADYRQAAKPISVILVTLAAKAYKELIENDLHGFTSAIEVALEVVARMPDFIDRNGHAYSINNPALPGTVRENFADKWNSDGGLRAREFETWHTRLENDLEALFSEEYSKRSENRVQAIFGQQGVQAWKASQGAGPLAGLLSGVSVPSGPRKSSASDTFA

SEQ ID NO: 386 - protein, 398 aa, Bordetella genomosp. 12
MPQKRSRVIAKAIALRNESQQWEEFIVRMLKKLELSEDKRDAATRRYKEFSNHIARAFDIETSDVHVVVQGSMRTQTTIAGDGREKFDLDVVVKLTGPKFSNLVYSEPFFQDFGAALRGIRDAGDPKAKSRCWRLQYPGEPFYFDVTPAIPMQAWIEGTILKVRDPELVWSPSNPEEFADWFCAIANRRFPFQTIRKAFAVDARTTVDPIPQERIGLDDILRRLVQLMKLHRDSYYKQQADYRQAAKPISVILVTLAAKAYKELIENDLHGFTSAIEVALEVVARMPDFIDRNGHAYSINNPALPGTVRENFADKWNSDGGLRAREFETWHTRLENDLEALFSEEYSKRSENRVQAIFGQQGVQAWKASQGAGPLAGLLSGVSVPSGPRKSSASDTFA

SEQ ID NO: 387 - protein, 403 aa, Unknown
  Description of Unknown: gamma proteobacterium sequence
MNIQVQSPSALIAKSLLERNEARQWETFIVSMLKKLELSAENQEKAKRRYAQFAHHIAQKLGVDDDDVHVVVQGSMRTQTTIAGTGREKFDLDVVVKLCGPRFENLLYSDAFFADFGKALRGLEGAGDPQPKNRCWRLPYPGEPFYFDVTPAIPLSEQITGTHLRVRDEEEVWSPSNPEEFADWFCAIANKRFIQRAMNRAAMEGFKVDPLPEQPVGIDDVLRRMVQLMKLHRDSYYKKQSDARRAAKPISVILVTLAAKAYDQIATSGAYTTSSAIEVALELVARMPQFITYGEEIRVENPAMPGVHGENFAEKWNTDNGLRAREFSTWHEALMQDLAALFAEEYSKRSEERVRAVFGEVGVDAWEASQAGGILAGLRATAPGLSGTQPAAPRSTASSNTLA

SEQ ID NO: 388 - protein, 407 aa, Pseudomonas sp.
MLPMFEPKTRLLAKTIQVANEETQWESFIVKLLKKLELPEEKRRAAEARYYELARHVAHKLNMGEENVHVVVQGSMRTQTTVAGYGPEKFDLDIVIKVHGGPLSVMPPDMFFNTFGEALRGIPGAGEPEAKNRCWRLRYPGESLYFDVTPAVPVSYAITGADLRVRDQEKGWSPSNPEEFASWFCSIAQLRFAFEQRRWLIKAEDAAVKVDPLPSEPVRIDDILRRLVQLMKLHRDSYFRKLPDERRMAMPISVILVTLATKAYQDMATQEPNAFVSAIDVVLEVVERMPGYIKRDRQFEVNNPALEGPYPENFADKWNHDGGLRAREFNTWHRQLSDDLFALFVAGYSKRSEEKIRAVFGEVGVSGWKEMQPQPTGILGGLLATAPGNSATQPQRPRSTGERDTLA

SEQ ID NO: 389 - protein, 407 aa, Acidovorax sp.
MTTNPPVLSKRISDALAARKEGAQWESFIVSMLQKLELSPSERAKAVKRYDELARHIARKLSVSDVDVHVVVQGSMRTQTTTAMWGNTKFDLDIVVKLSSSRFSGLKESEGFFQEFGLALRGVPEAGEPVAKNRCWRLQYPGEPFYFDVTPAIPLSAGIVGTDLRVRDPKTIWSPSNPEEFASWFCKIAEGRFPFQRQQVIKAADARTQVDPVPTGRVGIDDILRRTVQLVKLHRDNYYRGLSEHRRDGMPISVILVTLASSAFRDMLAREATSFGSAIEVAVEIVDRLPKYIDRSRSKVQVMNPALSGPVGENFADRWNGDGGVRSHEFSTWHAQLVTDLEALFADQHTKKDEGRVKRIFGEHGVQAWKDGLAAGGLMEGLLNTLPAEPRSNPQNPVPTGSRNQLA

SEQ ID NO: 390 - protein, 394 aa, Acidovorax sp.
MGPYRGVLFHWTMTIGMLSKLELPEEKRAKAIQKYEDLQKHIAKKLHVDETSVHVIVQGSMKTQTTIAMYGNTKFDLDIVVKLSSPKYANLGESEQFFQDFGESLKGVDGAGEPSAKSRCWRLQYPHESFYFDVTPAIPTSHQFTGTELRVRDPETIWNPSNPEEFADWFCGIANKRFHFQEGVAVAKSMVLEDFKADPVPTEPIRIDDILRRTVQLLKLHRDNYYRGKPDERRAAMPISVILVTLAATAYDEMVTKEKQAFTSAIEVALEVADRLPKYIQYVTGIYSVMNPALPTSHGENFAERWNKDGGARKIEFYGWHTQLKKDLEALFSDEHTRRGEKNIQNVFGDHGVKAWRAGLHATGALGGLLGTLPAEPRSNPTRPIPAGSKDQLA

SEQ ID NO: 391 - protein, 377 aa, Propionivibrio dicarboxylicus
MEMLQKLELSQEERARATARYEALGRHVAAKLDMADADAYVFVQGSMRTQTTVSPRGNQNFDLDIVVKLTGPKVHGITNPEPFFQAFGSALKGIHGAGEPTQKRRCWRLNYPGEPFYFDVTPALPDSRSMGLSVATDLRVRDPDTRWSPSNPEEFADWFCTIADKRFSFHRELREMLAKADTQVTPIPDTPVGIDDILRRGIQLMKLHRDNYYWNLSEERKDAKPISVILVTLAGHAYNNMVTHEQTAYSSPIEVLLELVDRMPRGIFTDGRSYCVSNPALTMENFADRWNSDRGLRAREFNTWHKQLVADLEALFSEEYSKKSEARIRSVFGQYGVDAWKASMPTSPLQGLLAAVPGQPRTNPTTVRPQGSKNTLA

SEQ ID NO: 392 - protein, 405 aa, Propionivibrio dicarboxylicus
MTTANSYAKRIFDALQARQERVQWEAFIVEMLQKLELSQEERARATARYEALGRHVAAKLDMADADAYVFVQGSMRTQTTVSPRGNQNFDLDIVVKLTGPKVHGITNPEPFFQAFGSALKGIHGAGEPTQKRRCWRLNYPGEPFYFDVTPALPDSRSMGLSVATDLRVRDPDTRWSPSNPEEFADWFCTIADKRFSFHRELREMLAKADTQVTPIPDTPVGIDDILRRGIQLMKLHRDNYYWNLSEERKDAKPISVILVTLAGHAYNNMVTHEQTAYSSPIEVLLELVDRMPRGIFTDGRSYCVSNPALTMENFADRWNSDRGLRAREFNTWHKQLVADLEALFSEEYSKKSEARIRSVFGQYGVDAWKASMPTSPLQGLLAAVPGQPRTNPTTVRPQGSKNTLA

SEQ ID NO: 393 - protein, 396 aa, Cupriavidus sp.
MASLLARQQAEQWESFIVSMLQRLELDAKELARAKMHYDLLARQIAHKLHVADTDVHVVVQGSMRTQTTISPRGNAKFDLDIVVKLTGGAFDKLDSETFFSRFGDALRGLNDAAGDPKPKARCWRLDYAGEPFYFDVTPALPGSQIITGTDLRVRDPKTKWSPSNPEEFADWFCKIAGLCFSFESQMAKALVFDHAQVDPIPSTPVGIDDVLRRTVQLIKLHRDNYYYGSIVSDARKEAKPISVILVTLATHAYNDLWLTKRSAFASPIELVLELVEQLPKRIERLNGKHWVANPALPKENFAERWNEDGGLRAKEFAIWHEQLTSDLELLFNEDYNAKSEERIRRVFGRHGVDSWQASTKSSGLGVLGGLRKTVPAQPRSNPSSPTAVGSRNTLA

SEQ ID NO: 394 - protein, 407 aa, Cupriavidus sp.
MNQKLSLSKSVIASLVVRQQTQQWESFVVSMLKRLELDASELARAKAHYDILAQQLARKLDIADTDVHIVVQGSMRTQTTISPRGNAKFDLDIVVKLTGGLFDGTDSETFFARFGEALTGLNDSAGEPKPKPRCWRLEYTGEPFYFDVTPALPGSQLITGTDLRVRDPKTKWSPSNPEEFADWFCHIADLRFGFERRVMKGFALDHAQIDPIPSAPVEIDDVLRRTVQLIKLHRDNYYYGASISRERKEAKPISVILVTLATHAYQDLWMKDKSAFASPIELVLEIVDQLPHRIERANGKFRVANPALTRENFAERWNEDGGLRAKEFQSWHTQLTGDLELLFNEDYDSKSEQRIRSVFGQHGVDSWKASRATPAAGVLAGLRATAPAQPRSNPSSPMPVGSKNTLA

SEQ ID NO: 395 - protein, 396 aa, Cupriavidus sp.
MASLVVRQQTQQWESFVVSMLKRLELDASELARAKAHYDILAQQLARKLDIADTDVHIVVQGSMRTQTTISPRGNAKFDLDIVVKLTGGLFDGTDSETFFARFGEALTGLNDSAGEPKPKPRCWRLEYTGEPFYFDVTPALPGSQLITGTDLRVRDPKTKWSPSNPEEFADWFCHIADLRFGFERRVMKGFALDHAQIDPIPSAPVEIDDVLRRTVQLIKLHRDNYYYGASISRERKEAKPISVILVTLATHAYQDLWMKDKSAFASPIELVLEIVDQLPHRIERANGKFRVANPALTRENFAERWNEDGGLRAKEFQSWHTQLTGDLELLFNEDYDSKSEQRIRSVFGQHGVDSWKASRATPAAGVLAGLRATAPAQPRSNPSSPMPVGSKNTLA

SEQ ID NO: 396 - protein, 404 aa, Unknown
  Description of Unknown: Variovorax sequence
MNQSLSLAKSIAAELAARQQTRQWETFILSMLTRLELDPSERSRAEAHYQVMARHIASKLGIGDNDVHVVIQGSMRTQTTISPRGNAKFDLDVVVKLTGSRFDNIQAEAFFEEFGKALKGLPEAAGEPEARRRCWRLQYPGEPFYFDVTPAIPGSLEITGTDLRVRDPDTVWSPSNPEDFADWFCAIAQLRFAFQQGGGRVVTMDGRSQVDPLPNRAISLDDVLRRTVQLIKLHRDNHYHLLPAERKEAMPISVILVTLAGHVYRELHASRPNGFSSPIELALEVVDQLPRYIDRSKGNYRVPNPGLAHENFADRWNHDGGARASEFSHWHARLKDDLALLFHEDYDSRSAERIRSVFGQAGVDAWKASLPASNDVLKGLRATVPVQPRDPSSPTPMGSRKTLA

SEQ ID NO: 397 - protein, 393 aa, Burkholderia pseudomallei
MEKVAADQEARQWEELMVQLLSKLELSEEERGRASGHYDTLAKQVARKLGVGETDVHIVVQGSMRTQTTVAPRGREKFDLDIVVKMDGDRFIGIDPDEFFKEFGDSLRGLNNAAGDPKPKPRCWRLQYPNEPFYFDVTPALPGSFDITGTDLRVRDPDTGWSPSNPEDFADWFCEAAEQKFQFQMLLKVAMDARHQIEDVPSDPVAIDDILRRTVQLIKLHRDLMYHGASDGVKEGKPISVILVTLATWAYNDVYQDRHLYSNAIEVLLDVVERMPEYIEFDDGVYTVRNPKHPDENFAERWNGDDGVRASAFYRWHEKLQSDLTALFSDSYSRSTEERIRKIFGQHGVDAWKASIAPATSGLLNSLMKSVPGGERRDPVTPVPPGSRKDTLA

SEQ ID NO: 398 - protein, 404 aa, Burkholderia ubonensis
MDSKRTLAKAFMEKVAADQEARQWEELMVQLLSKLELSEEERGRASGHYDTLAKQVARKLGVGETDVHIVVQGSMRTQTTVAPRGREKFDLDIVVKMDGDRFIGIDPDEFFKEFGDSLRGLNNAAGDPKPKPRCWRLQYPNEPFYFDVTPALPGSFDITGTDLRVRDPDTGWSPSNPEDFADWFCDAAEQKFEFQQLLKKALEARQQIDEMPSDPVAIDDILRRTVQLIKLHRDLMYHGASDAAREGKPISVILVTLATWAYNDVYQDRHLYSNAIEVLLDVVERMPEYIEFDDGVYTVRNPKHPDENFAERWNGDDGLRASAFYRWHEKLQSDLASLFSDSYSRGTEERIRKIFGQHGVDAWKASIAPATSGLLNSLMKSVPGGERRDPVTPVPPGSRKDTLA

SEQ ID NO: 399 - protein, 404 aa, Burkholderia cepacia
MNSKRTLAKAFMEKVAADQEARQWEELMVQLLSKLELSEEERARASGHYDTLAKQVARKLGVGETDVHIVVQGSMRTQTTVAPRGREKFDLDIVVKMDGDRFIGIDPDEFFKEFGDSLRGLNNAAGDPKPKPRCWRLQYPNEPFYFDVTPALPGSFDITGTDLRVRDPDTGWSPSNPEDFADWFCDAAEQKFEFQQLLKKALEARQQIDEMPSDPVAIDDILRRTVQLIKLHRDLMYHGASDAAREGKPISVILVTLATWAYNDVYQDRHLYSNAIEVLLDVVERMPEYIEFDDGVYTVRNPKHPDENFAERWNGDDGLRASAFYRWHEKLQSDLAALFSDSYSRSTEERIRKIFGQHGVDAWKASIAPATSGLLNSLMKSVPGGERRDPVTPVPPGSRKDTLA

SEQ ID NO: 400 - protein, 404 aa, Burkholderia pseudomallei
MNSKRTLAKAFMEKAAADQEARQWEELMVQLLSKLELSEEERGRASGHYDTLAKQVARKLGVGETDVHIVVQGSMRTQTTVAPRGREKFDLDIVVKMDGDRFIGIDPDEFFKEFGDSLRGLNNAAGDPKPKPRCWRLQYPNEPFYFDVTPALPGSFDITGTDLRVRDPDTGWSPSNPEDFADWFCDAAEQKFEFQQLLKKALEARQQIDEMPSGPVAIDDILRRTVQLIKLHRDLMYHGASDAAREGKPISVILVTLATWAYNDVYQDRHLYSNAIEVLLDVVERMPEYIEFDDGVYTVRNPKHPDENFAERWNGDDGLRASAFYRWHEKLQSDLAALFSDSYSRSTEERILKIFGQHGVDAWKASIAPAKSGLLNSLMKSVPGGERRDPVTPVPPGSRKDTLA

SEQ ID NO: 401 - protein, 404 aa, Burkholderia vietnamiensis
MNSKRTLAKAFMDKAAADQEARQWEELMVQLLSKLELSEEERRRAVAHYGVLAKQVARKLGVGETDVHIVVQGSMRTQTTVAPRGNEKFDLDIVVKLGGKHFIGVDPDDFFADFGDALRGLNDAAGDPKPKPRCWRLQYVGEPFYFDVTPALPDSFGITGTDLRVRDPETGWSPSNPEEFADWFCEAANQKFTFQRVVKATMDAAHQIDDVPEKPVAIDDILRRTLQLIKLHRDLMYRGASDEVKEGKPISVVLVTLATWAYKAVYRDRHLYSNAIEVLLDVVERMPDFIDFGGGRYSVRNPQHDDENFAERWNEDGGKRARAFYSWHKQLQTDLAALFSDSYSRGNEERVRKIFGQHGVDAWKASIAPTATGLLNSLMKSVPGGERREPVTPVPSGSRKDTLA

SEQ ID NO: 402 - protein, 404 aa, Burkholderia multivorans
MNSKRTLAKAFMEKVAADQEARQWEELMVQLLSKLELSEEERGRAVAHYGVLAKQVAHKLGVGETDVHIVVQGSMRTQTTVAPRGNEKFDLDIVVKLGGEHFIGIDPDEFFTDFGNALRGLNDAAGDPKPKPRCWRLQYVNEPFYFDVTPALPDSFGITGTDLRVRDPDTGWSPSNPEEFADWFCEAANQKFVFQRMLKAAMDAAHQIDDVPSNPVAIDDILRRTLQLIKLHRDLMYRGASDEVKEGTPISVVLVTLATWAYKAVYLDRHMYSNAIEVLLDVVERMPDFIDFDGQRYSVRNPRHEDENFAERWNEDGGKRARAFFSWHNQLRTDLAALFSDSYSRSNEERVRKIFGQHGVDAWKASIAPTATGLLNSLMKSVPGGERREPVAPVPSGSRKDTLA

SEQ ID NO: 403 - protein, 404 aa, Burkholderia diffusa
MNSKRTLAKAFMEKAAADQEARQWEELMVQLLSKLELSEEERDRAVAHYGLLAKQVARKLGVGETDVHIVVQGSMRTQTTVAPRGNEKFDLDIVVKLGGEHFIGIDPDQFFTDFGDALRGLNDAAGDPKPKPRCWRLQYVNEPFYFDVTPALPDSFGITGTDLRVRDPETGWSPSNPEEFADWFCEAANQKFVFQRMLKAAMDAAHQIDDVPENPVAIDDILRRTLQLIKLHRDLMYRGASDEVKEGKPISVVLVTLATWAYKTVYQDRHMYSNAIEVLLDVVERMPDFIEFDGERYSVRNPRHEDENFAERWNEDDGKRARAFYSWHKQLQADLAALFSDSYSRSNEERVRKIFGQHGVDAWKASIAPAATGLLNSLMKSVPGGERREPVTPVPSGSKKDTLA

SEQ ID NO: 404 - protein, 404 aa, Burkholderia cepacia
MNGKRTLARAFMDQASVDQEARQWETLVVELLSKLELKDDEKERAVKHYETLARQVARKLGVGETDVHIIVQGSMRTQTTVAPRGREKFDLDIVVKLTGERFHAVDPDEFFNDFGDALRGLNDAAGEPKAKPRCWRLQYVNEPFYFDVTPALPDSVGITGTDLRVRDPDTGWSPSNPEEFADWFCEAANQRFTFQKRLAMVMDATQQIDDVPSDPVAIDDILRRAVQLIKLHRDLLYYGVSDDEKEGKPISVILVTLATWAYKTAYLNRNAFSNAFEVLLDVVERMPDYIEFDGTEYRVCNPSHDEENFAERWNEDGGKRATAFYRWHSQLKVDLEALYADSYSRSSEDRIRKIFGQHGVDAWKASIAPATSGLLSSLMKSVPGGERRDPVTPVPLGSRKDTLA

SEQ ID NO: 405 - protein, 404 aa, Paraburkholderia fungorum
MTNNRTLAKAFMEKATFDQEARQWEELMAGLLSKLELSKEERDRARAHYQTLARQVARKLEVDETDVHIVVQGSMRTQTTVAPRGRQKFDLDIVVKLGGDHFSGVDSDEFFNAFGDSLRGLNDAAGEPKPKARCWRLQYANEPFYFDVTPALPGSYEITGTDLRVRDPKTHWTPSNPEDFADWFCEAAKQKFGFQSVRLTKAEARHQIDDLPSEKVAIDDILRRTVQLIKLHRDLQYYGKSDEVKEGQPISVILVTLATHAYNAAIVNRHMYSNAIEVLLDVVEGMPDFIAFHSGRYSVCNPGHVGENFAERWNEDEGKRARAFYGWHEQLKSDLKALFADSYSRSGEAQIRKVFGEDGVQAWKASFAPAPSGLLNSLIRSGPGGERRDPVVPVPSGSKKNTLA

SEQ ID NO: 406 - protein, 404 aa, Pandoraea pnomenusa
MDSAGDRGIALESFAKARTQFEPYARALDLVNKHITIRPEDIKDASAAYQELAEKLVEKLQWPSGAIRVFPQGSASTQTLIRSPDRTKFDIDAVCRVVIDAGYVSNPLTFFDDVGKGLEGLVVEAKNRCWKVNFPNRPYYIEFTPSVPLESVHIDKNGNDLRRLVAPGYIDTALAVVDRETKTWKTSNPEGLVKWVDEASKYKLVRVVMLKAALEHVMDSVRPVSEQEIAVDDTLRIAIRLFKRHRDMSVFHGHIDRQFQPISVILVTLLTQMYYGLAELGRTFENSVQLLVQLAELLPHMVPSYPTYGYFIGNPTVEGENFAERWNTDEGERAETFAKWCKLLRYDLETILSAADEKTIEEKARKVFGCTRDTGPSDGGGGGGGVSVSPTRRPPPPPRTQGLA

SEQ ID NO: 407 - protein, 428 aa, Pandoraea pnomenusa
MIKMSNAQLVEAAFRQRSAASAVVMDSAGDRGIALESFAKARTQFEPYARALDLVNKHITIRPEDIKDASAAYQELAEKLVEKLQWPSGAIRVFPQGSASTQTLIRSPDRTKFDIDAVCRVVIDAGYVSNPLTFFDDVGKGLEGLVVEAKNRCWKVNFPNRPYYIEFTPSVPLESVHIDKNGNDLRRLVAPGYIDTALAVVDRETKTWKTSNPEGLVKWVDEASKYKLVRVVMLKAALEHVMDSVRPVSEQEIAVDDTLRIAIRLFKRHRDMSVFHGHIDRQFQPISVILVTLLTQMYYGLAELGRTFENSVQLLVQLAELLPHMVPSYPTYGYFIGNPTVEGENFAERWNTDEGERAETFAKWCKLLRYDLETILSAADEKTIEEKARKVFGCTRDTGPSDGGGGGGGVSVSPTRRPPPPPRTQGLA

SEQ ID NO: 408 - protein, 444 aa, Ralstonia solanacearum
MAMSKNAQLVEQAIRRRGGVAELTKSMGIAMDGLSEGVLVTAQRSDMVAKIIRMREPFAHALSLINDHITVRQEEIEAASAAYGDIARRLVDKLDWPIDAINIHPQGSASTKTLIRMPDRTKFDIDAVCEVDITKLQAQDPMTFFGAIGEALDGLEVEPKKRCWKINFSGKPFYIECTPSVPLATIPVAQHESSRLRPAEPEFASTALAVVDTPQKKWKTSNPAGIRNWVDRVSARTIVARMVREAFAKSASASIQPVSTQSVEVEETLRLAIRLFKRHRDMRVYRNEIDKEFQPISIILVTLVTICYDGLADLIDAGVLLPFAHPVDALIAIADLLPEMIPKYPDVGYQLANPTVVGENFAERWNDDDGERAQTFDVWCGLLRADLERIAALTDPKEIEAETREVFGCHASSGPTGSGGSGGSGPYISVPRPPKPAPSTPGLA

SEQ ID NO: 409 - protein, 444 aa, Ralstonia solanacearum
MAMSKNAQLVEQAIRRRGGVAELTKSMGIAMDGLSEGVLVTAQRSDMVAKIIRIREPFAHALSLINDHITVRQEEIEAASAAYGDIARRLVDKLDWPIDAINIHPQGSASTKTLIRMPDRTKFDIDAVCEVDITKLQAQDPMTFFGAIGEALDGLEVEPKKRCWKINFSGKPFYIECTPSVPLATIPVAQHESSRLRPAEPEFASTALAVVDTPQKKWKTSNPAGIRNWVDRVSARTIVARMVREAFAKSASASIQPVSTQSVEVEETLRLAIRLFKRHRDMRVYRNEIDKEFQPISIILVTLVTICYDGLADLIDAGVLQPFAHPVDALIAIADLLPEMIPKYPDVGYQLANPTVVGENFAERWNDDDGERAQTFDVWCGLLRADLERIAALTDPKEIEAETREVFGCHASSGPTGSGGSGGSGPYISVPRPPKPAPSTPGLA

SEQ ID NO: 410 - protein, 448 aa, Ralstonia solanacearum
MALTKNAQLVEQAIKRRGGVAELTKSMGIAMDSLSHTYADSVYGSVERADLTTKIIRQREPFAHALSIVNDHITVRPEEIEAASAAYDGIAQRLVEKLDWPIEAISIHPQGSASTKTLIRMPDRTKFDIDAICEVDITKVQAQDPMTFFAAIGTALDGLEVVAKNRCWQIKYNGEPFYIECTPSVPLATIPASQREASHLKPAMPEFASTALAVVDTPLKKWKTSNPAGIRNWVERVSARNIVANLVLEEFTKSARANIQPVLPQSVEVEETLRVAIRLFKRHRDMRVYRQEIAKDFQPISIILVTLVTICYDGLADLIDEGVLQPFPHPVDALVAIADLLPEMIIDYPGTGYQLANPTVVGENFAERWNNDDGERAQTFDVWCGLLRADLERIAALTDPKEIEAETREVFGCHASSGPTGSGGSGGSGPYISVPRPPKPAPSTPGLA

SEQ ID NO: 411 - protein, 444 aa, Ralstonia solanacearum
MAMTKNAMLVEQAIKRRGGVSELTKSVGIAMDGFSEGALVSAQRSDMTAKIIRMREPFAHALSLINDHITVRQEEIEAASAAYEDIARRLVNKLGWPVDAINIHPQGSASTKTLIRMPDRTKFDIDAVCEVDITKLQAQDPMTFFGAIGEALDGLEVEAKKRCWKINFSGKPFYIECTPSVPLATIPVSQQESSRLKPAEAEFANTALAVVDTPQKKWKTSNPAGIRNWVDRVSARTIVARVVLEAFAKSASASIQPVSTQSVEVEETLRLAIRLFKRHRDMRVYRNEIDKEFQPISIILVTLVTICYDGLADLIDAGALQPFAHPVDALIAIADLLPEMIPNYPDLGYQLVNPTVVGENFAERWNDNDGERAQTFDVWCGLLRADLERIAALTDPKEIEAEAREVFGCHAENNPPGSGSSGGSGPFISIPRPPSPAPSTPGLA

SEQ ID NO: 412 - protein, 444 aa, Burkholderia pyrrocinia
MALTKNAMLVEQAIKRRGGVAELTKSMGYAMDEMPGGLLDSVSRADSVAKITRKLEPFAHALSLVNDHITVREEEINEASAAYDEIANRLVNKLDWPIDAISVHVQGSASTKTLIRSPDGSKFDIDAICEVDITKVQARDPMAFFEAIGSALDGLEVEPKKRCWKINFRGKPFYLECTPSVPLDTIPATQQEASHLKLAEPEFASTALAVVDTPEEKWKTSNPAGIRNWVDRVAGRTVVKQVLLDSVTKSASANIQPVGTQSVEVEETLRVAIRLFKRHRDMRVYRKEIDGEFQPISIILVTLVTTCYDGLADLIDAGELPSFAHPVDALIAIADLLPEMIPNYPDLGYYLANPTVVGENFAERWNEDDGERAHAFDAWCGLLRGDLERIGALTDPKKIEAETREVFGCHAGSGPTGSGGSGGSGPFISIPRPPKPAPSTPGLA

SEQ ID NO: 413 - protein, 432 aa, Unknown
  Description of Unknown: Burkholderia sequence
MTLTKNATRVKTALARRGDQLFAKAAAVAADSMTLESYRSTEEILEPYARALSVINDHITVPKSEIDEAAAAYDLIANRLVERLGWPRDAIRIHPQGSASTRTLIRAPGAAKFDIDAVCEVDISRIEARDPMAFFDAAGQALDGLDVEKKKRCWCIKFAEKRFYLEFTPSVPLATVPAGMIEIQGLRAFLEAEYEDTALAVVDTPTQRWKTSNPAGLCEWIEKVAGRALVASLVLEELRKSATAGVTTVPNQSVKIDETLRVAIRLFKRHRDMCVRRGLIDSETQPISIILVTLLTICYDGLADLIEAREIPMFPHPVDVLIGIADLLPNMIPPHPDFGYSLINPTVHSENFAEKWNHDDGERADSFATWCGILKADLVSIRATADPREIEKKAREVFGCPADSKPGHAGGPGPATGVPRPPSAAPRTSGLA

SEQ ID NO: 414 - protein, 442 aa, Herbaspirillum sp.
MGLTKNAMFVEAAIKRRGGIAVMAKSLTPSTEGSSVVFDSATEPTTYRNLKQKREPYSHSLSVVNDHITVKQELIDDASAAYEEIAQLLTSKLGWPPEAIRIFPQGSASTKTLIRTLGNQKFDIDAVCEVDISKVEARDPMAFFDEIGMALDGLDIEPRRRCWTVKMIDQRFYLEFTPSVPLTTVPLTERQHRGLKQSEQEFVTTALAVVDRPSENWKTSNPAGIRDWVNRAAYKSIVLSPVVEAYDSVRASIDPIEKQSVEIEETLRVAIRLFKRHRDMCVARGHLEFETQPISIILVTLLTRCYEGLAELIQEGVRPPFVHVVDALIAIADLLPEMIPQNPDWGYYLPNPTVVDENFAERWNTDDGERAEAFQIWCGLLQADLAAIAALTDSKKIMQKTLEVFGCTNASTGSNGTGGGNNPGPRVVPSAPAPAPRTSGLA

SEQ ID NO: 415 - protein, 442 aa, Herbaspirillum frisingense
MGLTKNAMFVEAAIKRRGGIAVMAKSLTPSTEGFSVVFDSATEPTTYRNLKQKREPYAHSLSVVNDHITVKQELIDDASAAYEEIAQLLTSKLGWPPEAIRIFPQGSASTKTLIRTLGNQKFDIDAVCEVDISKVEARDPMAFFDEIGMALDGLDIEPRRRCWTVKMIDQRFYLEFTPSVPLTTVPLTERQHRGLKQSEQEFVSTALAVVDRPSENWKTSNPAGIRDWVNRAAYKSIVLSPVVEAYNSVRASIDPIEKQSVEIEETLRVAIRLFKRHRDMCVSRGHLEFETQPISIILVTLLTLCYEGLAELIQEGVRPPFVHVVDALIAIADLLPEMIPQNPDWGYYLPNPTVVDENFAERWNTDDGERAEAFQIWCGLLQADLAAIAALTDPKKIMQKTLEVFGCTNASTGPNGTGGGNDPGPRVVPSAPAPAPRTSGLA

SEQ ID NO: 416 - protein, 441 aa, Burkholderia ubonensis
MALTRNAMLVEAAIKRRIGSAVLAKSLTPSMEGLDAVLFDSVERPEKRASIGRKREPYAHALSLVNDHITVRQDVIDEASAAYNDIANRLASKLNWPLSAIKIFPQGSASTKTLIRTIGNRKFDIDAVCEVDISRIEARDPMAFFHAIGTALDGLNAESKKRCWSINIVDKPFYLEFTPSVPLRTVPLTGRQMHGLNNAELEFVSAALAVVDTPLKNWKTSNPAGIRDWVNRASERSIVLEPVTEAYDSVRASIEPVARQSVEVEETLRVAIRLFKRHRDIRVHRGYLTAEAQPISIILVTLLTTCYEGLADLIDDGTRAPFAHVVDALIALAELLPDMIPHYPDLGYYLANPTVVDENFAERWNTDEGERAEAFRTWCGLLRADLVAIAALDDPEEMTAKTLEVFGCTAAGGPKGGSGNSGPRVTLPSPPPPAPRTSGLA

SEQ ID NO: 417 - protein, 440 aa, Acidovorax avenae
MARTKNAVLVESAIQRSGGIAALTRVLNPSLEGFAVARSMTFDSASPRANVKEKREPYAHALSLVNDHITVKEEVIEEARAAYTGIATLLAEELKVRQQDIKIFPQGSASTRTLIRTVGNRNFDIDAVCEVDISAAEAKDPMAFFEAVGAALKGKDAQRKRRCWTVNFAGKPYYVEFTPSVPLASVALSAKQKDSLERKEHQFLDTALAVVDTPSKSWKTSNPAGIRDWVNRAAERHIVVQELVKACESIQASIEPVGTQSVEVEETLRVAIRLFKRHRDMCVHRGHLESEYQPISIILVTLLTTCYEGLADLLQQSAIPPFPHVVDALIAIANLLPEMIPKYPDGHYYLDNPTVVDENFAERWNTDADQRAEAFRTWCTILRDDLQKIVAQTDPAKITTTTLEVFGCQSAASPKGGNGNPGLDMVPPTPKAAPVTSGLA

SEQ ID NO: 418 - protein, 440 aa, Castellaniella caeni
MVRTKNAVFVENAIQRSGGIAALTKILNPSQEGLAAARSGAFDSANLRANVKESREPYAHALSLVNDHITVKDEVIEEARVAYTGIATLLVEKLKLRQQDVNIFPQGSASTRTLIRTVGNRNFDIDAVCEVDISAAEAKDPMAFFEAIGAALEGKGAECKRRCWTINFPGKPYYVEFTPSVPLSTVPLTSSQKNSLERNEHQFLDTALAVVDTPSRNWKTSNPAGIRDWVNRASERNIIVQELVKACESIQAHIEPVSAQSVEVEETLRVAIRLFKRHRDMCVHRGYLELEYQPISIILVTLLTTCYEGLADLLQQGAIPPFSHAVDALIAIANLLPEMIPQYPDGHYYLENPTVVDENFAERWNTDEGQRAEAFRRWCTILRDDLQKIVAQTDPAKITATTFDVFGCTNADRPKGGNGNPGLGVVPPTPKAAPVTSGLA

SEQ ID NO: 419 - protein, 382 aa, Aromatoleum aromaticum
MAYSPWARALNEANLHITVRPEEIAAAAEAYREVAGLLVAKLDWPNDTIRILPQGSASTQTLIRSPFGGEKFDIDAVCQVDISRVAAQDPMGFFQSVGDALEELEAEAKKRCWNIPFPNRPFYLEFTPSVPLNNVPQYTMESMAPRYRAAFAYRATALAVVDTPTERWKTSNPAGITKWVDDTAKRSLIRQVSMETAVLREAKAEVAPVPEQAVEITDTLRVAIRLFKRHRDMCVRRGIIAGEAKPISIIIVTLLTSCYEGLADLGRVYAHPVELLDDLASLLPHLVLKLEDQYRVDNPTVEGENFAEKWNHDGGTRYRAFVAWCNALSADLETILALSEPQEISTRVREVFGIPAPTTDGTGLSSARYPAPPPTRPGRGLA

SEQ ID NO: 420 - protein, 427 aa, Aromatoleum aromaticum
MTLTKSADLVLQAERTRPARLTESLESIAALRNDGLTRSAERDLLLAYSPWARALNEANLHITVRPEEIAAAAEAYREVAGLLVAKLDWPNDTIRILPQGSASTQTLIRSPFGGEKFDIDAVCQVDISRVAAQDPMGFFQSVGDALEELEAEAKKRCWNIPFPNRPFYLEFTPSVPLNNVPQYTMESMAPRYRAAFAYRATALAVVDTPTERWKTSNPAGITKWVDDTAKRSLIRQVSMETAVLREAKAEVAPVPEQAVEITDTLRVAIRLFKRHRDMCVRRGIIAGEAKPISIIIVTLLTSCYEGLADLGRVYAHPVELLDDLASLLPHLVLKLEDQYRVDNPTVEGENFAEKWNHDGGTRYRAFVAWCNALSADLETILALSEPQEISTRVREVFGIPAPTTDGTGLSSARYPAPPPTRPGRGLA

SEQ ID NO: 421 - protein, 424 aa, Unknown
  Description of Unknown: Enterobacteriaceae sequence
MNKTKSAELVIHAEQTRFDRLTNSFESYAGVMDGVASDSTRSQPEYRHWEKALNEVNTHIAVREEEIEAAKGAYQEVAELLAANLSWPPEAISILPQGSVSTKTLIRSPNGGEKFDIDAVCQIDISRIEASEPMVFFESIGKALIELNAQAKRRCWNLPFPQQPFYLEFTPSVPLNTVPQNIYESMAPRYRAVRYTETALAVVDTPTTSWKTSNPAGMSKWVDDTSKRALILVPAMESFSKGRFMDSISPVPDQTVEITDTLRVAIRLFKRHRDMCVRRGLIERGTKPISVIIVTLLTTCYEGLADLGRVFRHPVEVLDELAVYMPHLLLQLDGKYRVDNPTVEGENFAEKWNDDEGERYRSFMTWCDALSADLKTILALTEPQAITKRVREVFGIPAPTGGGNGLPTIETPKPKATPVTTGLA

SEQ ID NO: 422 - protein, 424 aa, Pectobacterium polaris
MNKTKSAELVIHAEQTRFDRLTNSFESYAGVMDGVASDSTRSQPEYRHWEKALNEVNTHIAVREEEIEAAKEAYQEVAELLAANLSWPPEAISILPQGSVSTKTLIRSPNGGEKFDIDAVCQVDISRIEASEPMVFFESIGKALIELNAQAKRRCWNLPFPKQPFYLEFTPSVPLNTVPQNIYESMAPRYRAVRYTETALAVVDTPTTSWKTSNPAGMSKWVDDTSKRALILVPGMESLAEGRFMDSISPVPDQTVEITDTLRVAIRLFKRHRDMCVRRGLIERGTKPISVIIVTLLTTCYEGLADLERVFRHPVEVLDELAVYMPHLLLQLDGKYRVDNPTVEGENFAEKWNDDEGERYRSFMTWCDALSADLKTILALTEPQAITKRVREVFGIPAPTGAGNGLPTIEIPKPKATPVTTGLA

SEQ ID NO: 423 - protein, 424 aa, Yersinia enterocolitica
MNKTKSAELVIHAEQTRFDPLMKASESYAGVMDGMASDSTRSQPEYRHWEKALNEANTHITVREDEIEAAKGAYQEVAELLAANLSWPPEAISILPQGSVSTKTLIRSPNGSEKFDIDAVCQVDISRIEASEPMVFFESIGKALIELNAQAKRRCWNLPFPQQPFYLEFTPSVPLNTVPQNIYESMAPRYRAVRYTETALAVVDTPTTSWKTSNPAGMSKWVDDTSKRALILVPAMESFSKGRFMDSISPVPDQTVEITDTLRVAIRLFKRHRDMCVRRGLIERGTKPISVIIVTLLTTCYEGLADLGRVFRHPVEVLDELAVYMPHLLLKLDGKYRVDNPTVEGENFAEKWNDDEGERYQSFMTWCDALSADLKTILALTEPQAITKRVREVFGIPAPTGGGNGLPTIETPKPKATPVTTGLA

SEQ ID NO: 424 - protein, 424 aa, Pseudomonas xanthomarina
MSITKSAALVNYAEQAKPARLTKALESLAILNERFVTYDSARHLKYSPWAQALNAANLHITVREDEISAAAGAYQEVAEHLAANLSWPPEAISIRTQGSVSTKTLIRSPMGGEKFDIDAVCEVDISRVQAANPMEFFGSVGRALVELEAQAKRRCWNIPFPRQPFYLEFTPSVPLDNVPTQTLASMAPRYRASRYEKTALAVVDTPTQSWKTSNPAGMSQWVDDTSKRPLIRVMKMEAYAMDEARASVSPVPDQTVEITDTLRVAIRLFKRHRDMCVRRNIIESSTKPISIIIVTLLTTCYEGLADLNRSFEHPVELLVELAAFMPHLVLKLDGKYRVDNPTVEGENFAEKWNDDEGERHRAFMTWCDALSADLKTILALTEPQEISKRVREVFGIPAPSSDGNGLPSIQIPAPKATPASSGLA

SEQ ID NO: 425 - protein, 423 aa, Halomonas sp.
MITKSAELVKHAEQKCPTRLTQSLESFAALREGYIAGAINRLEEYGLWAKALSEANSHIAVDKEEIAAATDAYNEVADYLATNLSWPPESISIKPQGSVSTKTLIRSPYGSEKFDIDAVCKIDISHIEADNPVSFFESIGQALKELEAQPKRRCWKIPFTGRKFYLEFTPSIPLNTISEQTLHSMAPRYSVARYGETALAVVDMPTESWKTSNSEGMSKWVNDTSERRLLWSNVMEAHAYDRAAASISPVPDQTVDITDTLRVAIRLFKRHRDMCARRGIIDAATKPISVIIVTLLTSCYEGLADLGRSFEHPIELLDELATLMPHLVLELDGKYRVDNPTVEGENFAEKWNDDNGERYKSFMTWTNALSADLQSILALKDPQAISIRVRDVFGIAAPTGGGNGLTTIQPPAPRATPASRGLA

SEQ ID NO: 426 - protein, 423 aa, Unknown
  Description of Unknown: Halomonas sequence
  MOD_RES (269)..(269): Any amino acid
MITKSAELVKHAEQKCPTRLTQSLESFAALREGYIAGAINRLEEYGLWAKALSEANSHIAVDKEEIAAATDAYNEVADYLATNLSWPPESISIKPQGSVSTKTLIRSPYGSEKFDIDAVCKIDISHIEADNPVSFFESIGQALKELEAQPKRRCWKIPFTGRKFYLEFTPSIPLNTISEQTLHSMAPRYSVARYGETALAVVDMPTESWKTSNSEGMSKWVNDTSERRLLWSNVMEAHAYDRAAASISPVPDQTVDITDTLRVAIRLFXRHRDMCARRGIIDAATKPISVIIVTLLTSCYEGLADLGRSFEHPIELLDELATLMPHLVLELDGKYRVDNPTVEGENFAEKWNDDNGERYKSFMTWTNALSADLQSILALKDPQAISIRVRDVFGIAAPTGGGNGLTTIQPPAPRATPASRGLA

SEQ ID NO: 427 - protein, 424 aa, Halomonas cupida
MSTTKSAELVKHAELEYPTRLTKSLESFAALREGYITDARDRLIEYGLWAKALSEANSHIAVDEEEIRAAADAYEEVANYLASNLSWPLKSISIMTQGSVSTKTLIRSPNGSEKFDIDAVCKIDISHIEADDPMSFFESIGQALKELEAQAKRRCWYIPFTGQRFYLEFTPSIPLNTITAQTLSSMAPRYSASRYEETALAVVDTPTKSWKTSNSAGMSKWVNDTAERRLIRSIVMEAYANDRAVASVAPVPDQTVEITDTLRVAIRLFKRHRDMCARRGVIDAATKPISVIIVTLLTSCYEGLADLGRSFEHPIELLDELATLMPHLVLKLDGKYRVDNPTVEGENFAEKWNDDDGERYKSFMTWTNALSADLQTILALKDPSAISRRVREVFGIPAPTGGGNGLTTIQPPAPRATPASRGLA

SEQ ID NO: 428 - protein, 396 aa, Achromobacter ruhlandii
MRQAVLTEDSVERLRARLNPWAAALLQANDHITVKEEEISEASQRYEEVAERLVTKMKLPRGAVEIIPQGSVSSRTLIRSPNGGEKFDIDAVCLVEGAYVSVYKPMEFFADVGKALEDLELEAKKRCWQVWFANEPFYIEFTPSVRLSDLPSHVLSSMPRKFTASRYAATALAVVDRPTQAWKTSNPQGMSQWIEDTARRKIVLDIALERHTSVHAADGVRPVPTQTVEISDALRVAIRLFKRHRDMSVRRSIISRDAKPISILIVTLLTSAYEGLADLGRVYHHPVHLLVELAKLLPRLVLKLDDKWRVDNPTVEGENFAEKWNTDDGERARAFFTWCKALSSDLQTILARTNSDEIMERVREVFGIPAPTAKYTDPGSSFYAAPPPTRPGRGLA

SEQ ID NO: 429 - protein, 415 aa, Massilia timonae
MSTTKFSLLVESASQSRSDSLEKAFRQYGTDVFDVWARELDVVNKHITVDPALVEEAARSYEDLGELLVERLRWPADAITIAPQGSTNTKTLVRAPTAERFDVDAVCEVDLSRVEAQDPMQFFEDVGAALEGHEPQEKSRCWRINFPNKGYYIDFTPSAPLAKIPLGQRGDIQYRPETGYEATALAVVDRPSGKWKTSNPAGFAAWVNEQARRQLLIQPLQKAEATAQRADIRPVPSQEVPLSDTLRVAIRLFKRHRCMAVRRGHITAEFKPISVIIVTLLTQCYAGLADQHRLYNHPVELLADLAVLLPAMVECHNGQYVIANPTVHGENFAERWNTDEGQRAQAFKSWCRLLVTDLTYILGASEPAEVRKRVQKTFGCEGASLPNAATQGIFTGLAPAQPRQVQPVRPGRGLA

SEQ ID NO: 430 - protein, 384 aa, Massilia timonae
MFDVWARELDVVNKHITVDPALVEEAARSYEDLGELLVERLRWPADAITIAPQGSTNTKTLVRAPTAERFDVDAVCEVDLSRVEAQDPMQFFEDVGAALEGHEPQEKSRCWRINFPNKGYYIDFTPSAPLAKIPLGQRGDIQYRPETGYEATALAVVDRPSGKWKTSNPAGFAAWVNEQARRQLLIQPLQKAEATAQRADIRPVPSQEVPLSDTLRVAIRLFKRHRCMAVRRGHITAEFKPISVIIVTLLTQCYAGLADQHRLYNHPVELLADLAVLLPAMVECHNGQYVIANPTVHGENFAERWNTDEGQRAQAFKSWCRLLVTDLTYILGASEPAEVRKRVQKTFGCEGASLPNAATQGIFTGLAPAQPRQVQPVRPGRGLA

SEQ ID NO: 431 - protein, 415 aa, Massilia yuzhufengensis
MSKTKYDQLVESALTYRTDVLEKAIRERGAVALDVWGRELDIVNRHITVDRELVEEAAASYEELGRCLVERLRWSEDAIAIAPQGSTNTKTLVRAPTAERFDIDAVCAVDLSRVDASEPMQFFDDVGRALEGYEPEEMNRCWRINFPNKGYYIDFTPSVPLDKVPAGQRAFVRYQPAAGYESTALAVVDRPSQSWKTSNPAGFAAWVNDQAKRQLLIQLLLKAEAVAKRADIQPVPDQEVPLSDTLRVAIRLFKRHRCMSVRRGQIDGKFKPISVIIVTLLTQCYAGLADQQRRYHHPVELLAELAELLPNMVERHNGEYVIANPTVQGENFAERWNTDNGERARAFTHWCRLLVADLTFILGATEPAEVRKRVQKTFGCEGAVVSPDAAHSMLTGLAAAQPRQVQPVRPGRGLA

SEQ ID NO: 432 - protein, 391 aa, Massilia yuzhufengensis
MRERGAVALDVWGRELDIVNRHITVDRELVEEAAASYEELGRCLVERLRWSEDAIAIAPQGSTNTKTLVRAPTAERFDIDAVCAVDLSRVDASEPMQFFDDVGRALEGYEPEEMNRCWRINFPNKGYYIDFTPSVPLDKVPAGQRAFVRYQPAAGYESTALAVVDRPSQSWKTSNPAGFAAWVNDQAKRQLLIQLLLKAEAVAKRADIQPVPDQEVPLSDTLRVAIRLFKRHRCMSVRRGQIDGKFKPISVIIVTLLTQCYAGLADQQRRYHHPVELLAELAELLPNMVERHNGEYVIANPTVQGENFAERWNTDNGERARAFTHWCRLLVADLTFILGATEPAEVRKRVQKTFGCEGAVVSPDAAHSMLTGLAAAQPRQVQPVRPGRGLA

SEQ ID NO: 433 - protein, 432 aa, Gammaproteobacteria bacterium
MPISPYASLVIDAERRRKRVPSQSIAALRESLSIDDNVQRLLRTYAPWAQELEAVNDHITVRYNEIDEAITAYEEVAQHLRKQLDWPEEATHVFPQGSASTRTLIRSPIANEKFDIDAVCQVDINHIDAYNPIDFFDKVGEALRRYEPKRKNRCWNINFASNPFYLELTPSVPLDTVPINIRASITETLRPVENYRDTALAVVDNDTQQWKTSNPAGISRWVNDIAKRQLLSQQAFVALTSLRETASVESVPDQDVDITDTLRISIRLFKRHRDICARRGRIDKEVQPISIILVTLLTSCYAGLHDLGRPYQHPVELLVDLSERLPGMPEFRNGKHWVANPTVEGENFAEKWNQDDGVRSTAFKTWCDILAADLRTILATTDPKEIRETVGDVFGITGSTNPSTGLFASAGLIGTPATRRPPPPPPKTRGLA

SEQ ID NO: 434 - protein, 432 aa, Gammaproteobacteria bacterium
MPISPYASLVIDAERRRKRVPSQSIAALRESLSIDDNVQRLLRTYAPWAQELEAVNDHITVRYNEIDEAITAYEEVAQHLRKQLDWPEEATHVFPQGSASTRTLIRSPIANEKFDIDAVCQVDINHIDAYNPIDFFDKVGEALRRYEPKRKNRCWNINFASNPFYLELTPSVPLDTVPINIRASITETLRPVENYRDTALAVVDNDTQQWKTSNPAGISRWVNDIAKRQLLSQQAFVALTSLRETASVESVPDQDVDITDTLRISIRLFKRHRDICARRGRIDKEVQPISIILVTLLTSCYAGLHDLGRPYQHPVELLVDLSELLPGMTEFRNGKHWVANPTVEGENFAEKWNQDDGVRSTAFKTWCDILAADLRTILATTDPKEIRETVGDVFGITGSTNPSTGLFASAGLIGTPATRRPPPPPPKTRGLA

SEQ ID NO: 435 - protein, 427 aa, Salinivibrio sp.
MPHSKYSTLVKDALQRRDNSLRKGLDSISEGISMESFDSAYNIYGPWASELAYVNDHITVSQEIIDNAAKEYEKVADKLIKELEWDENSIRVLPQGSASTQTLIKAPDRSKFDIDAVCQVDVSQIDTQDPMAFFEKVGGVLTEIEAIRKKRCWKIQFSKEPFYLEFTPSIPLVTVTEEVRQSMSPRFLPVEHKYLNTALAVVDTPTESWKTSNPEGFSAWVKDTAKLKLLAHQANESISMESRDGIDPVPEQHVELEDTLRIAIRLFKRHRDMCIRRGQIEKESKPISVIIVTLLTGCYAGLYNLRQSYNHPIELLADLVELMPKMIEVRNGEFWVENPTVPEENFAERWNEDDGERFSTITRWCALLAADLQHILQATDDREIKERVRKIFGCQGNKFDTDGSKNPGYDISPILRPKPAPKTNGLA

SEQ ID NO: 436 - protein, 422 aa, Methylophaga nitratireducenticrescens
MADTHYSYLVNEAMARRKNNTQITKTLRESLVMDSIQDSRRHLEALALDIKMVNDHIKVDESIFGEASVDYDKIANKLVEKLHWPNESIRIIPQGSVSTKTLIRSPDNSKFDIDAVCSVDLSMIEVNDPMDFFDKVGLAIEEWEPEAKRRCWKVDFKGRRYYIEFTPSTPLNKVPQTATNQIALSPSNRYRDKALAVVNTPSRQWKTSNPEGFSSWVNDQSSRPLLRWLIENSMQESYSLDSVIPVPAQEVEISDTLRVAIRLLKRHRDMSVKRNYIEPNLKPISIIIVTLLTQCYEGLADKGAVYTHPIELLLDLVELMPYMIEHRANDYWISNPTVEGENFAEKWNENPQLKNSFDIWTNLLKENLNEILAADNLDSRRQIIKEVFGCTATQSPPSPIISGLAQNRPTQAHKAPPTKGLA

SEQ ID NO: 437 - protein, 427 aa, Methylophaga nitratireducenticrescens
MKDIKMADTHYSYLVNEAMARRKNNTQITKTLRESLVMDSIQDSRRHLEALALDIKMVNDHIKVDESIFGEASVDYDKIANKLVEKLHWPNESIRIIPQGSVSTKTLIRSPDNSKFDIDAVCSVDLSMIEVNDPMDFFDKVGLAIEEWEPEAKRRCWKVDFKGRRYYIEFTPSTPLNKVPQTATNQIALSPSNRYRDKALAVVNTPSRQWKTSNPEGFSSWVNDQSSRPLLRWLIENSMQESYSLDSVIPVPAQEVEISDTLRVAIRLLKRHRDMSVKRNYIEPNLKPISIIIVTLLTQCYEGLADKGAVYTHPIELLLDLVELMPYMIEHRANDYWISNPTVEGENFAEKWNENPQLKNSFDIWTNLLKENLNEILAADNLDSRRQIIKEVFGCTATQSPPSPIISGLAQNRPTQAHKAPPTKGLA

SEQ ID NO: 438 - protein, 382 aa, Methylomonas sp.
MSWQSLAEELDAINRHITVNADDFEEAASDYNHIAERLVEKLHWPNDAIRIIPQGSSSTKTLIRMPGPGKFDIDAVCAVDISKIEAKDPIVFFEKIGEALEDWLPSAKKRCWCVEFTNRRYYIEFTPSVPLNTIPAQAVASICYRPSDRYSDTALAVVDTPTRRWKTSNPEGFSNWVSDQAKRIILVSLLLEKRAMEALASDSVAPVPEQQVPLSDTLRIAIRLLKRHRDMSVQRGYFEAELKPISVIIVTLLTQCYEGLADQNARYSHPIELLADLAQLMPGMIEIRNGDYWIENPTVAEENFAEKWNTNHTLKDVFDNWCELLIDDLQSILSSTDERSLCENIRSVFGCTAVTGSVPPSSSGLASRAPNRVHNVPARGLA

SEQ ID NO: 439 - protein, 403 aa, Serratia plymuthica
MSQIIETLDLTKTQYANIESAYSGVGNYLSDGDDPLLKEAVIYPQGSVRLNTTVKPKNEEEYDIDLICYLPHATAADYTGVITAIRQRLESHNTYKDLLSDLPRGFRINYAGDYHLDITPGRDYQGYSEHQGQPLWVVDDKTDWKESNPRGYAEWFDESASKQPVRITLLTDTASRVGTEALLPLPDHTDKKLLNRIVQILKRHRDEWACELDENTQRCKPISVILTTLACHAYNQIIAERRVYDNDLDVLLDVLELMPDFIQAHNGEVHVSNPHMPEENFAEKWNRQENGEGKKRSDAFQQWHVAAQATFNTLAESLGEDNLFTNLEKDFGKTPVDAVRSRLLNEVKQSREQGSLHIDKKTGGLLVSSATTSAAANAGMAKNTFYGTMSAPLPISKNTFYGA

SEQ ID NO: 440 - protein, 425 aa, Serratia plymuthica
MSISTTVARNLPTRKKQRIADLLSQIIETLDLTKTQYANIESAYSGVGNYLSDGDDPLLKEAVIYPQGSVRLNTTVKPKNEEEYDIDLICYLPHATAADYTGVITAIRQRLESHNTYKDLLSDLPRGFRINYAGDYHLDITPGRDYQGYSEHQGQPLWVVDDKTDWKESNPRGYAEWFDESASKQPVRITLLTDTASRVGTEALLPLPDHTDKKLLNRIVQILKRHRDEWACELDENTQRCKPISVILTTLACHAYNQIIAGRRVYDNDLDVLLDVLELMPDFIQAHNGEVHVSNPHMPEENFAEKWNRQENGEGKKRSDAFQQWHVAAQATFNTLAESLGEDNLFTNLEKDFGKTPVDAVRSRLLNEVKQSREQGSLHIDKKTGGLLVSSATTSAAANAGMAKNTFYGTMSAPLPISKNTFYGA

SEQ ID NO: 441 - protein, 425 aa, Serratia plymuthica
MSISTTVARNLPTRKKQRIADLLSQIIETLDLTKTQYANIESAYSGVGNYLSDGDDPLLKEAVIYPQGSVRLNTTVKPKNEEEYDIDLICYLPHATAADYTGVITAIRQRLESHNTYKDLLSDLPRGFRINYAGDYHLDITPGRDYQGYSEHQGQPLWVVDDKTDWKESNPRGYAEWFDESASKQPVRITLLTDTASRVGTEALLPLPDHTDKKLLNRIVQILKRHRDEWACELDENTQRCKPISVILTTLACHAYNQIIAERRVYDNDLDVLLDVLELMPDFIQAHNGEVHVSNPHMPEENFAEKWNRQENGEGKKRSDAFQQWHVAAQATFNTLAESLGEDNLFTNLEKDFGKTPVDAVRSRLLNEVKQSREQGSLHIDKKTGGLLVSSATTSAAANAGMAKNTFYGTMSAPLPISKNTFYGA

SEQ ID NO: 442 - protein, 425 aa, Serratia marcescens
MTTPITVARNLPTQKKQRIADLLSQIIETLDLTKTQYANIESAYNGVGHYLSDGDDPLLKEAVIYPQGSVRLNTTVKPKNEEEYDIDLICYLPHATETDYTGVITAIRQRLESHNTYKELLSDLPRGFRINYAGDYHLDITPGRDYHHYNERLGQPLWVVDDKTDWKESNPRGYAEWFDESASKQPLRIALLTDTASRAGTEALLPLPDHTDKKLLNRIVQILKRHRDEWAFELDEDTQRCKPISVILTTLACHAYNQIIAERRAYDNDLDVLLDVLELMPDFIDGSQGAVHVSNPHMPEENFAEKWNRRENGEGQKRRDAFQQWHVAALATFNTLAESIGEDNLFLNLQKDFGKTPVEAVRSRLLNEVKQSREQGALHVDKKTGGLLVAGASATATANAGMPKNTFYGTESVSQPVPKNTFYGA

SEQ ID NO: 443 - protein, 423 aa, Serratia marcescens
MSTSTTVARNLPTQKKQRITDLLSQIIETLDLTKTQYANIESAYNGVGHYLSDGEDPLLKEAVIYPQGSVRLNTTVKPKNEEEYDIDLICYLPHATETDYTGVITAIRQRLESHNTYKELLSDLPRGFRINYAGDYHLDITPGRDYHHYNERLGQPLWVVDDKTDWKESNPRGYAEWFDESASKQPLRIALLTDTASRVGTEALLPLPDHTDKKLLNRIVQILKRHRDEWAFELDEDTQRCKPISVILTTLACHAYNQIIAERRAYDNDLDVLLDVLELMPDFIDGSQGAVHVSNPHMPEENFAEKWNRRENGEGQKRRDAFQQWHVAALATFNTLAESIGEDNLFLNLQKDFGETPVEAVRSRLLNEVKQSREQGALHVDKKTGGLLVAGASATANAGMPKNTFYGTESVSQPVPKNTFYGA

SEQ ID NO: 444 - protein, 407 aa, Serratia marcescens
MYGSTTARNLPSGKKQRIADLLSQIIETLDLTKTQYANIESAYNGVGTFLSEGDDPLLQDAVIYPQGSVRLNTTVKPKNEEQYDIDLICYLPHATQADYTGVISAIRQRLESHKTYKTLLSELPRGFRINYAGDYHLDITPGRDHTGTAHPGQPLWVVDAQTAWKESNPSGYAEWFESSASVQPLRTILVMDSASRVGTEALLPLPDSTDKKLLNHIVQILKRHRDEWAAEQDEVRQRCRPISVIITTLACHAYNHIIADRRAYDNDLDILLDVLELMPDFIVSTQGAIHVNNPHMPEENFAEKWNRSEQDEGPQRSEAFYQWHAAAQATFNTIAASVGEDNLFLSLEDSFGKTPVDVVRQRLMEHMQSAREQGSLHLDKKTGGLIATGLAGTAAQAGVPKNTFYGE

SEQ ID NO: 445 - protein, 408 aa, Serratia marcescens
MYGSATARNLPSGKKQRIADLLSQIIETLDLTKTQYANIESAYNGVGTFLAEGDDPLLQDAVIYPQGSVRLNTTVKPKNEEQYDIDLICYLPHATQADYTGVISAIRQRLESHKTYKTLLSELPRGFRINYAGDYHLDITPGRDHTGAAERLGQPLWVVDAQTAWKESNPSGYAEWFESSASVQPLRTILVMDSASRVGTEALLPLPDSTDKKLLNRIVQILKRHRDEWAAEQDEIRQRCRPISVIITTLACHAYNHIIADRRAYDNDLDILLDVLELMPDFIVSTQGEIQVSNPHMPEENFAEKWNRSEQDEGPQRSETFYQWHTAAQATFNTIAASVGEDNLFLSLEDSFGKDPVDVVRQRLMEHMQSAREQGSLHIDKKTGGLIATGLAGTAAHAGVPKNTFYGE

SEQ ID NO: 446 - protein, 408 aa, Serratia nematodiphila
MYGSATARNLPSGKKQRIADLLSQIIETLDLTKTQYANIESAYNGVGTFLAEGDDPLLQDAVIYPQGSVRLNTTVKPKNEEQYDIDLICYLPHATQADYTGVISAIRQRLESHKTYKTLLSELPRGFRINYAGDYHLDITPGRDHTGAAERLGQPLWVVDAQTAWKESNPSGYAEWFESSASVQPLRTILVMDSASRVGTEALLPLPDSSDKKLLNRIVQILKRHRDEWAVEQDEVRQRCRPISVIITTLACHAYNHIIADRRAYDNDLDILLDVLELMPDFIVSTQGEIQVSNPHMPEENFAEKWNRSEQDEGPQRSEAFYQWHAAAQATFNTIAASVGEDNLFLSLEDSFGKDPVDVVRQRLMEHMQSAREQGSLHLDKKTGGLIATGLAGTAAQAGVPKNTFYGE

SEQ ID NO: 447 - protein, 408 aa, Serratia marcescens
MYGSATARNLPSGKKQRIADLLSQIIETLDLTKTQYANIESAYNGVGTFLSEGDDPLLQDAVIYPQGSVRLNTTVKPKNEEQYDIDLICYLPHATQADYTGVISAIRQRLESHKTYKTLLSELPRGFRINYAGDYHLDITPGRDHTSAAERLGQPLWVVDAQTAWKESNPSGYAEWFENSASAQPLRTILVMDSASHVGTEALLPLPDSSDKKLLNRIVQILKRHRDEWAVEQDEVRQRCRPISVIITTLACHAYNHIIADRRAYDNDLDILLDVLELMPDFIVSTQGEIQVSNPHMPEENFAEKWNRSEQDEGPQRSEAFYQWHAAAQATFNTIAASVGEDNLFLSLEDSFGKKPVDVVRQRLMEHMQSAREQGSLHLDKKTGGLIATGLAGTAAQAGVPKNTFYGE

SEQ ID NO: 448 - protein, 407 aa, Serratia sp.
MYGSTTARNLPAGKKQRIADLLSQIIETLDLTKTQYANIESAYNGVGTFLAEGDDPLLQDAVIYPQGSVRLNTTVKPKNEEQYDIDLICYLPHATQADYTGVISAIRQRLESHKTYKTLLSELPRGFRINYAGDYHLDITPGRDHTGAAHPGQPLWVVDAQTAWKESNPSGYAEWFESSASVQPLRTILVMDSASRVGTEALLPLPDSSNKKLLNRIVQILKRHRDEWAAEQDEVQQRCRPISVIITTLACHAYNHIIADRRAYDNDLDILLDVLELMPDFIVSTQGEIQVSNPHMPEENFAEKWNRSEQDEGPQRSEAFYQWHAAAQATFNTIAASVGEDNLFLSLEDSFGKDPVDVVRQRLMEHMQSAREQGSLHLDKKTGGLIATGLAGTAAQAGVPKNTFYGE

SEQ ID NO: 449 - protein, 408 aa, Serratia nematodiphila
MYGSTTARNLPSGKKQRIADLLSQIIETLDLTKTQYANIESAYNGVGTFLSEGDDPLLQDAVIYPQGSVRLNTTVKPKNEEQYDIDLICYLPHATQADYTGVISAIRQRLESHKTYKTLLSELPRGFRINYAGDYHLDITPGRDHTSAAERLGQPLWVVDAQTAWKESNPSGYAEWFESSASAQPLRSILVMDSASRVGTEALLPLPDSTDKKLLNRIVQILKRHRDEWAAEQDEVQQRCRPISVIITTLACHAYNHIIADRRAYDNDLDILLDVLELMPDFIVSAQGEIQVSNPHMPEENFAEKWNRSEQDEGPQRSEAFYQWHATAQATFNTIAASVGEDNLFLSLEDSFGKDPVDVVRQRLMEHMQSAREQGSLHLDKKTGGLIATGLAGTAAQAGVPKNTFYGE

SEQ ID NO: 450 - protein, 407 aa, Serratia marcescens
MYGSATARNLPAGKKQRIADLLSQIIETLDLTKTQYANIESAYNGVGTFLSEGDDPLLQDAVIYPQGSVRLNTTVKPKNEEQYDIDLICYLPHATQADYTGVISAIRRRLESHNTYRDLLSDLPRGFRINYAGDYHLDITPGRDHTGAQHPGQPLWVVDAQTAWKESNPSGYAEWFDSSASVQPLRTILVMDSASRVGTEALLPLPDSTDKKLLNRIVQILKRHRDEWAIEQDDVQQRCRPISVIITTLACHAYNHIIAARRAYDNDLDILLDVLELMPDFIVSTQGEIQVSNPHMPEENFAEKWNRSEQDEGPQRSETFYQWHAAAQATFNTIAASVGEDNLFLSLEDGFGKTPVDVVRQRLMEHMQSAREQGSLQLDKKTGGLIATGLASTAAHASVPKNTFYGE

SEQ ID NO: 451 - protein, 407 aa, Serratia marcescens
MYGSATARSLPAGKKQRIADLLSQIVETLDLTKTQYANIKSAYNGVGTFLSEGDDPLLQDAVIYPQGSVRLNTTVKPKNEEQYDIDLICYLPHATQADYTGVISAIRRRLESHSTYKDLLSDLPRGFRINYAGDYHLDITPGRDHTGAEHPGQPLWVVDAQTAWKESNPSGYAEWFDSSASVQPLRTILLMDSASRVGTEALLPLPDSTDKKLLNRIVQILKRHRDEWAVEQNDLQQRCRPISVIITTLACHAYNHIIAARRAYDNDLDILLDVLELMPDFIVLTQGEIQVSNPHMPEENFAEKWNRSEQDEGPQRSETFYQWHAAAQATFNTIAASVGEDNLFLSLEDSFGKKPVDVVRQRLMEHMQSAREQGSLHLDKKTGELIATGIASTAAHAGVPKNTFYGE

SEQ ID NO: 452 - protein, 407 aa, Serratia marcescens
MYGSATARSLPAGKKQRIADLLSQIIETLDLTKTQYANIESAYNGVGTFLSKGDDPLLQDAVIYPQGSVRLNTTVKPKNEEQYDIDLICYLPHATQADYTGVISAIRRRLESHSTYKDLLSDLPRGFRINYAGDYHLDITPGRDHTGAERPGQPLWVVDAQTAWKESNPSGYAEWFDSSASKQPLRIVLLADSASRVGTEALLPLPDSTDKKLLNRIVQILKRHRDEWAVEQNDVQQRCRPISVIITTLACHAYNHIIADRRAYDNDLDILLDVLELMPDFIVSTQGEIQVSNPHMPEENFAEKWNRSEQDEGPQRSETFYQWHAAAQATFNTIAASVGEDNLFLSLEDSFGKKPVDVVRQRLMEHMQSAREQGSLHLDKKTGGLIATGLASTAAQAGVPKNTFYGE

SEQ ID NO: 453 - protein, 408 aa, Serratia marcescens
MYSSATARSLPSGKKQRIADLLSQMIETLDLTKTQYANIESAYNGVGTFLSEGDDPLLQDAVIYPQGSVRLNTTVKPKNEEQYDIDLICYLPHATQADYTGVISAIRQRLESHNTYKDLLSDLLRGFRINYAGDYHLDITPGRDHTGVAERPGQPLWVVDAKTAWKESNPSGYAEWFESSASVQPLRIALLTDSASRVGTEALLPLPDSTDKKLLNRIVQILKRHRDEWAVDQDDIHQRCRPISVIITTLACHAYNHIIADRRAYDNDLDILLDVLELMPDFIVSTQGEIQVNNPHMPEENFAEKWNRSEQDEGPQRSEAFYHWHAAALATFNTIAASVGEDNLFLSLEDSFGKDPVDSVRQRLMEHMQSAREQGSLHLDKNTGGLIATGLASTAANAGVPKNTFYGE

SEQ ID NO: 454 - protein, 408 aa, Serratia marcescens
MYSSATARSLPSGKKQRIADLLSQMIETLDLTKTQYANIESAYNGVGTFLSEGDDPLLQDAVIYPQGSVRLNTTVKPKNEEQYDIDLICYLPHATQADYTGVISAIRQRLESHNTYKDLLSDLPRGFRINYAGDYHLDITPGRDHTGAAERPGQPLWVVDAKTAWKESNPSGYAEWFESSASVQPLRIALLTDSAGRVGTEALLPLPDSTDKKLLNRIVQILKRHRDEWAVEQDDIHQRCRPISVIITTLACHAYNHIIADRRAYDNDLDILLDVLELMPDFIVSTQGEIQVNNPHMPEENFAEKWNRSEQDEGPQRSEAFYQWHAAALATFNTIAASVGEDNLFLSLEDSFGKTPVDSVRQRLMEHMQSAREQGSLHLDKKTGGLIATGLASTAANAGVPKNTFYGE

SEQ ID NO: 455 - protein, 408 aa, Serratia marcescens
MYSSATARSLPSGKKQRIADLLSQMIETLDLTKTQYANIESAYNGVGTFLSEGDDPLLQDAVIYPQGSVRLNTTVKPKNEEQYDIDLICYLPHATQADFTGVISAIRQRLESHNTYKDLLSDLPRGFRINYAGDYHLDITPGRDHTGAAERPGQPLWVVDAKTAWKESNPNGYAEWFESSASVQPLRIALLTDSASRVGTEALLPLPDSTDKKLLNRIVQILKRHRDEWAVEQDDIHQRCRPISVIITTLACHAYNHIIADRRAYDNDLDILLDVLELMPDFIVSTQGEIQVNNPHMPEENFAEKWNRSEQDEGPQRSEAFYQWHAAALATFNTIAASVGEDNLFLSLEDSFGKDPVDSVRQRLMEHMQSAREQGSLHLDKKTGGLLATGLASTAANAGVPKNTFYGE

SEQ ID NO: 456 - protein, 408 aa, Serratia sp.
MYGSATARNLPSGKKQRIADLLSQMIETLDLTKTQYANIESAYNGVGTFLSEGDDPLLQDAVIYPQGSVRLNTTVKPKNEEQYDIDLICYLPHATQADYTGVISAIRRRLESHKTYKTLLSELPRGFRINYAGDYHLDITPGRDHTGAAEHPGQPLWVVDAKTAWKESNPSGYAEWFESSASVQPLRIALLTDSASRVGTEALLPLPDNTDKKLLNRIVQILKRHRDEWAVEQDELQQRCRPISVIITTLACHAYNHIIADRRVYDNDLDILLDVLELMPDFIVSTQGEIQVSNPHMPEENFAEKWNRSEQDEGPQRSETFYQWYAAAQTTFNTIAASVGEDNLFLSLEDSFGKTPVDIVRQRLMEHMQTAREQGSLHLDKRTGGLITTGLASTAAHASVPKNTFYGE

SEQ ID NO: 457 - protein, 404 aa, Serratia marcescens
MYGSATARSLPSGKKQRIADLLSQMIETLDLTKTQYANIKSAYNGVGAFLSEGDDPLLQDAVIYPQGSVRLNTTVKPKNEEQYDIDLICYLPHATQVDYTDVISAIRQRQESHNTYKDLLSDLPRGFHINYAGDYHLDITPGRDHTGAAVRPGQPLWAVDAKTAWKESNPSGYAEWFDNSASVQPLRIALLTDSASRVGTEVLLPLPDSTDKKLLNRIVQILKRHRDEWAVEQDDLQQRCRPISVIITTLACHSYNHIIAAKRAYDNDLDILLDVLELMPDFIVCEQGEIQVSNPHMPEENFAEKWNRSEQDDGPQRRETFYQWHAAAQATFNIIAASVGEDNLFLSLEDSFGKDPVDIVRQRLMEHMQSAREQSRLKTGGLIATGLASTAANASVPKNTFYGE

SEQ ID NO: 458 - protein, 426 aa, Enterobacter cloacae
MSNGNLALNISKDKRQYVGDFLDCIVDCLDLTETQHKHIKSAYHSVGKFLSEGDNPILKGAMIYSQGSVRLNTTVKPKGSEQYDVDLLCYLPNASHITGWAQVLDAVRDRLSSHETYRKMLHPLPRGYRIMYAGDYHLDITPGIDWSTNPTEENHPLLVPDTRLRGWKESNPAGYATWFDNITEKLPTFLTRMVACENLAKSASVRPLPNHTHKKLLNRIVQIFKRHRDVWAASQGKDYIEFKPISAIITTLSAHAYNHICDQKTTYDTDFDVILDVLYLMPKFIVGSLGNYHVSNPSMPAENFAEKWNNPESGKGERLKKHFDLWHKAAIESINEIAASEGEDELLENLSKYFGERPVKAVREAMLENINAARSQNNLNVLPFTGALSAGAVTGTASARSVPSNTFYGGEATSSVVVQKNTFFGD

SEQ ID NO: 459 - protein, 426 aa, Unknown
  Description of Unknown: Enterobacter cloacae complex sequence
MSNGNLALNISKEKRQYVGDFLDCIVDCLDLTETQHKHIKSAYHSVGKFLSEGDNPILKGAMIYSQGSVRLNTTVKPKGSEQYDVDLLCYLPNASHITGWAQVLDAVRDRLSSHETYRKMLHPLPRGYRIMYAGDYHLDITPGIDWSTNPTEENHPLLVPDTRLRGWKESNPAGYATWFDNITEKLPTFLTRMVACENLAKSASVRPLPNHTHKKLLNRIVQIFKRHRDVWAASQGKDYIEFKPISAIITTLSAHAYNHICDQKTTYDTDFDVILDVLYLMPKFIVGSLGNYHVSNPSMPAENFAEKWNNPESGKGERLKKHFDLWHKAAIESINEIAASEGEDELLENLSKYFGERPVKAVREAMLENINAARSQNNLNVLPFTGALSAGAVTGTASARLVPSNTFYGGEATSSVVVQKNTFFGD

SEQ ID NO: 460 - protein, 421 aa, Enterobacter hormaechei
MALNISKEKRQYVGDFLDCIVDCLDLTETQHKHIKSAYHSVGKFLSEGDNPILKGAMIYSQGSVRLNTTVKPKGSEQYDVDLLCYLPNASHITGWAQVLDAVRDRLSSHETYRKMLHPLPRGYRIMYAGDYHLDITPGIDWSTNPTEENHPLLVPDTRLRGWKESNPAGYATWFDNITEKLPTFLTRMVACENLAKSASVRPLPNHTHKKLLNRIVQIFKRHRDVWAASQGKDYIEFKPISAIITTLSAHAYNHICDQKTTYDTDFDVILDVLYLMPKFIVGSLGNYHVSNPSMPAENFAEKWNNPESGKGERLKKHFDLWHKAAIESINEIAASEGEDELLENLSKYFGERPVKAVREAMLENINAARSQNNLNVLPFTGALSAGAVTGTASARLVPSNTFYGGEATSSVVVQKNTFFGD

SEQ ID NO: 461 - protein, 426 aa, Enterobacter cloacae
MSNGNLALNISKEKRQYVGDFLDCIVDCLDLTETQHKHIKSAYHSVGKFLSEGDNPILKGAMIYSQGSVRLNTTVKPKGSEQYDVDLLCYLPNASHITGWAQVLDAVRDRLSSHETYRKMLHPLPRGYRIMYAGDYHLDITPGIDWSTNPTEENHPLLVPDTRLRGWKESNPAGYATWFDNITEKLPTFLTRMVACENLAKSASVRPLPNHTHKKLLNRIVQIFKRHRDVWAASQGKDCIEFKPISAIITTLSAHAYNHICDQKTTYDTDFDVILDVLYLMPKFIVGSLGNYHVSNPSMPAENFAEKWNNPESGKGERLKKHFDLWHKAAIESINEIAASEGEDELLENLSKYFGERPVKAVREAMLENINAARSQNNLNVLPFTGALSAGAVTGTASARSVPSNTFYGGEATSSVVVQKNTFFGD

SEQ ID NO: 462 - protein, 421 aa, Enterobacter cloacae
MALNISKEKRQYVGDFLDCIVDCLDLTETQHKHIKSAYHSVGKFLSEGDNPILKGAMIYSQGSVRLNTTVKPKGSEQYDVDLLCYLPNASHITGWAQVLDAVRDRLSSHETYRKMLHPLPRGYRIMYAGDYHLDITPGIDWSTNPTEENHPLLVPDTRLRGWKESNPAGYATWFDNITEKLPTFLTRMVACENLAKSASVRPLPNHTHKKLLNRIVQIFKRHRDVWAASQGKDCIEFKPISAIITTLSAHAYNHICDQKTTYDTDFDVILDVLYLMPKFIVGSLGNYHVSNPSMPAENFAEKWNNPESGKGERLKKHFDLWHKAAIESINEIAASEGEDELLENLSKYFGERPVKAVREAMLENINAARSQNNLNVLPFTGALSAGAVTGTASARSVPSNTFYGGEATSSVVVQKNTFFGD

SEQ ID NO: 463 - protein, 426 aa, Morganella morganii
MSKSNSALSISKEKKQYVGDFLDCIVDSLDLTDTQHKHIKSAYHAVGKYLSEGDNPVLNGAIIYSQGSVRLNTTVKPKGSEQYDVDLLCYLPNASRSTGWAQVLDAVHERLSSHKTYCEMLNPLPRGYRIRYAGDYHLDITPGIDWSTDPTEENHPLLVPDARLGGWKESNPAGYATWFDNITEKLPMFLKRVVACESFSEAASVRPLPDHMHKKLLNRIVQIFKRHRDVWAASLGKDYIESKPISAIITTLSAHAYNCICDQKKVYDTDFDVILDVLYLMPKFIEVSTGYYHVSNPSMPAENFAEKWNNPEGGKGKNLKNCFVMWHQAAIENINEIAASDGEDELLDNLSKYFGERPVKAVREAMLVNINTARSQNGLNVLPFTGALSAGTMSGAAAGRSVPANTFYGGETAPSIVVQKNTFFGD

SEQ ID NO: 464 - protein, 426 aa, Xenorhabdus bovienii
MRNAGSVLRVSKEKKQYVGDFLDCIVDSLDLTETQHKHIKSAYHAVGKYLSEGDNPILEGAMIYSQGSVRLNTTVKPKGSEQYDVDLLCYLPNASKVTGWAQVLEAVHERLSSHETYRKMLHPLPRGYRIMYEGDYHLDITPGIDWNNNPSEENHPLLVPDSRLMDWKESNPAGYATWFDDITEKLPTFLMLEAACESFAKSASVRPLPNHKHKKLLNRIVQIFKRHRDVWAAEKGKECIELKPISAIITTLSAHAYNHICDQGRVYDTDFDVILDVLDLMPRFIDVIYGQYYVSNPSMPAENFAEKWNIVEGGKGEKLKSNFVLWHEVAVESINEIAASEGEDELLDNLSKYFGERPVKAVREAMLEGISAVRYQNGLNVLPFTGALSAGAVSATAATRPVPANTFYNGDAASPVVVQKNTFFGD

SEQ ID NO: 465 - protein, 426 aa, Xenorhabdus beddingii
MRNSGSVLRVSKEKKQYVGDFLDCIVDSLDLTETQHKYIKRAYHAVGKYLSEGDNPILEGAIIYSQGSVRLNTTVKPKGSEQYDVDLLCYLPNASKVTGWAQILEAVHERLSSHETYRKMLHPLPRGYRIMYAGDYHLDITPGIDWNNNPSEENHPLLVPDSRLMDWKESNPAGYATWFDDITEKLPTFLILEAGSESLAKSASVRPLPNHKHKKLLNRIVQIFKRHRDVWAADKNKEFIKLKPISAIITTLSAHAYNHICDQGGVYDTDFDVILDVLDLMPRFINIINGQYYVSNPSMPAENFAEKWNIVEGGEGEKLKSNFVLWHEVAVESINEIAASEGEDALLDNLSKYFGERPVKAVREAMVEVISTARNQNGLNVLPFTGALSAVAVSATAAAQPVPANTFYGGDAASPVVVQKNTFFGD

SEQ ID NO: 466 - protein, 426 aa, Escherichia coli
MRNSVPALQISKEKKQYVGDFLDCIVDSLDLTETQHNHIERAYHSVGKYISEGDNPILEGAVIYSQGSVRLNTTVKPKGSEQYDVDLLCYLPNASRATGWAQVLDAVYQRLNSHETYRKMLTPLPRGYRIMYAGDYHLDITPGIDWSRNASEENHPLWIPDSRLMNWKESNPAGYATWFDSITEKYPIFLMFEAACESLSKSASVRPLPNRNHKKLLNRIVQIFKRHRDVWAASRGAECVELKPISAIITTLSAHAYNLICDRERIYSTDFDVILDVLDLMKDFIVERDGYIYVSNPSMHAENFAEKWNIAEGEKGYKLHRNFLQWREAAIENINEIAASVGEDELLERLSKYFGERPVKAVRDAMLEEVNSARIQNGLNVLPFTGALSAGTMGASASAQPIPTNTFYGGEVASPIVVPKNTFFGD

SEQ ID NO: 467 - protein, 410 aa, Enterobacter hormaechei
MGDFLDFIVDTLDLSETQYGLIKRAYESVGRYLAEGDDPLLSGAVIYSQGSVRLNTTVKPKGSEQYDVDLLCYLPNASLDSGWANVLEAVRSRLASHSTYSEMLSPLPRGHRIMYAGEYHLDITPGIDWSNNHSEENHPLMVPDSRLQDWKESNPAGYATWFDAITEKFPVFFKLEVACESFIKSAAVRPLPDHTQKKLLNRIVQILKRHRDVWAAEGGKERVDHKPISAIITTLAAHAYNRICDERRAYDTDFDVILDVLALMPEYIRCGSGIYSVPNPSMPAENFAEKWNVGEARKGEKLRNNFELWHQTVTNNIIEIASSVGEDQLLDKLSKYFGERPVKAVQEAMLGGVNTARNNNTLRSSALTGALTAGVASTAAASTRTVPANTFYGSDSLSATPVQKNTFFGD

SEQ ID NO: 468 - protein, 426 aa, Unknown
  Description of Unknown: Enterobacteriaceae sequence
MSNSVSVLALSTEQKQYVGDFLDCIVGSLDLSETQYSLIKRAYESVGAYLAGGDDPILVGAEIYSQGSVRLNTTVKPKGSEQYDVDLLCYLPNASVASGWAEVLEAVRARLASHGTYSEMLTPLPRGHRIMYAGEYHLDITPGIDLGYNSSEHNHPLLVPDSRLQDWKESNPAGYATWFDNITEKLPIFVRLEVASESFIKSAAVRPLPDHTRKKLLNRIVQIFKRHRDVWAAEGGKERIDLKPISAIITTLAGHAYSKICDEGRSYSTDFDVLLDVLELMPDYIRYSYGLYFVPNPSMPEENFAEKWNVEESRKGEKLRKNFELWHKTITENIIEIASSVGEDQLLDNLSKYFGERPVKAVREAMVGGVNAARDSNDLRVLALTGALSAGAANVPAMARTVPENTFYGGNALSSAPVKKNTFFGD

SEQ ID NO: 469 - protein, 426 aa, Unknown
  Description of Unknown: Klebsiella sequence
MSNSVSVLALSTEQKQYVGDFLDCIVGSLDLSETQYSLIKRAYESVGAYLAGGDDPILVGAEIYSQGSVRLNTTVKPKGSEQYDVDLLCYLPNASVASGWAEVLEAVRARLASHGTYSEMLTPLPRGHRIMYAGEYHLDITPGIDLGYNSSENNHPLLVPDSRLQDWKKSNPAGYATWFDNITEKLPIFVRLEVASESFIKSAAVRPLPDHTRKKLLNRIVQIFKRHRDVWAAEGGKERIDLKPISAIITTLAGHAYSKICDEGRSYSTDFDVLLDVLELMPAYIRYSYGLYFVPNPSMPEENFAEKWNVEESRKGEKLRKNFELWHKTITDNIIEIASSVGEDQLLDNLSKYFGERPVKAVREAMVGGVNAARDSNDLRVLALTGTLSAGAANVPAMARTVPENTFYGGNALSSAPVKKNTFFGD

SEQ ID NO: 470 - protein, 426 aa, Unknown
  Description of Unknown: Enterobacteriaceae sequence
MSNSVSVLALSTEQKQYVGDFLDCIVGSLDLSETQYSLIKRAYESVGAYLAGGDDPILVGAEIYSQGSVRLNTTVKPKGSEQYDVDLLCYLPNASVASGWAEVLEAVRARLASHGTYSEMLTPLPRGHRIMYAGEYHLDITPGIDLGYNSSEHNHPLLVPDSRLQDWKESNPAGYATWFDNITEKLPIFVRLEVASESFIKSAAVRPLPDHTRKKLLNRIVQIFKRHRDVWAAEGGKERIDLKPISAIITTLAGHAYSKICDEGRSYSTDFDVLLDVLELMPDYIRYSYGLYFVPNPSMPEENFAEKWNVEESRKGEKLRKNFELWHKTITDNIIEIASSVGEDQLLDNLSKYFGERPVKAVREAMVGGVNAARDSNDLRVLALTGALSAGAANVPAMARTVPENTFYGGNALSSAPVKKNTFFGD

SEQ ID NO: 471 - protein, 426 aa, Klebsiella pneumoniae
MSNSVSVLALSTEQKQYVGDFLDCIVGSLDLSETQYSLIKRAYESVGAYLAGGDDPILVGAEIYSQGSVRLNTTVKPKGSEQYDVDLLCYLPNASVASGWAEVLEAVRARLASHGTYSEMLTPLPRGHRIMYAGEYHLDITPGIDLGYNSSEHNHPLLVPDSRLQDWKESNPAGYATWFDNITEKLPIFVRLEVASESFIKSAAVRPLPDHTRKKLLNRTVQIFKRHRDVWAAEGGKERIDLKPISAIITTLAGHAYSKICDEGRSYSTDFDVLLDVLELMPDYIRYSYGLYFVPNPSMPEENFAEKWNVEESRKGEKLRKNFELWHKTITENIIEIASSVGEDQLLDNLSKYFGERPVKAVREAMVGGVNAARDSNDLRVLALTGALSAGAANVPAMARTVPENTFYGGNALSSAPVKKNTFFGD

SEQ ID NO: 472 - protein, 426 aa, Klebsiella pneumoniae
MSNSVSVLALSTEQKQYVGDFLDCIVGSLDLSETQYSLIKRAYESVGAYLAGGDDPILVGAEIYSQGSVRLNTTVKPKGSEQYDVDLLCYLPNASVASGWAEVLEAVRARLASHGTYSEMLTPLPRGHRIMYAGEYHLDITPGIDLGYNSSEHNHPLLVPDSRLHDWKESNPAGYATWFDNITEKLPIFVRLEVASESFIKSAAVRPLPDHTRKKLLNRIVQIFKRHRDVWAAEGGKERIDLKPISAIITTLAGHAYSKICDEGRSYSTDFDVLLDVLELMPDYIRYSYGLYFVPNPSMPEENFAEKWNVEESRKGEKLRKNFELWHKTITENIIEIASSVGEDQLLDNLSKYFGERPVKAVREAMVGGVNAARDSNDLRVLALTGALSAGAANVPAMARTVPENTFYGGNALSSAPVKKNTFFGD

SEQ ID NO: 473 - protein, 426 aa, Klebsiella pneumoniae
MSNSVSVLALSLEQKQYVGDFLDCIVGSLDLSETQYSLIKRAYESVGAYLAGGDDPILVGAEIYSQGSVRLNTTVKPKGSEQYDVDLLCYLPNASVASGWAEVLEAVRARLASHGTYSEMLTPLPRGHRIMYAGEYHLDITPGIDFGYNSSEHSHPLLIPDSRLQDWKESNPAGYATWFDNITEKLPIFVRLEVASESFIKSAAVRPLPDHTRKKLLNRIVQIFKRHRDVWAAEGGKERIDLKPISAIITTLAGQAYSKICDEGRSYSTDFDVLLDVLELMPDYIRYSYGLYFVPNPSMPEENFAEKWNVEESRKGEKLRKNFELWHKTITDNITEIASSVGEDQLLDNLSKYFGERPVKAVREAMVVGVNAARNSNDLRVLALTGALSAGAANVPAMARTVPENTFYGGNALSSAPVKKNTFFGD

SEQ ID NO: 474 - protein, 426 aa, Klebsiella pneumoniae
MSNSVSVLALSLEQKQYVGDFLDCIVGSLDLSETQYSLIKRAYESVGAYLAGGDDPILVGAEIYSQGSVRLNTTVKPKGSEQYDVDLLCYLPNASVASGWAEVLEAVRARLASHGTYSEMLTPLPRGHRIMYAGEYHLDITPGIDFGYNSSEHSHPLLIPDSRLQDWKESNPAGYATWFDNITEKLPIFVRLEVASESFIKSAAVRPLPDHTRKKLLNRIVQIFKRHRDVWAAEGGKERIDLKPISAIITTLAGQAYSKICDEGRSYSTDFDVLLDVLELMPDYIRYSYGLYFVPNPSMPEENFAEKWNVEESRKGEKLRKNFELWHKTITDNITEIASSVGEDQLLDNLSKYFGERPVKAVREAMVVGVNAARDSNDLRVLALTGALSAGAANVPAMARTVPENTFYGGNALSSAPVKKNTFFGD

SEQ ID NO: 475 - protein, 425 aa, Obesumbacterium proteus
MNSSTSVLKLSKEKKQYVGDFLGSIVESLDLSETQYSLIKRAYETVGTYLAEGENPILSGAEIYSQGSVRLNTTVRPKGSEQYDVDLLCYLPNACKATGWAEVLEAVRERLANHGTYGEMLNPLPRGYRIMYAGEYHLDITPGIDWSSNPSEENHPLLVPDSRLRNWKESNPAGYATWFDSITEKTPLFLMLEVACDSFIKSAAVRPLPDHTQKKLLNRIVQIFKRHRDVWAADQGKECVDLKPISAIITTLAAHAYNHICDEARTYETDFDAILDVLELMPHFIGYRSGLYFVANPSMPAENFAEKWNIAEGGKGEKLKNNFASWHRTAIDNIKEIASSVGEDQLLNNLSQYFGERPVKAVREAMLGGISTARNNSELRASAITGALTAGAANSSVARAMPANTFYGENSLSSVAMQKNTFFGD

SEQ ID NO: 476 - protein, 416 aa, Paraglaciecola mesophila
MSSLFNNARALSEQKKSMLVEMLDSVFDNLDLTKTQRERIETAYKAVGNYLASCEHPLLEGAQIYPQGSMRLRTTNKPLGQEEFDVDLILFLPNAAFATRDEIVSVVKQHLLDNEVYKELVEDLPRGLRINYKGDYHLDITPAKAYDLQGLQGHPLWVVDKHTGFKESNPEGMAQGFDKACSMLPVIRKAHVFMEALTNRSVTELPDQLKKKPLNRIIQILKRHRDVWSQQDGNIHADFRPISVVITMLASLAYVEVVKSGKEYDNEFDLILDVIELMPHHIENNFDEVLITNPTMKPENYAEKWNRVEGLEGQKYRNAFYAWHRAAVDTFEHLASANNQGIDNVFTALSGAFGERPVVAAKDRIIETVNANRSNGNLSVALGTGAITTTVAGKANAASRVVTPVVKVKGNRFYGD

SEQ ID NO: 477 - protein, 416 aa, Paraglaciecola agarilytica
MSSLFNNARALSEQKKSMLVEMLDSVFDNLDLTKTQRERIETAYKAVGNYLASCEHPLLEGAQIYPQGSMRLRTTNKPLGQEEFDVDLILFLPNAAFATRDEIVSVVKQHLLDNEVYKELVEDLPRGLRINYKGDYHLDITPAKAYDLQGFQGHPLWVVDKHTGFKESNPEGMAQGFDKACSMLPVIRKAHVFMEALTNRSVTELPDQLKKKPLNRIIQILKRHRDVWSQQDGNIHADFRPISVVITMLASLAYVEVVKSGKEYDIEFDLILDVIELMPHHIENNFDEVLITNPTMKPENYAEKWNRVEGLEGQKYRNAFYAWHRAAVDTFEHLASANNQGIDNVFTALSGAFGERPVVAAKDRIIETVNANRSNGNLGVALGTGAITTTVAGKTNAASRVVTPVVKVKGNRFYGD

SEQ ID NO: 478 - protein, 416 aa, Pseudoalteromonas sp.
MSSLFSNARALSEQKKSMLMEMLDSVFDNLDLTKTQRERIETAYKAVGNYLASCEHPLLEGALIYPQGSMRLRTTNKPLGQEEFDVDLILFLPHATYATRDEIVRVVKQHLVDNDVYKDLVEDLPRGLRINYKGDYHLDITPAKAYDLSGLQGHPLWVVDKHTGFKESNPEGMAQGFDKVCSMLPVIRKAHVFMEALTNRSVTELPDQSKKKPLNRITQVLKRHRDVWSQQEGNTHADFRPISVVITMLASLAYVEVVKSGKEYDNEFDLILDVIELMPHHIETNFDEVLITNPTMKPENYAEKWNRAERQEGQKYRTAFYAWHRAAVDTFERLASANNQGIDNVFTALSGAFGEQPVTAAKDRIIETVNTNRTNGNLGVALGTGVITTVVTEKANAASRVVTPVVPVKGNRFYGD

SEQ ID NO: 479 - protein, 416 aa, Thalassomonas actiniarum
MTRLFTNARALSEHQKSMLAEMLDSVFDNLDLTKTQRERIETAYNAVGNYLASCDDSLLEGAQIYPQGSMRLRTTNKPLSQEEFDVDLILFLPNARYATRDEIVKVVKQHLLDSDVYKELVEDLPRGLRINYKGDYHLDITPAKAYELEELPGHPLWVVDKRTGFKESNPEGMAQGFDKACAMLPVIRRSHVFLEALSKKSVAELPDQTKKKPLNRIIQILKHHRDVWSQLEGNPHADFKPISVIITTLACRAYVEVIKSGREYDNEFDLILDVIELMPHHIETFYDEVLIANPTMRAENYAEKWNREERQEGQKKREAFYAWHQATVDMFERLASENNRGMDNVFTALSGAFGERPVLAAKDRIVEAVNANRSNSNLGIVLGTGAITAAVAGKAHSTSRVVNDVVPVKRNQFYGD

SEQ ID NO: 480 - protein, 416 aa, Shewanella sp.
MTELFTNARALSEHKKSMLVEMLDSVFDNLDLTKTQRERIETAYNTVGSYLASCDHPLLKEAQIYPQGSMRLRTTNKPLYQEEFDVDLILFLPNAGHATRDEIVKVVKQHLKDNEVYKELVEDLPRGLRINYKGDYHLDITPAKEYDLPGLQGHPLWVVDKHTGFKESNPEGMAQGFEKACSMLPVIRRRHELLEALANKSVTELPDQSKKKPLNRIIQILKRHRDVWSQQGENLHADFRPISVIITMLASLAYVEVVKSGKEYESEFDLILDVIELMPLHIEINFDGVFVTNPTMRPENYAEKWNRVERQEGQKYRNAFYAWHQAAVDTFERLASANNQGMDNVFAALSGAFGEKPVLAAKNRIIEAINENRNNGNLRVALGTGALAAATAGKVHAASRVVSPVESVKRNQFYGD

SEQ ID NO: 481 - protein, 416 aa, Marinomonas polaris
MTTLFTNARALNESKKSMLVDMLDSVFDSLDLTKTQRERIESAYNAVGDYLASCDDPLLDGVQIYPQGSMRLRTTNKPLSQEEFDVDLILFLPNAGSATRDKIVSVVKQHLLDSKVYKELVEDLPRGFRINYKGDYHLDITPAKSYDLESLPGHPLWVVDKSMGFKESNPEGMAKNFDEVCSMLPIIRRPQVFLEALNSKSVTALPDQSKKKPLNRIIQILKRHRDVWSQFNSNPHADFKPISVVITTLACRAYLEVIETGKQYDNEFDLILDVIELMPHHIESGFDGILIANPAMRPENYAEKWNRSEKQEGQKYTRAFYAWYQAAIDTFEYLASENIRGMDSVFAALSGAFGEKPVLAAQDRIVEAVNVSRDNNKLGVGLGTGAVIASIAGKANSETTGLHDVVPVKRNQFYGD

SEQ ID NO: 482 - protein, 416 aa, Rheinheimera perlucida
MSSLFTNARAMSEDKKTMLVEVLNYVFDNLDLTQSQREQIESAYNAVGEYLASCDDPLLEAAQIYPQGSMRLRTTNKPLSQEEFDVDLILYLPNAGAATRNEIVRVVKQHLLNNKVYKDLVVDLPRGLRINYKGNYHLDITPGKKYDLEALPGHPLWVVDKHSGFKESNPEGMAQVFDDSCLLLPKIKSRHRFMEALSNKSVTQLPDQNVKKPLNRIIQILKRHRDVWSQQDTNPHAVFKPISVVITSLARSAYVEVIKSGKEYDNELDLILDIIELMPHHIETIDNKVLIANPTMRPENYAEKWNRVEGFEGENYRLAFFAWHQAAIGMFENLASENNRGLDNAFTALSEAFGEKPVLAAKDRIIELVNVTRSNDRLGVTLGTGAFTSVMAGKTHSATWPVNNVVPVKRNQFYGD

SEQ ID NO: 483 - protein, 410 aa, Thiothrix lacustris
MHKPKTLHEQQPQFKIELVGWMVRICHSLELTQTQRQRIETCYHAVGNWLAEGTHYLLKGAAIYPQGSIRLRTTVKPIGQDEFDVDLIIHLPKAYQGISRKVVLQVIKDRLNEHETYKQLLKELKRGFRINYAGDYHLDITPAIDYHTHPPYGHPVLVPDRDEEWKSSNPKGMANIFEEASKRQPRYTAVFRETFDSITMSQVESLPDENKLKTPLQQITQLAKRNRDVWAMSDQGKRLAEYKPISVLLTTLLMHSYTFCTQEKFSYNSELDFLLNVIEKMPSFITSGADGYHVDNPTVQGENFAEKWNKPSSGQRYAEAFFTWHRDLLSNLNRLAEVYGEDEFQKQLKTLFGERPVNDAANAIRLNVSQQRVNRNIRVGSGGLLLAGGAGLSTAAHATVRPNNFWGRHP

SEQ ID NO: 484 - protein, 400 aa, Burkholderiales bacterium
MHADPKLAELASSKRRLLVGVLDALFDQIDLTESQYETAKDRYAAVSAWLAEGESPFLKVASIYAQGSIAVGIANKPIGRTEFDVDLVCHLPSAGPGSDPRAVKALIGERLKAHATYASMLEEKRRCWRLCYANEFHLDITPSIPNPACANGGELVPDRALSAWKPTNPKGFAARFEQYAALQPRQYLREATIAAKRAEVEDFPEQEMRKPPLKRIVQLLKRHRDVSFAAPGRSELAPISVILTMLAARSYAHCTARFVYADTYELTLDVVRRMPQFIVVDERSGKPVYLIENETTAGENFADKWNLDSRLPEAFYAWHKAAIGMLEGLAAVEGKDRLGQALQKSFGTSQEAVRRALAPITSEVGKARVAGSLLVAPSLGVVTAPAAGRVAVRPNTFFGR

SEQ ID NO: 485 - protein, 400 aa, Burkholderiales bacterium; identical to SEQ ID NO: 484

SEQ ID NO: 486 - protein, 400 aa, Thauera sp.
MHADPRLIEFATHKRRMLVGILDALFAQIDLTDSQYETAKARYEAVSAWLAEGESPFLQDAAIYAQGSIAVGTANKPIGRAEFDVDLVCHLPSVGATSNPAAVKALIGDRLRAHATYASMLEEKQRCWRLCYANEFHLDITPSIPNPACGNGGELVPDRALAAWKPTNPKGYAARFEQYAALRRRLTLREAAIAAKRADVEDFPEQEMRKPPLKRIVQLLKRHRDVSFAAPGRSELAPISVILTTLAARSYADCITRFVYADTYELILDVVRRLPEFIQVGERNGRPFYFIENETTTGENFADKWNLDPRLPRAFYGWHRDAVAMLEGLIALEGKDRLGEALQKSFGASQEAVRAAMAPLATTVGNARAAGSLLVAPSLGLVTSPAVGRVTVPPHTFFGR

SEQ ID NO: 487 - protein, 400 aa, Methylotenera sp.
MNFDTNIALLNTRKKQMVVSLLDQLCQQLDITETQYQTAKDRYEAVGIWLADSPLQALNDAKIYPQGSIALGTAIKPIGSNEFDVDLVCYLPGLAVNSYPHQVKALIGSRLKEHGTYRGMLEEKQRCWRINYANEFHLDITPSIDNPHCYQGGELVPDKKLAEWKPTNPKGYIKKIEEYSALNPHFNLLEKSFAEARADIAPLPEQSMTKPVLKRIIQLLKRHRDHMFTISNRTELAPISVIITTLASWAYAECVTQRLHTNAFDFIIGVIREMPSFIKTEMRFGQKYFIIENETTSGENFADKWNHDSRLATAFNEWHKDALTSIESLLMIEGIDRFAESLSHKFGAKKELVRETLASINKPINEARTAGSLIIAPALGLTSAPALGSVTVPKNTFFGR

SEQ ID NO: 488 - protein, 384 aa, Methylotenera sp.
MVVSLLDQLCQQLDITETQYQTAKDRYEAVGIWLADSPLQALNDAKIYPQGSIALGTAIKPIGSNEFDVDLVCYLPGLAVNSYPHQVKALIGSRLKEHGTYRGMLEEKQRCWRINYANEFHLDITPSIDNPHCYQGGELVPDKKLAEWKPTNPKGYIKKIEEYSALNPHFNLLEKSFAEARADIAPLPEQSMTKPVLKRIIQLLKRHRDHMFTISNRTELAPISVIITTLASWAYAECVTQRLHTNAFDFIIGVIREMPSFIKTEMRFGQKYFIIENETTSGENFADKWNHDSRLATAFNEWHKDALTSIESLLMIEGIDRFAESLSHKFGAKKELVRETLASINKPINEARTAGSLIIAPALGLTSAPALGSVTVPKNTFFGR

SEQ ID NO: 489 - protein, 383 aa, Burkholderia territorii
MLVQTLDRLCDELELSTSRYQQAQERYEAVGDWLAGSEDSFLSSALIYPQGSIALGTTVKPLNQAEFDVDLVCFLPTIAEKSSPAAVKALVGNRLKEHEKYGGMLEEKQRCWRINYANEFHLDITPAITNEMCAHGGELVPDRKLATWKATNPRGYCANFERRAAMRPRLYAFDRAIAKADSVQGFPVQQMSKSPLKRIVQLLKRHRDEAFSAPAARELAPISVIITTLAAYSYERCITHSLYADMYELIVDVITRMPDFIQRIDRGGRIEYWIDNDATLGENFAEKWNHDPRLPTAFFSWYAKALEDLSELIKLEGQDVIAERLTKAYGATRDQAIAALGGHVRSLNVARASGSLVFAPSVGLTTQAIGKATPVRSNTFFGD

SEQ ID NO: 490 - protein, 399 aa, Burkholderia territorii
MNNDRQIHELSPYKRSLLVQTLDRLCDELELSTSRYQQAQERYEAVGDWLAGSEDSFLSSALIYPQGSIALGTTVKPLNQAEFDVDLVCFLPTIAEKSSPAAVKALVGNRLKEHEKYGGMLEEKQRCWRINYANEFHLDITPAITNEMCAHGGELVPDRKLATWKATNPRGYCANFERRAAMRPRLYAFDRAIAKADSVQGFPVQQMSKSPLKRIVQLLKRHRDEAFSAPAARELAPISVIITTLAAYSYERCITHSLYADMYELIVDVITRMPDFIQRIDRGGRIEYWIDNDATLGENFAEKWNHDPRLPTAFFSWYAKALEDLSELIKLEGQDVIAERLTKAYGATRDQAIAALGGHVRSLNVARASGSLVFAPSVGLTTQAIGKATPVRSNTFFGD

SEQ ID NO: 491 - protein, 399 aa, Burkholderia ubonensis
MNNDRQIHELSPYKRSLLVQTLDRLCDELELSTSRYQQAQERYEAVGDWLAGSEDSFLSSALIYPQGSIALGTTVKPLNQAEFDVDLVCFLPTIAEKSSPAAVNALVGNRLKEHEKYDGMLEEKQRCWRINYANEFHLDITPAITNEMCAHGGELVPDRKLATWKATNPRGYCANFERRAAMRPRMYAFDRAIAKADSVQGFPEQQMSKSPLKRIVQLLKRHRDEAFSAPAARELAPISVIITTLAAYSYERCITHSVYADMYELIVDVITRMPDFIQRIDRGGRIEYRIDNDATLGENFAEKWNHDPRLPTAFFSWHAKALEDLSELIKLEGQDVIAERLTKAYGATRDQAIAALGGHVRSLNVARASGSLVFAPSVGLTTQAIGKATPVRSNTFFGD

SEQ ID NO: 492 - protein, 383 aa, Burkholderia ubonensis
MLVQTLDRLCDELELSTSRYQQAQERYEAVGDWLAGSEDSFLSSALIYPQGSIALGTTVKPLNQAEFDVDLVCFLPTIAEKSSPAAVNALVGNRLKEHEKYDGMLEEKQRCWRINYANEFHLDITPAITNEMCAHGGELVPDRKLATWKATNPRGYCANFERRAAMRPRMYAFDRAIAKADSVQGFPEQQMSKSPLKRIVQLLKRHRDEAFSAPAARELAPISVIITTLAAYSYERCITHSVYADMYELIVDVITRMPDFIQRIDRGGRIEYRIDNDATLGENFAEKWNHDPRLPTAFFSWHAKALEDLSELIKLEGQDVIAERLTKAYGATRDQAIAALGGHVRSLNVARASGSLVFAPSVGLTTQAIGKATPVRSNTFFGD

SEQ ID NO: 493 - protein, 399 aa, Burkholderia stagnalis
MNNDRQIHELSPYKRSLLVQTLDRLCDELELSTSRYQQAQERYEAVGDWLAGSEDSFLSSALIYPQGSIALGTTVKPLNQAEFDVDLVCFLPTIAEKSSPAAVKALVGNRLKEHGKYDGKLEEKQRCWRINYANEFHLDITPAITNEMCAHGGELVPDRKLATWKATNPRGYCANFERRAAMRPRMYAFDRAIAKADSVQGFPEQQMSKPPLKRIVQLLKRHRDEAFSAPAARELAPISVIITTLAAYSYERCITHSVYADMYELIVDVITRMPDFIQRINRGERIEYRIDNDATLGENFAEKWNHDPRLPTAFFSWHAKALEDLSELIKLEGQDVIAERLTKAYGATRDQAIAALGGHVRSLNVARASGSLVFAPSVGLTTQAIGKTTPVRSNTFFGD

SEQ ID NO: 494 - protein, 383 aa, Burkholderia stagnalis
MLVQTLDRLCDELELSTSRYQQAQERYEAVGDWLAGSEDSFLSSALIYPQGSIALGTTVKPLNQAEFDVDLVCFLPTIAEKSSPAAVKALVGNRLKEHGKYDGKLEEKQRCWRINYANEFHLDITPAITNEMCAHGGELVPDRKLATWKATNPRGYCANFERRAAMRPRMYAFDRAIAKADSVQGFPEQQMSKPPLKRIVQLLKRHRDEAFSAPAARELAPISVIITTLAAYSYERCITHSVYADMYELIVDVITRMPDFIQRINRGERIEYRIDNDATLGENFAEKWNHDPRLPTAFFSWHAKALEDLSELIKLEGQDVIAERLTKAYGATRDQAIAALGGHVRSLNVARASGSLVFAPSVGLTTQAIGKTTPVRSNTFFGD

SEQ ID NO: 495 - protein, 399 aa, Burkholderia gladioli
MNNDRQIHELSPYKRSLLVQTLDRLCDELELSTCRYQQAQERYEAVGDWLAGSDDSFLSSALIYPQGSIALGTTVKPLNQAEFDVDLVCFLPTIAEKSSPAAVKALVGNRLKEHGKYDGMLEEKQRCWRINYANEFHLDITPAITNEMCAHGGELVPDRKLAIWKATNPRGYCANFERRAAMRPLMYAFDRAIAKADSVQDFPEQQMSKPPLKRIVQLLKRHRDKAFSAPAARELAPISVIITTLAAYSYERCITQSVYADMYELIVDVITRMPDFIQRIDRGGRIEYRIDNDATLGENFAEKWNHDPRLATAFFSWHAKALEDLSELIKLEGQDVIAERLTKAYGATRDQAIAALGGHVRSMNFARASGYLLFAPSVGLTTQAIGKTTPVRSNTFFGD

SEQ ID NO: 496 - protein, 399 aa, Burkholderia sp.
MKNDRQIQEISRYKRNLLVQTLDRLCDELELSASRYQQAQERYEAVGDWLAGSDNSFLSSALIYPQGSIALGTTVKPLNQTEFDVDLVCFLPTIAERSSPAAVKALVGDRLREHGKYDGMLEEKQRCWRINYANEFHLDITPAITNEMCVQRGELVPDRKVANWKATNPRGYRANFERRAALRPRLYAFDRAIAKADSVQSFPEQQMSKPPLKRIVQLLKRHRDEAFSAPAARELAPISVIITTLAAYSYERCVTKNAYADMYELIVDVITHMPDFIQHIDRGGHIEYRIDNDATLGENFAEKWNHDPRLPITFFSWHTKALEDLSELLKLEGQDVIAERLAKTYGATRDQAIAALGGHVRSLHVARGNGSLFFAPSIGLTTQAVGNTTSVRSNTFFGD

SEQ ID NO: 497 - protein, 399 aa, Burkholderia cenocepacia
MNNERQIQELSSYKRSLLVQTLDRLCDELELSVSRYQQAQERYEAVGDWLAGSGDRFLSSALIYPQGSIALGTTVKPLNQTEFDVDLVCFLPTIGDKSSPAAVKALVGDRLREHGKYDGMLEEKQRCWRINYANEFHLDITPAITNVMCVHAGELVPDKKLANWKASNPRGYRANFERRAAMRPRLYAFDRALAKADSVQNFPEQQMSKPPLKRIVQLLKRHRDEAFSSPAMREFAPISVIITTLVAYSYERCVTKGVYADMYELIVAVIKHMPDFIQRIDRDGRLEYWIDNDATLGENFAEKWNHDSRLPIAFFSWHTKVLEDLSDLIQLEGQDVIAERLTKAYGATRDQAIAALGGHVRSLNVARRSGSLLFTPSVGLTTQAIGKTTAVRSNTFFGD

SEQ ID NO: 498 - protein, 394 aa, Paraburkholderia sordidicola
MHEFASHKRSALVRALDRLCQELELPPSRYDEARERYESVGGWLAGSENKFLTVATVYPQGSIALGTTVKPLNRAEFDVDLVCFLPTIGATSSPAGVKALVGDRLKEHGHYEGMLEEKQRCWRINYANEFHLDITPAISNDMCMYGGEFVPDKSLRDWKPTNPQGYKNNFERRAALRPRFYALEKRAKITADSVDSFPEQELTKPPLKRLVQLLKRHRDQVFSGRDVREWMPISVIVTTLTANAYEYCVTNHVYVDMYELLCDVIRRMPDSIRRVEVSAKTQYFIDNDATTGENFAEKWNRDPRLPEAFYDWHKRVLDDLSQLLQIEGQDVIAEHFIKSYGATRSQATAALGSPIASATAARSNGSLLVVPTLGLTTDMRPDATQVRPNTFFGD

SEQ ID NO: 499 - protein, 400 aa, Caballeronia sordidicola
MNNDRQIHEFASHKRSALVRALDRLCQELELPPSRYDEARERYESVGGWLAGSENKFLTVATVYPQGSIALGTTVKPLNRAEFDVDLVCFLPTIGATSSPAGVKALVGDRLKEHGHYEGMLEEKQRCWRINYANEFHLDITPAISNDMCMYGGEFVPDKSLRDWKPTNPQGYKNNFERRAALRPRFYALEKRAKITADSVDSFPEQELTKPPLKRLVQLLKRHRDQVFSGRDVREWMPISVIVTTLTANAYEYCVTNHVYVDMYELLCDVIRRMPDSIRRVEVSAKTQYFIDNDATTGENFAEKWNRDPRLPEAFYDWHKRVLDDLSQLLQIEGQDVIAEHFIKSYGATRSQATAALGSPIASATAARSNGSLLVVPTLGLTTDMRPDATQVRPNTFFGD

SEQ ID NO: 500 - protein, 308 aa, Citreicella sp.
MNKIFSSPLTDTAIQRRARVFTILEEICQELEWTQTQFEKARTSYEAVADWLAGSSDPMLASLHVYLHGSGALGTSIKPIGRDEFDVDLISFILGLGPEIAPARLKAAIGQRLREHAYYASILEEKKRCWRLNYAGDFHLDISPTIANPNCKNGGELVPDRELRNWHVTNPRAYRALFDERAALVPTMTQSIIAAQRDAATTEPFPVRQSVKGILRRTVQLLKRHRDLEFLHVQEEVAPISIIITTLAMRSYEMCVRSRGLTPFRAASREPMLAGVSPLSGETVSANRTLCISSSGTLLHKSREGFIS

SEQ ID NO: 501 - protein, 399 aa, Pseudooceanicola batsensis
MNQIFSHPLTDTAIQRRAQVFTILDEICQELEWTQTQFEKARTSYEAVADWLAGSSDPMLASLHVYLHGSGALGTSIKPIGRDEFDVDLISFILGLGPEIAPARLKASIGKRLREHAYYASILEEKKRCWRLNYAGDFHLDISPTIANPNCVNGGELVPDRKLRDWHATNPRAYRALFDERAALIPRMTQSIIAAQRDAATTEPFPVRQSVKGILRRTVQLLKRHRDLEFLHVQEEIAPISIIITTLAMRSYEMCVRRHVFADELQVLIDTIRLMPIFIERPLVNGRQIYAVWNETTEGENFAERWNEEPARVEAFYKWHGKALADFESLRDLVGLDAIVGSMKDSLGDKLVARTMNRRMDALNEGRKTGALVLGAGVGLTTQKSAASTPVPRNEFFGD

SEQ ID NO: 502 - protein, 399 aa, Rhodobacter sp.
MNQIFSHPLTDTAIQRRAQVFTILEEICQELEWTQTQFEKARTSYEAVADWLAGSSDPMLGSLHVYLHGSGALGTSIKPIGRDEFDVDLISFILGLGPEIAPARLKAAIGKRLREHAYYTSILEEKKRCWRLNYAGDFHLDISPTIANPNCMNGGELVPDRKLRDWHATNPRAYRALFDDRAALVPRMTQSIIAAQRDAATIEPFPVRQSVKGILPRAVQLLKRHRDLEFLHVQEEIAPISIIITTLAMRSYEMCVRRHVFADELQVLIDTIRLMPIFIERPLVNGRQIYAVWNETTEGENFAERWNEEPARVEAFYKWHGKALADFEALRDLVGLDAIVGSMKDSLGDKLVSRTMNRRMDALNEGRKTGALVLGAGVGLTTQKSVASTPVPKNEFFGD

SEQ ID NO: 503 - protein, 399 aa, Roseovarius atlanticus
MNQIFSHPLTDTAIQRRAQVFTILEEICQELEWTQTQFEKARTSYEAVADWLAGSSDPMLASLHVYLHGSGALGTSIKPIGRDEFDVDLISFILGLGPEIAPMCLTAAIGQRLREHAYYASILEEKKRCWRLNYAGDFHLDISPTIANPNCVNGGELVPDRKLRDWHATNPRAYRALFDERAALVPRMTQSIVAAQRDAATTEPFPVRQSVKGILRRTVQLLKRHRDLEFLHVQEEIAPISIIITTLAMRSYEMCVRRHVFVDELQVLIDTIRLMPIFIERPLVNGRQIYAVWNETTQGENFAERWNEEPARVEAFYKWHSKALADFESLRDLVGLDAIVGSMKDSLGDKLVARTMNRRMDALNEGRKTGALMLGAGVGLTTQKSAASTPVPRNEFFGD

SEQ ID NO: 504 - protein, 399 aa, Aestuariivita atlantica
MNQIFSHPLTDTAIQRRAQVFTILEEICQELEWTQTQFEKARTSYEAVADWLAGSSDPMLASLHVYLHGSGALGTSIKPIGRDEFDVDLISFILGLGPEIAPARLKAAVGKRLREHAYYASILEEKKRCWRLNYAGDFHLDISPTIANPNCMNGGELVPDRKLRDWHATNPRAYRTLFDERAALVPQMTQSIIAAQRDAATTEPFPVRQSVKGILRRTVQLLKRHRDLEFLHVHEEIAPISIIITTLAMRSYEMCVRRHVFADELQVLIDTIRLMPVFIERPLVNGRQIYAVWNETTEGENFAERWNEEPARVEAFYKWHSKALADFESLRDLVGLDAIVGSMKDSLGDKLVARTMNRRMDALNEGRKTGALVLGAGVGLTTQKSAASTPVPKNEFFGD

SEQ ID NO: 505 - protein, 399 aa, Roseovarius halotolerans
MNQIFSHPLTDTAIQRRAQVFTILEEICQELEWTQTQFEKARTSYEAVADWLAGSSDPMLASLHVYLHGSGALGTSIKPIGRDEFDVDLISFILGLGPEIAPARLKAAIGKRLREHAYYASILEEKKRCWRLNYAGDFHLDISPTIANPNCMNGGELVPDRKLRDWHATNPRAYRTLFDERAALVPQMTQSIIAAQRDAATTEPFPVRQSVKGILRRTVQLLKRHRDLEFLHVQEEIAPISIIITTLAMRSYEMCVRRHVFADELQVLIDTIRLMPVFIERPLVNGRQIYAVWNETTEGENFAERWNEEPARVEAFYKWHSKALANFESLRDLVGLDAIVGSMKDSLGDKLVARTMNRRMDALNEGRKTGALVLGAGVGLTTQKSAASTPVPKNEFFGD

SEQ ID NO: 506 - protein, 399 aa, Thioclava sp.
MNQIFSHPLTDTAIQRRAQVFTILEEICQELEWTQTQFEKARTSYEAVADWLSGSSDPMLASLHVYLHGSGALGTSIKPIGRDEFDVDLISFILGLGPAIAPARLKAAIGKRLREHAYYASILEEKKRCWRLNYASDFHLDISPTIANPNCINGGELVPDRKLRDWHATNPRAYRTLFDERAALVPRMTQSIIAAQRDAATTEPFPVRQSVKGILRRTVQLLKRHRDLEFLHVQEEIAPISIIITTLAMRSYEMCVRRHVFADELQVLIDTIRLMPVFIERPLVNGRQIYAVWNETTEGENFAERWNEEPARVEAFYKWHGKALADFESLRDLVGLDAIVGSMKDSLGDKLVARTMNRRMDALNEGRKTGALMLGAGVGLTTQKSTASTPVPKNEFFGD

SEQ ID NO: 507 - protein, 399 aa, Loktanella sp.
MNQIFSHPLTDTAIQRRAQVFTILEEICQELEWTQTQFEKARTSYEAVADWLAGSSDPMLASLHVYLHGSGALGTSIKPIGRDEFDVDLISFILGLGPEIAPARLKAAIGKRLREHAYYASILEEKKRCWRLNYAGDFHLDISPTIANPNCVNGGELVPDRKLRDWHATNPRAYRALFDERAAMVPRMTQSVMAAQRDAATTEPFPVRQSIKGILRRTVQLLKRHRDLEFLHVQEEIAPISIIITTLAMRSYEMCVRRHVFADELQVLIDTIRLMPVFIERPLVNGRQIYAVWNETTEGENFAERWNEEPARVEAFYKWHSKALADFESLRDLVGLDAIVGSMKDSLGDKLVARTMNRRMDALNEGRKTGALMLGAGVGLTTQKSAASTPVPKNEFFGD

SEQ ID NO: 508 - protein, 399 aa, Pseudooceanicola nanhaiensis
MNQNFSHTLTDTAIQRRAQVFTILEEICQELEWTQTQFEKARTSYEAVADWLAGSSDPMLASLHVYLHGSGALGTSIKPIGRDEFDVDLISFILGLGPEIAPARLKAAIGQRLREHAYYASILEEKKRCWRLNYAGDFHLDISPTIANPNCMNGGELVPDRKLRDWHATNPRAYRALFDERAALVPRMTQSIIAAQRDAATTEPFPVRQSVKGILRRTVQLLKRHRDLEFLHVQEEITPISIIITTLAMRSYEMCVRRHVFADELEVLIDTIRLMPVFIDRPLVNGRQIYAVWNETTNGENFAERWNEEPARVEAFYKWHSKALADFQSLRDLVGLDAIVGSMKDSLGDKLVARTMNRRMDALNEGRKTGALVLGAGVGLTTQQSAASTPVPKNEFFGD

SEQ ID NO: 509 - protein, 399 aa, Jannaschia seosinensis
MNQIFSQPLTDTAIQRRAQVFTILEEICQELEWTKTQFEKARTSYEAVADWLAGSSDCMLASLHVYLHGSGALGTSIKPIGRDEFDVDLISFILGLGPEIEPTRVKAAIGQRLREHAYYASILEEKKRCWRLNYAGDFHLDISPTIANPNCINGGELVPDRKLRDWHVTNPRAYRALFDERAALVPRMTQSITAEQRDAATIEPFPVRQSVKGILRWTVQLLKRHRDLEFLHVEEEIAPISIIITTLAMRSYEMCVRRHVFVDELQVLIDTIRLMPVFIERPLVNGCQIYAVWNETAEDENFAERWNEEPARVEAFYKWHRKALADFEALRDLVGLDAIVGSMKQSLGDRLVSRTINRRMDVLNEGRKTGALMLGAGVGLTTQRSAASTPVAKNEFFGD

SEQ ID NO: 510 - protein, 402 aa, Devosia sp.
MGQTLSRSATPDYVLRRKGEAYTILDEICQELELSEAQYEAAKTSYEAVADWLGKSTHPTLRMLSLYAHGSTALGTTVRPLAREDFDVDLICLVLGLTGDMPPAELKKLIGDRLREHGQYAAMLEEKKRCWRLNYAREFHLDISPTIPNPHCNNRGELVPDKSLRAWKPTNPLGYRLRFEEYCLLQPVIRALATAAADSVAKADIQPFPARRVRKGILRRIVQLLKRHRDIAFADIEADIAPISIIITTLAAKAYAFCVRQFVFDTELDVVVATIRMMPHFIERPYVDGRRTYSIPNETTEGENFADRWNQEPERATAFYNWHAKALSDFESIANLEGLDLLTDTLSGSLGGRVVRKVMDSRTEVISQARSAQRLFVAPAVGLTLTPGAQASPVPRNTHFGD

SEQ ID NO: 511 - protein, 400 aa, Notoacmeibacter marinus
MNETSQFQIPDHIRLRKSELYSILDDICLDLEPTTTQSESAETSYETVAGWLSQSEHDALQQIDVYAHGSMALGTTVRPLGQKEFDVDLICLSRRYPSHGSPAELKKIVGDRLRDHDYYASILEEKKRCWRLNYAGQYHLDISPTITNFTCDNGGELVPDKKLEEWKPTNPRGYRRLFEHRANLLPRMKIQERIAASQDHANIEPYPVHTGPKGILRRIVQLLKRHRDVAFEEVTKDIAPISIIITTLAARSYEFCVNTFTFDTELDVLVATIRLMPHFIERPYVDGRRMYVVPNETTAGENFAERWNTEPERARAFYRWHAKALSDFEKLEQLQGLDVVTMSIGESLGSRVVGRVMDARTENISNARNKKMLYMAPAVGLSLTKTAEATPVPGNTFFGD

SEQ ID NO: 512 - protein, 400 aa, Mesorhizobium sp.
MNQMLLASSTAYSPLRKAEIYSLLDEICQMLELTAAQFEAARTSYEAVAEWLSASDNPILRLIEVYAHGSAGLGTTVRPIAREDFDVDLICKVLRFTADRLPAELKRIVGDRLKENARYASMLEEKKRCWRLNYAREYHLDISPTIVNTECANGGELVPDKKLREFKPTNPKGYKALFDRRASLRPVLRINKALAAQDRAAGVEPFPVHSVAKGILRRIVQLLKRHRDIHFFEVTEDVAPISIIITTLAAQAYEYCVTNFPFDSELDVVIETIRMMPHFIERPFVNGRRLYVVANETAIGENFAERWNTEPARATAFYAWHGKALADFEGLRDLEGVDLIARSLGKSLGDSVVEKVMDSRTQAVSQARVGNKLYVAPAVGLTLSTPANATQVRPNTFFGD

SEQ ID NO: 513 - protein, 399 aa, Mesorhizobium sp.
MNELARSLVPQRVLLRKSEIYSILDEICQDLELTTAQMQAAKASYEAVADWLSSSDNSVLQHIDVYPHGSAGLGTSVKPLGREDFDVDVICLVFRFASVRPPAELKKIVGDRLRENARYAAMLEEKKRCWRLNYAREFHLDVSPTIVNPGCNNGGELVPDKSLSEFKPTNPKGYRALFEKRALMRPRLKVQKAIASDRQANIEPFPVHMRVKGILRRTVQLLKRHRDIYFFDIEADIAPISIVITTLAAQAYECCVNTFTFDSELDVVIATIRMMPHFIDRPFVNGQRMYVVANETTIGENFAERWNKEPARATAFYAWHAKALADFENLAELEGLDRITKKLGDSYGKTVVARVMDARTEQISGARAAQKLFVAPMIGLTLTNSAAATAVPKNTYFGD

SEQ ID NO: 514 - protein, 399 aa, Unknown
  Description of Unknown: Mesorhizobium sequence
MNELARSLVPQNVLLRKSEIYSILDEICQDLELTTAQMQAAKASYEAVADWLSSSDNPVLQHIDVYPHGSAGLGTSVKPLGREDFDVDVICLVFRFASVRPPAELKKIVGDRLRENARYAAMLEEKKRCWRLNYAREFHLDVSPTIVNPSCNNGGELVPDKSLSEFKPTNPKGYRALFEKRALMRPRLKVQKAIASDRQANIEPFPVQMRVKGILRRTVQLLKRHRDIYFFDIEADIAPISIVITTLAAQAYECCVNTFTFDSELDVVIATIRMMPHFIDRPFVNGQRMYVVANETTIGENFAERWNKEPARATAFYAWHAKALADFENLAELEGLDRITKKLGDSYGKTVVARVMDARTEQISGARAAQKLFVAPMVGLTLTNSAAATAVPKNTYFGD

SEQ ID NO: 515 - protein, 399 aa, Roseovarius mucosus
MNQMLRQLLTDSDIRRRTQIFTILDEIGEDLDLTETQFDRARQSYGAVGDWLSGSTDPLLVSVLVYLQGSNALGTAVKPIGRREFDVDLICFCAGIASGISPATLKAAVGNRLKEHATYVRLLEEKKRCWRLNYAGDFHLDLSPTIANPVCGNRGELVPDRALKEWHPTNPRAYKTLFDERAALRPTFVGKFIAMQRDEATVEPFPVREAVKGILRRIVQLLKRHRDVFYQNNTQDVAPISVIITTLAMQSYAYCVRNHVFHDEMDLLVETIRMMPHFIDRPILDGRRGYAILNETTNGENFADNWNKDERRAPAFYAWHAQALSDFEVLRDAVGQDRVSLNMERSFGSGVTGRVLGNRVNAVSDGRKSGLLSVAPVVGLTTSKVAASTTVPTNTFFGD

SEQ ID NO: 516 - protein, 399 aa, Roseovarius mucosus; identical to SEQ ID NO: 515

SEQ ID NO: 517 - protein, 399 aa, Unknown
  Description of Unknown: Rhodobacteraceae sequence
MNQMLRQPLTDSDIRRRTQIFTILDEIGEDLDLTETQFDRARQSYGAVGDWLSGSTDPLLVSVLVYLQGSSALGTAVKPIGRREFDVDLICFCAGIASGISPATLKAAVGNRLKEHATYVRLLEEKKRCWRLNYAGDFHLDLSPTIANPVCGNRGELVPDRALKEWHPTNPRAYKTLFDERAALRPTFVGKFIAMQRDEATVEPFPVREAVKGILRRIVQLLKRHRDVFYQNNTQDVAPISVIITTLAMQSYAYCVRNHVFHDEMDLLVETIRMMPHFIDRPILDGRRGYAILNETTNGENFADNWNKDERRAPAFYAWHAQALSDFEVLRDAVGQDRVSLNMERSFGSGVTGRVLGNRVNAVSDGRKSGLLSVAPVVGLTTSKVAASTTVPTNTFFGD

SEQ ID NO: 518 - protein, 399 aa, Unknown
  Description of Unknown: Rhodobacteraceae sequence
MNQMLRQPLTDSDIRRRTQIFTILDEIGEDLDLTETQFDRARQSYGAVGDWLSGSTDPLLVSVLVYLQGSSALGTAVKPIGRREFDVDLICLCAGIASGISPATLKAAVGNRLKEHATYVRLLEEKKRCWRLNYAGDFHLDLSPTIANPVCGNRGELVPDRALKEWHPTNPRAYKTLFDERAALRPTFVGKFIAMQRDEATVEPFPVREAVKGILRRIVQLLKRHRDVFYQNNTQDVAPISVIITTLAMQSYAYCVRNHVFHDEMDLLVETIRMMPHFIDRPILDGRRGYAILNETTNGENFADNWNKDERRAPAFYAWHAQALSDFEVLRDAVGQDRVSLNMERSFGSGVTGRVLGNRVNAVSDGRKSGLLSVATVVGLTTSKVAASTTVPTNTFFGD

SEQ ID NO: 519 - protein, 399 aa, Roseovarius indicus
MNQMLRQPLTDSDIRRRTQIFTILDEIGEDLDLTETQFDRARQSYGAVGDWLSGSTDPLLVSVLVYLQGSSALGTAVKPIGRREFDVDLICFCAGIASGISPATLKAAVGNRLKEHATYARLLEEKKRCWRLNYAGDFHLDLSPTIANPVCGNRGELVPDRALKEWHPTNPRAYKTLFDERAALRPTFVGKFIAMQRDEATVEPFPVREAVKGILRRIVQLLKRHRDVFYQNNTQDVAPISVIITTLAMQSYAYCVRNHVFHDEMDLLVETIRMMPHFIDRPILDGRRGYAILNETTNGENFADNWNKDERRAPAFYAWHAQALSDFEVLRDAVGQDRVSLNMERSFGSGVTGRVLGNRVNAVSDGRKSGLLSVAPVVGLTTSKVAASTTVPTNTFFGD

SEQ ID NO: 520 - protein, 399 aa, Thalassobacter stenotrophicus
MNQMLRQPLTDSDIRRRTQIFTILDEIGEDLDLTETQFDRARQSYGAVGDWLSGSTDPLLVSVLVYLQGSSALGTAVKPIGRREFDVDLICFCAGIASGISPATLKAAVGNRLKEHATYVRLLEEKKRCWRLNYAGDFHLDLSPTIANPVCGNRGELVPDRALKEWHPTNPRAYKTLFGERAALRPTFVGKFIAMQRDEATVEPFPAREAVKGILRRIVQLLKRHRDFFYQNNTQDVAPISVIITTLAMQSYAYCVRNHVFHDEMDLLVETIRMMPHFIDRPILDGRRGYAILNETTNGENFADNWNKDERRAPAFYAWHAQALSDFEVLRDAVGQDRVSLNMERSFGSGVTGRVLGNRVNAVSDGRKSGLLSVAPVVGLTTSKVAASTTVPTNTFFGD

SEQ ID NO: 521 - protein, 399 aa, Sulfitobacter noctilucicola
MNQMLRQPLTDCDIRRRMQIFTILDEIGEDLDLTETQFDRARQSYGAVGDWLSGSTDPLLVSVLVYLQGSSALGTAVKPIGRREFDVDLICFCAGIASGISPATLKAAVGNRLKEHATYVRLLEEKKRCWRLNYAGDFHLDLSPTIANPVCGNRGELVPDRALKEWHPTNPRAYKTLFDERAALRPTFVGKFIAMQRDEATVEPFPVREAVKGILRRIVQLLKRHRDVFYQNNTQDVAPISVIITTLAMQSYAYCVRNHVFHDEMDLLVETIRMMPHFIDRPILDGRRGYAILNETTNGENFADNWNKDERRAPAFYAWHAQALSDFEVLRDAVGQDRVSLNMERSFGSGVTGRVLGNRVNAVSDGRKSGLLSVAPVVGLTTSKVAASTTVPTNTFFGD

SEQ ID NO: 522 - protein, 399 aa, Rhodobacteraceae bacterium
MNQMLRQPLTDSDIRRRTQIFTILDEIGEDLDLTETQFDRARQSYGAVGDWLSASTDPLLVSVMVYLQGSSALGTAVKPIGRREFDVDLICFCAGIASGISPAVLKAAVGNRLKEHATYVRILEEKKRCWRLNYAGDFHLDLSPTIANPACINRGELVPDRALKEWHPTNPKAYKILFDKRAALQPTFVGKFIAMQRDEAKVEPFPVREAVKGILRRIVQLLKRHRDVFYENNTQDVAPISVIITTLAMQSYAYCVRKHVFQDEMDLLVETIRMMPHFIDRPILDGRRGYAILNETTNGENFADNWNKDERRAPAFYAWHAQALSDFEALRDAVGQDRLSLNMERSFGSGVTGRVLGNRVNAVSDGRKSGLLSVAPVVGLTTSKVAASTTVPANTFFGD

SEQ ID NO: 523 - protein, 400 aa, Defluviimonas alba
MNQMLRQPLTDNDIRRRKQIFSILDELGEDLDLTETQFVRARQSYGAVGDWLSGSTDPLLISVLVYLHGSSALGTAVKPIGRREFDVDLICFCAGIASGISPAVLKAAVGNRLKEHASYVRILEEKKRCWRLNYAGDFHLDLSPTIANPLCINRGELVPDRTLKEWHPTNPRAYKILFDERAALRPTFAGKIIAMQRDEATVEPFPVREAVKGILRRIVQLLKRHRDVFYENNTEDVAPISIIITTLAMQAYAYCVRRHAFEDEMDVVVETIRMMPHFIERPILDGRRGYAVLNETTDGENFADNWNKDERRAPAFYAWHARALSDFEALRDAVGQDRLSLNMEHSFGPGVTGRVLGNRINAVSEGRKSGLLSVAPLIGLTTSRVTASTAVPVNTFFGDR

SEQ ID NO: 524 - protein, 400 aa, Roseisalinus antarcticus
MNQMLRQPLTDNDIRRRTQIFTILDEIGEDLDLTEAQFERARQSYGAVGDWLSGSTDPLLVSVMVYLHGSSALGTAVKPIGRREFDVDLICFCAGIASGISPAVLKAAVGNRLKEHATYVRLLEEKKRCWRLNYAGDFHLDLSPTIANPACFNRGELVPDRALKAWHPTNPRAYKILFDERAALRPTFAGKLIAMQRDEATVEPFPVREAVKGILRRIVQLLKRHRDVFYEDNTEDVAPISIIITTLAMQAYAYCVRRHVFEDEMDVVVETIRMMPHFIERPILDGRQGYAILNETTDGENFADNWNKDARRAPAFYAWHARALSDFEALRDSVGQDCLSVNMERSFGPVVTGRVLGNRINAVSDGRKSGLLSVAPLIGLTTSQVAASTAVPANTFFGDQ

SEQ ID NO: 525 - protein, 400 aa, Sulfitobacter brevis
MNQVLRQPLTDSDIRRRTHIFSILNEIGEDLDLTETQFDRARQSYGAVGDWLSSSNDPLLVSVLVYLQGSSALGTAVKPIGRREFDVDLICFCAGVASGISPATLKEAVGNRLKEHVTYARLLEEKKRCWRLNYAGDFHLDLSPTIVNPFCANRGELVPDQTLQEWHPTNPRAYKTLFDERAALRPTFVGKLVAKQRDEATVEPFPVRETVKGILRRIVQLLKRHRDVFYENNTEDVAPISVIITTLAMQAYAYCVRRHVFKDEMDVLVETIRMMPHFIERPILDGHQSYAILNETTNGENFADNWNKDARRAPAFYTWHARAVADFEALRDAVGQDRLSLNMERSFGSRVTGRVLDSRIGAVSDGRKSGLLFVAPLIGLTTSKVAASTVVPANTFFGDQ

SEQ ID NO: 526 - protein, 399 aa, Paracoccus sediminis
MNQMLRQPLTDSDIRRRTQIFSILDEIGEALDLTETQFDRARQSYNAVGDWLSGSADPLLVSVLVYLQGSTALGTAVKPIGRREFDVDLICFCAGVTSGISPTALKVAVGNRLKEHAIYVRLLVEKKRCWRLNYAGDFHLDLSPTIANPLCINRGELVPDRTLKDWHPTNPRAYKSLFDERAALQPTFVGRFIAMQRDKATVEPFPVREGVKGILRRIVQLLKRHRDVFYENNTEDVAPISIIITTLAMQAYAYCVRQHVFEDEMDVVVETIRMMPHFIERPVLNGRQVYAILNETTDGENFADNWNKDARRAPAFYAWHARVLSDFEALRDAVGQDRLSLNMERSFGSGVTGRVLGKRVGVVSEGRKSGLLSVAPLIGLTTSKVATSTAVPVNTFFGD

SEQ ID NO: 527 - protein, 207 aa, Jannaschia helgolandensis
MNQMLRQPLTDSDIRRRTQIFTILDEIGEDLDLTETQFDRARQSYGAVGDWLSGSTDPLLVSVLVYLQGSSALGTAVKPIGRREFDVDLICFCAGIASGISPATLKAAVGNRLKEHATYVRLLEEKKRCWRLNYAGDFHLDLSPTIANPVCGNRGELVPDRALKEWHPTNPRAYKTLFDERAALRPTFVGKFIAMQRDEATVEPFPV

SEQ ID NO: 528 - protein, 402 aa, Stappia sp.
MNTLEHRFPIDRDWRRRVEIYRYLEEIGQDLDLTEAQVEKARQEHDKLCKWLAAALEPLLTDIVVYPHGSFALGTANKPLGRAEFDIDLICLLKRGHAGLDPASIKKLIGTRLREHPEYRKILEEKKRCWRLNFPGDFHIDVAGTIPNPKCVNDGELVPDKALKEWHPTNPRGFKNLFERRTMLQPRFKRSFVALSKGDAAAAQIEPFPEQSKIKGVLRRLVQLLKRHRDHHFLEIEQDVAPISVIITTLAMRSYEHCVSWYTFSDELELLVEVIRMMPHFIENGSLDGRTIYAVWNETTEGENFADRWNAEPERAKAFYAWHKKALSDFEAVRDAVGLDEVIGSSRNQFGQRVVDRVMSKRNKAVSDARKSNRLLVAPTIGLTTTPAAAAVPIPKNDFFGD

SEQ ID NO: 529 - protein, 399 aa, Afipia felis
MNYIAERARLRQSQLVDLIEEACQHLEPSAHQRDLAKQRYEGVGEWLAAADDWLLTSIAIRLQGSVAIGTTVKPIGKNEHDVDLVAHVADLDLTVSPALLKQRIGDRLRSNGHYAPLLVEMPRCWRLDYANEFHLDITPSIPNPECRFCGELVPDKTLKTWKASNPQGYRAKFERRAALLPRIRSVFGKAFDSAHANAQVEPYPEEKRLKGILRRIVQIAKRHRDIHFIDDDQGLAPLSIIITTLASRAYETCVSNFEYDHELDLIVDVLRRMPQMLQTSMTEGRVMWCLWNQTTAGENFCEKWNRHPERATAFFEWHSKVVADVEHLAAARGLDQVRRGLGDIFGTAPANKVMDTLTERVDIARRTNRLLATRSAGLIMSTAASATPVRANTFFGDGP

SEQ ID NO: 530 - protein, 398 aa, Nitrobacter sp.
MNELRSRTCAVAPIPAYVEEACQHLEPSASQQDLAKQRYEGVGGWLARSEDSLLASIEIRLQGSVAIGTTVKPLGANEHDVDLVAHVPDLDVAVSPAQLKHRIGDRLRSNGYYAPLLKEMPRCWRLDYANEFHLDITPSIPNPECRFGGELVPDKTLKTWKASNSMGYRAKFNRRAALLPRIRPALGMTFDSMRKVDVEPYPENKRLKGILLRIVQIAKRHRDLLFIDDNDGVAPLSIIITTLASRTYEICATNFEYDHELDLIVDVLRRMPSMLETGTFQGRAVWYLWNQTTSGENFCEKWNKYPERAIAFFEWHRRILADVELLARAQGLDQVRRRLGDVFGMGPANKAMDSLTERVDTARATGRLSVTKSAGLIMGTTAASATPVPANTFFGDRR

SEQ ID NO: 531 - protein, 385 aa, Nitrobacter sp.
MPAYVEEACQHLEPSASQQDLAKQRYEGVGGWLARSEDSLLASIEIRLQGSVAIGTTVKPLGANEHDVDLVAHVPDLDVAVSPAQLKHRIGDRLRSNGYYAPLLKEMPRCWRLDYANEFHLDITPSIPNPECRFGGELVPDKTLKTWKASNSMGYRAKFNRRAALLPRIRPALGMTFDSMRKVDVEPYPENKRLKGILLRIVQIAKRHRDLLFIDDNDGVAPLSIIITTLASRTYEICATNFEYDHELDLIVDVLRRMPSMLETGTFQGRAVWYLWNQTTSGENFCEKWNKYPERAIAFFEWHRRILADVELLARAQGLDQVRRRLGDVFGMGPANKAMDSLTERVDTARATGRLSVTKSAGLIMGTTAASATPVPANTFFGDRR

SEQ ID NO: 532 - protein, 399 aa, Bradyrhizobium elkanii
MNYISERAQLRQSQLADLIEEACQHLEPSPYQREVAQQRYEGVGDWLAKSQDPLLAEIAIRLQGSVAIGTTVKPMGAAEYDVDLVAHVPDIDAVISPAMLKHRIGDRLRANGHYAPLLVEMPRCWRLDYANEFHLDITPSIPNPGCAMGGELVPDKALKSWKASNPMGYRAKFERRAKLQARIRSAFGRILDSTIAKDSVEPYPKEMKLKGLLRRTVQIAKRHRDLEFIDDTDGLAPLSIIVTTLASRAYEFCVGNFVYDHELDLIVDLLRRMPNSIETRVNGNRVEWYLWNQTTVGENFCEKWNKHPERATAFFEWHAKLVADVEKLAAARGLDEVRHLLGDVVGRSPANAALDALTARVSTARTGNRLSVTKPAGLIVGTAVGSTPVRGNTFFGDPR

SEQ ID NO: 533 - protein, 390 aa, Bradyrhizobium elkanii
MRQSQLADLIEEACQHLEPSPYQREVAQQRYEGVGDWLAKSQDPLLAEIAIRLQGSVAIGTTVKPMGAAEYDVDLVAHVPDIDAVISPAMLKHRIGDRLRANGHYAPLLVEMPRCWRLDYANEFHLDITPSIPNPGCAMGGELVPDKALKSWKASNPMGYRAKFERRAKLQARIRSAFGRILDSTIAKDSVEPYPKEMKLKGLLRRTVQIAKRHRDLEFIDDTDGLAPLSIIVTTLASRAYEFCVGNFVYDHELDLIVDLLRRMPNSIETRVNGNRVEWYLWNQTTVGENFCEKWNKHPERATAFFEWHAKLVADVEKLAAARGLDEVRHLLGDVVGRSPANAALDALTARVSTARTGNRLSVTKPAGLIVGTAVGSTPVRGNTFFGDPR

SEQ ID NO: 534 - protein, 398 aa, Bradyrhizobium sp.
MNYIAERAQLRQTQLVELIEEACRHIEPSEPQRELAKQRYEGVGAWLARSDDWLLANIEIRLQGSVAIGTAVKPIGSLEHDVDLVAHVPDVEVAISPALLKQRIGDRLRANGKYAPLLKEMPRCWRLDYAGEFHLDITPSIPNPECRLGGELVPDKTLKDWKASNPLGYRTKIERRAAIQPRIRLIAKAADSAMAERQVEPFPENKRLKGLLRRTVQIAKRHRDIEFIDDKDGLAPLSIIITTLVSRAYEFCARSREYDHELALIVDVLEWMPNTIEQRVVGGRTEWYLWNQTTAGENFCEKWNKHPERAVAFFDWHAKLVNDVKQLAAAQGFDALRRLLVNVVGSRPANMVMDSLTEQVSVARNAGRLSVTKPAGLIIGSAASATSVRANTFFGDRL

SEQ ID NO: 535 - protein, 389 aa, Bradyrhizobium sp.
MRQTQLVELIEEACRHIEPSEPQRELAKQRYEGVGAWLARSDDWLLANIEIRLQGSVAIGTAVKPIGSLEHDVDLVAHVPDVEVAISPALLKQRIGDRLRANGKYAPLLKEMPRCWRLDYAGEFHLDITPSIPNPECRLGGELVPDKTLKDWKASNPLGYRTKIERRAAIQPRIRLIAKAADSAMAERQVEPFPENKRLKGLLRRTVQIAKRHRDIEFIDDKDGLAPLSIIITTLVSRAYEFCARSREYDHELALIVDVLEWMPNTIEQRVVGGRTEWYLWNQTTAGENFCEKWNKHPERAVAFFDWHAKLVNDVKQLAAAQGFDALRRLLVNVVGSRPANMVMDSLTEQVSVARNAGRLSVTKPAGLIIGSAASATSVRANTFFGDRL

SEQ ID NO: 536 - protein, 394 aa, Rhodopseudomonas palustris
MNYIDPRVQARPTLIVQALETVCESLELSQTQFDLAKQRYEGVGNYLARSEHPLLHNVAIYLQGSTALRTTVKPIGINEHDVDLVSHVPDQDTEVSPSALKKAIGDCLRANGNYAPLLEEMSRCWRLVYAGEFHMDITPSIKNPTCPNGGELVPDKVVKAWKASNPKGYRELFKERAKLTPIIRVRAFDEAAKASIEPYPKAGGFKGILRRIVQIAKRHRDVMFRDAPEDAPLSVIITTLASRSYAHCACNFEYDNELEFLLDVVRRMPDTIERNVSGGSLSWAIWNETTAGENFAEKWNHKPERALAFFDWHSRFVADMESLEAVIGLDRMGGKLRSLFGEHPAKAAIALLTEEVASARSNGALKVIPKVGLGTAAVATATPVRSNTFFGRKC

SEQ ID NO: 537 - protein, 396 aa, Mesorhizobium sp.
MNYLDPKLQARQTQIVEVLELVCQSLELTDAQFSLARQRYEGVGACLAGSDDPVLRAIAIYLQGSTALRTTVRPVGVNEHDVDLVAHVSDLDVAISPAALKKAIGDCLRANGNYAPLLEEMPRCWRLSYANEFHMDITPSIPNPGCRSGGELVPDKTLRAWKPSNPKGYRRLFEERAKLVPMIRLRKRIAKDSTHANIEPYPEAGGFKGILRRTVQISKRHRDIVFVDEPDLAPLSVIITTLAARSYEWCVRNHEYDNELELVLDVIDHMPDTIEAIPMDGRIQWFIWNETTAGENFAEKWNRHPERAESFYHWHRAFRADLAQLVAVSGLDRLSEALKGLFGSRPATAAMDSLTDRVTAARSGGNLFLAPKVGLIVGALPASTAVRANTFYGSNG

SEQ ID NO: 538 - protein, 398 aa, Rhizobium sp.
MFHDHRLIMRDGMLIGALERMCATFEIAPSQAELAKERYDGVGGWLAESEDPLLKAMGIFLQGSTAIGTTVKPIGSNEHDVDLVAHAPNLGNWVEPVALKKAIGDRLKANGHYKPLLVEMARCWRLVYANEFHMDITPSIPNRGCNMGGELVPDRALKIWKPSNPKGYKALFLERVKLAPRFRVAKSFHAEDRARADIEPYPEQVHFKGLLQRVVQILKRHRDVFIAVNEIDMSLSPISVLVTTLASQSYEYCVKTFTYDTELDLLFDVIRYMPDFIEARSVNGRMHWFVWNETTKGENFAEKWNGDPKRAEIFFTWHSRALADISRLKDVEGLDGLKRQLGDAFGSGPAKAVVDSITEDISTSRQNGTLGVAPRIGLVTGITTASVTPVRANTFFGR

SEQ ID NO: 539 - protein, 398 aa, Rhizobium leguminosarum
MFHNHRLVMRDGMLIGALERMCVTLEIAPSQADLAKERYEGVGGWLADAEDPLLKAMGIFLQGSTAIGTTVKPIGSNEHDVDLVAHAPYLGHWVEPTALKKAIGDRLKANGHYKPLLVEMARCWRLVYANEFHMDITPSIPNRNCTMGGELVPDRALKIWKPSNPKGYKALFLERVKLAPRFRVTKSLHTQDRARADIEPFPEQVHFKGLLQRVVQILKRHRDVFIAVNEIDISLSPISVLVTTLASQSYEYCVRTFIYESELDLLFDVIRHMPDFIETRRVDGQMQWFVWNETTMGENFSEKWNGDPKRAEIFFTWHTRALADISRLKDVEGLDGLKRQLGDAFGSAPAKAVIDSITDDISTSREKGTLGVAPRIGLVTGITTAAVTPVRANTFFGR

SEQ ID NO: 540 - protein, 398 aa, Rhizobium sp.
MFHDHRLVMRDGMLIGALERMCATLEIAPSQADLAKVRYEGVGGWLADAEDPLLKAMGIFLQGSTAIGTTVKPIGSNEHDVDLVAHAPYLGHWVEPAALKKAIGDRLKANGHYKPLLVEMARCWRLVYANEFHMDITPSIPNRDCTMGGELVPDRALKIWKPSNPKGYKALFLERVKLAPRFRVTKSLHTQDRARADIEPFPEQVHFKGLLQRVVQILKRHRDVFIAVNEIDISLSPISVLVTTLASQSYEYCVRTFIYDSELDLLFDVIRHMPDFIETRRVDGQMQWFVWNETTKGENFSEKWNGDPKRAEIFYTWHTRALADISRLKDVEGLDGLKRQLGDAFGSAPAKAVMDSITDDISTSRQRGTLGVAPRIGLVTGITTATATPVRANTFFGR

SEQ ID NO: 541 - protein, 398 aa, Agrobacterium vitis
MFHDHRLVMRDGMLIGALERMCVTLEISLSQAELAKERYDGVGGWLADAEDPLLKAMGIFLQGSTAIGTTVKPIGSNEHDVDLVAHAPYLGHWVEPAALKKAIGDRLKANGHYKPLLVEMARCWRLVYANEFHMDITPSIPNRNCHMGGELVPDRALKIWKPSNPKGYKALFLERVKLAPRFRVTKSLHTQDRARADIEPFPEQVHFKGLLQRVVQILKRHRDVFIAVNEIDISLSPISVLLTTLASKSYEYCVRTFIYDSELDLLFDVIRHMPDFIETRRVDGQMQWFVWNETTKGENFSEKWNGDPKRAEIFFTWHTRALADISRLKDVEGLDGLRRQLGDAFGSAPAKAVIDSITDDISTSRQKGTLGVAPRIGLVTGITTAAVTPVRANTFFGR

SEQ ID NO: 542 - protein, 398 aa, Shinella sp.
MYHDQRLIMRDGMLIGALERMCATLEISPSQATLAKERYEGVGEWLAGSEDPLLKLIGIFLQGSTAIGTTVKPIGSNEHDVDLVAHAPGLDDWVEPAALKTAIGDRLKANGHYKPLLVEMARCWRLVYANEFHMDITPSIPNPSCNMGGELVPDRALKMWKPSNPKGYKALFLERVKLAPRFRVTKSLNAQDRARADIEPYPEQVRFKGVLQRVVQILKRHRDVFISVNELDQCLSPISVLVTTLASQSYEYCVKTFIYDTELELLFDVIRHMPDFIEARSVNSRMHWFVWNETTKGENFAEKWNADPKRAEVFFAWHARALSDISRLRDAEGMDGLKRHLGDAFGPGPAKAVIDAITDEISASRRVGTLGVAPRIGLVTGIASAAATPVGANTFFGR

SEQ ID NO: 543 - protein, 398 aa, Rhizobium tropici
MLHDQRLVLRDGMLIGALDRMCSTLEISQSQSTLAQERYEGVGGWLAESENPLLKAIGIFLQGSTAIGTTVKPIGCNEHDVDLVAHAPGLGIWVEPATLKKAIGDRLRENGHYKSLLVEMGRCWRLVYANEFHLDITPSIPNRDCNMGGEFVPDRALKMWKPSNPKGYKALFLERVKLVPRFRVMKGLQAEDRAHASVEPYPEQGRFKGILQRIVQILKRHRDVFILASDLDTSLSPISVLVTTLASQSYEYCVRTNTYDSELDLLVDVIRRMPDFIETRIVNGRTHWFVWNETTKGENFAEKWNGDPKRAEVFYTWHARVLDDIGRLRDAEGLDGLKQRLSDSFGPAPAKAVMDSITDEISLSRRNGVLTVAPHVGLVTGLASATAMPVRANTFFGR

SEQ ID NO: 544 - protein, 398 aa, Rhizobium sp.
MLHDQRLVLREGMLIGALERMCATLEISQSQSTLAQERYEGVGGWLAESDNPLLKAIGIFLQGSTAIGTTVKPIGSNEHDVDLVAHVPGLGIWVEPAALKKAIGDRLRDNGHYKPLLVEMGRCWRLVYANEFHLDITPSIPNRDCYMGGEFVPDRALKVWKPSNPKGYKALFLERVKLVPRFRVMKGLQAEDRAHASVEPYPEQGFFKGILQRIVQILKRHRDVFILAGDLDTSLSPISVLVTTLASQSYEYCVRTNTYDSELDLLVDVIRCMPDFIETRIVSGRMHWFVWNETTKGENFAEKWNDEPKRAEVFYAWHARVLNDIGRLRDVEGLDGLKQRLSDSFGPAPAKAVIDSITDEISLSRRNGLLTAAPRIGLMTGLASAIATPVRANTFFGR

SEQ ID NO: 545 - protein, 398 aa, Rhizobium sp.
MLHNQRLVLRDGMLISALERMCATLEISQSQSTLAQERYEGVGGWLAESEDPLLKAIGIFLQGSTAIGTTVKPIGSNEHDVDLVAHVPGLGIWVEPATLKKAIGDRLRENGHYKPLLVEMGRCWRLVYANEFHLDITPSIPNRDCNMGGEFVPDRALKVWKPSNPKGYKALFLERVKLVPRFRVMEGLQVEDRARASVEPYPEQGHFKGILQRIVQILKRHRDVFILANDLDTSQSPISVLVTTLASQSYEYCARTNVYDSQLDLLVDVIRRMPDFIETRIVNGRTNWFVWNETTKGENFAEKWNGDPKRAEVFYSWHARVLDDVSRLRNVEGLDGLKQRLSDSFGPAPAKAVMDSITDEISLSRRNGLLTAAPRVGLLTGVASATATPVRANTFFGR

SEQ ID NO: 546 - protein, 396 aa, Sphingobium xenophagum
MLLDHAGFDRKARIVTILDEMMGGLEISPSQRELAQQRYEAVGRWLASSGVLMLRDLYIYLQGSTALGTTVKPIGHNEHDVDLVAHRPSYEAVEPAVLKRAIGDRLRENGNYAPLLEEMPRCWRLVYANEFHMDITPAIPNAQCSNGGELVPDRALRRWKTSNPKGYKREFERRAALKPQFRLNKSLQFDAKRADKNVEPYPVATGFKGVLRRMVQIGKRHRDIHFVDLDPCLAPISVIITTLAAWSYEYCVAAKVYESELDLACEVVRYMPAFIEERSVDGRRQWFIWNDTTAGENFAEKWNKHPERAEAFFSWHQRLMADLDALNEVEGMDRLNKGLRDAFGAAPVDRVFGRINEEVATARRSGLLGLAPAAGLSVAATSVPVRANTFFGAPPR

SEQ ID NO: 547 - protein, 398 aa, Afipia sp.
MYADQRTIMRNAQLVGVLERLCQGLELTDSQFELAKARYDAVGRWLAGAEDRLIHTVLIYPQGSTAIGTTVKPIGRIEHDVDLVSHVAEPDQLISPATLKFAIGNRLRSNGLYAPILEEMGRCWRINYAGEFHLDITPSIPNPGCPKGGVLVPDKALRSWTPSNPKGYKTLFLERAKIMPQMRLIKSMAAMDSARSVVEPYPEQVSFKGILPRTVQLSKRHRDIHFQELDPSLAPISVIITTLASRAYEFCALNTVYDSELDLLCDVVRHMPHFIQVDTSSGRRQWFIWNETTDHENFAEKWNADPRRANAFYTWHAKLLADLESLTHIEGLDLLTKRLGSAFGSTPAARALDGLTEPVSAARRTGRLVAAPAVGLSVAAVASSTSVRANTFHGSDSS

SEQ ID NO: 548 - protein, 399 aa, Komagataeibacter rhaeticus
MYMERRPALRKVEIFGLLERLCERLEPSETQTNRAQSSYEAVGRWLADAEDNRLATSGIYLQGSIALGTTVKPIGQNEYDVDLVCHLPAFGQWLSPALCKQIVGDRLKANQRYNNILQEKPRCWRLNYADEFHLDITPSIPNANCANGGELVPDKALSTWKPSNPKGYRDAFKRRAELVPQMRLLMSYAEDRARADADIEPFPERPRFKGLLCRIVQIAKRHRDSYFLERNMSLAPISVIITTLAAWSYEHCVRTMVFDSELDVLHAVIRHMRTFILSNTIEGRVYWAIWNETTEGENFAERWNAEPAKAAAFFEWHAAIMLDLERLSAAEGLDGLGRTLASSFGQAPAREIIQEMLDSMSAARSARMLAVAPAIGLTTAKVPVARATSVRSNTFYGAS

SEQ ID NO: 549 - protein, 399 aa, Komagataeibacter europaeus
MYMERRPALRKVEIFGLLERLCERLEPSETQTNRAQSSYEAVGRWLADAEDNRLATSGIYLQGSIALGTTVKPIGQNEYDVDLVCHLPAFGQWLPPALCKQIVGDRLKANQRYNNILQEKPRCWRLNYADEFHLDITPSIPNANCANGGELVPDKALSTWKPSNPKGYRDAFKRRAELVPQMRLLMSYAEDRARADADIEPFPERPRFKGLLCRIVQIAKRHRDSYFLERNMSLAPISVIITTLAAWSYEHCVRTMVFDSELDVLHAVIRHMRTFILSNTIEGRVYWAIWNETTEGENFAERWNAEPAKAAAFFEWHAAIMLDLERLSAAEGLDGLGRTLASSFGQAPAREIIQEMLDSMSTARSARMLAVAPAIGLTTAKVPVARATSVRSNTFYGAS

SEQ ID NO: 550 - protein, 399 aa, Komagataeibacter intermedius
MYMERRPALRKVEIFGLLERLCERLEPSETQTNRAQSSYEAVGRWLADAEDNRLATSGIYLQGSIALGTTVKPIGQNEYDVDLVCHLPAFGHWLPPALCKQIVGDRLKANQRYNNILQEKPRCWRLNYADEFHLDITPSIPNANCANGGELVPDKALSTWKPSNPKGYRDAFKRRAELVPQMRLLMSYAEDRARADADIEPFPERPRFKGLLCRIVQIAKRHRDSYFLERNMSLAPISVIITTLAAWSYEHCVRTMVFDSELDVLHAVIRHMRTFIRSNTIEGRVYWAIWNETTEGENFAERWNTEPAKAAAFFEWHAAIMLDLERLSAAEGLDGLGKTLASSFGQAPAREIIQEMLDSMSAARSARLLAVAPAIGLTTAKVPVARVTSVRSNTFYGAS

SEQ ID NO: 551 - protein, 395 aa, Sphingomonas sp.
MLMDFNEQFRRARLTGALEVVCEQLELTATQYEEAKTRYDGVSRWLAGSSHPALAGVSIYVQGSTAIGTTVKPIGRNEHDVDLIARLQAAARGYPPALVKKMIGDRLKEHGVYDRLLEEMCRCWRLDYANEFHLDITPSIPNPACANDGELVPDRELRDWKPSNPRGYKAAFERRAELRPRMRLRKSLQFDERAAASIEPYPEAGGFKGVLRRSVQIAKRHRDVHFERRPGECAPISVIVTTLLAWSYEHCVARMEFEDELDVLTAAIAGMTNFVEHRDGQWFIWNDTTPGENFAEKWNSHPDRAASFFAWHRKLVNDIAVLRSVEGLDGIARQLNEALGERPAEIAVAHLEKSVSAPRAAGALRYGATGLAASAPALVAPRASAAVPRNTFFGT

SEQ ID NO: 552 - protein, 401 aa, Asticcacaulis sp.
MDDRHFARQIQDARIRKAAAFSLVETYCQQLEPSATQEKRAKESYEAVGDWLATSDHPVLTCTLIYPQGSASTGTMVKPLQGNEHDVDLISLLKGATKFTPPADVKKAIGDRLASNGLYRDKLQEMARCWRINYANEFHLDITPSIKNPDCANGGELVPDKNLSQWKPSNPLGFRDLFNRRAALRPVSRLRKADSVAASAEIVPFPKTSPIKGVLRRTVQLLKRHRDVYFKNRDLSLAPLSIIISTLASRSYEWCVQQDRDEDDDFGLLLDTIRLMPHYIYAPVIQDRQHWFVMNETTDGENFAEKWNLEPARAQSFYAWHARALADFTRLLEFEGLDAMGTELSDFLDRQTVEKAVAAVTSQVSAARTSGRLVAGVGGLAAVTAPALVTTPVRANTFFGK

SEQ ID NO: 553 - protein, 399 aa, Bosea sp.
MIVDQRSVFRKAYLVNLLTRLCAELDIPEGRLRQAQERYEGAAEWLAAGEHFLLRELSIYLQGSTALGTSVKPIGRNEHDVDLVAFMPAGRTDLTPAFVKAVVGDRLKANAIYARLLEEKCRCWRLVYANEFHLDITPAILNSRCRDGGEFVPDRSLREWKGSNPRGYRRAFERRAALVPRLRVTRAFDDSAHARADIEPFPTTASGRNLLCNIVQVAKRHRDVHFDGRDPALTPISVILTTLLAWSYEACVAAAVYDTEFDLMIAVLRRMPDFIRTTLPDGSPGYWIPNETTLDENFAERWNDDPRRARAFYTWHTKALADMEGLALTEGTDRVRNHMEDAFGPRPVERAFATLDREVATARGSGVLRVAPLVGVTTAPAVAAAVPVRANTFFGRDCR

SEQ ID NO: 554 - protein, 399 aa, Methylobacterium oryzae
MFVDHRLAYRKAYLINLLARMCAELDITESRLQQAKERYEGVARWLAAGEHFLLHDLSIYLQGSTALGTSVRPIGKNEHDVDLVAFMPAGTTAWTPAYIKKVIGDRLKAHATYARLLEEKIRCWRLVYANEFHLDITPSILNLACRNQGELVPDKSLREWKGSNPRGYRKAFEARAALAPVIKLTKAFDGSIQSRADIEPFPVASSGRSILCNIVQVAKRHRDVHFEGQDLALWPISVILTTLIAWSYERCVKAGVYNTEFDLMIAVLRGMPDFIRRTLPDGSPGWYIPNETTIDENFAERWNDDPDKAMAFFTWHAKAVADMENLARVDGTDQVRKRMEESFGPRPVGAAFTALDNEIASARRSGLLGVAPLVGLTAAPAVAAVVPVRSNTFYGRDCG

SEQ ID NO: 555 - protein, 399 aa, Streptomyces purpurogeneiscleroticus
MFVDHRLAYRKAYLINLLARMCAELDITESRLQQAKERYEGVARWLATGEHFLLHDLSIYLQGSTALGTSVRPIGKNEYDVDLVAFMPAGTTVWTPAYIKKVIGDRLKAHATYARLLEEKIRCWRLVYANEFHLDITPSILNLACRNQGELVPDKSLREWKGSNPRGYRKAFEARAALAPVIKLTKAFDGSIQSRADIEPFPVASSGRSILCNIVQVAKRHRDVHFEGQDLALWPISVILTTLIAWSYERCVKAGVYDTEFDLMIAVLRGMPDFIGRTLPDGSPGWYIPNETTIDENFAERWNDDPDKAMAFFTWHAEAVADMENLARVDGTDQVRKRMEESFGPRPVGAAFTALDNEIASARRSGLLGVAPLVGLIAAPAVAAVVPVRSNTFYGRDCG

SEQ ID NO: 556 - protein, 399 aa, Methylobacterium sp.
MFLDHRLAHRKAYLINLLARMCAELDITESRLQQAKERYEGVARWLADGEHFLLHDLSIYLQGSTALGTSVRPIGKNEHDVDLVAFMPAGTTVWTPAYIKKVIGDRLKAHATYARLLEEKIRCWRLVYANEFHLDITPAILNIACRNQGELVPDKSLREWKGSNPRGYRKAFETRAALVPVIMLTKAFDESIKSRADIEPFPVTSSGRSILCRIVQVAKRHRDVHFEARDLALWPISVILTTLIAWSYERCVRAGVYDTEFDLIIAVLRGMPDFIGRTLPDGSPGWHIPNETTVDENFAERWNDDPDKAHAFFTWHAKAVADMENLAHVDGADQVRKRMDESFGPRPVDAAFTALDNEIASARRSGLLGVAPLVGLTAAPAIAAAVPVRNNTFFGRDCG

SEQ ID NO: 557 - protein, 191 aa, Desulfovibrio africanus
MVISEQEVMRKTQLTGLLELICQALELTKTQFETAEDRYGAVGRWLAEAESPLIETATVYPQGSMSLGTTVKPLGRNEFDIDLVCHTPRGKQYMEPSALKKLIGDRLRTNERYRPILEEKPRCWRLNYAGDFHLDITPTIPNPACRRGGELAPDKKLKEWKETNPQGYKDWFEQLAAIPVRFVVADAFAAN

SEQ ID NO: 558 - protein, 389 aa, Unknown
  Description of Unknown: Solemya pervernicosa gill symbiont sequence
MTFQTLNDTQKHHLAGLLEMACQELELTKTQFEDAQSKYDAVGRWLDDADHPILADSRIFSQGSVRLGTTVKPLGRDEYDVDLVCHLLSGHASMGAAYLKKIIGDRLKANGHYQPILEEKQRCWRLNYAGQFHMDITPSVTNSRCVDGGLLVPDKDLSQSMKPSNPEGYTQWFEKRAEMTPYMMAPGSMEIRADIEPLPEQVPIKGLLKRIVQICKRHRDLKFKDDDSGKAPISVIITTLAAHSYEAVVTSGRRLADIDMVYEVIAGMKRYIQCQKTATGIFYYIPNPTTKGENFAEKWNTNRERAKAFFEWHGAILHDVEELGRIAGLDSLIEHLREKIIGPEAGRVLTKVTDRMSVARTAGILLASSSIGVGTAHGDPVRPNKFYGS

SEQ ID NO: 559 - protein, 391 aa, Deltaproteobacteria bacterium
MVREQLSLLQKTQLVGFLELVCRELDLTESQFEHAKEKYESVGEWLNDGVLIKSLGPRIIPQGSVSLGTCVRPIDRNEFDVDLVCKLVLASQEQNQAYIRQIVGERLRQSKTYERILEPLKRGWRLKYAESSKFHLDIIPAVMRRGSSNGEVFVPDRELKRWTPSNPEGYVKWFEGFAALTPRIRGTMEFAARADIQPLPEPASFKSILKRSVQLLKRHRDVHFVHGKGELAPISVIITTLAAKSYGDAVKAGYEYDSDFDLFLDVISNMHRFIQVRHQDGKAFFFIPNETTDGENFAEQWNKHPERATAFYEWQKAAIKDFEELPKLEGLDNTRRAMMGKLGKPEVSKVFNEYTNSINLARSSGRLKVNPSGGLGLVAGINHQPNTYFGR

SEQ ID NO: 560 - protein, 390 aa, Desulfococcus oleovorans
MVFERYSNDKRVQLFYLLEKICQKLELTDTQYQDAKGKYKAVGEWLDGGEVLHPHAPHIFPQGSMSLGTTVRPLGRDEFDIDLVCLLNLFSSRCSPEAVRKAVGERLEANEVYKKMLEPLNRGWRLNYAQSSKLHLDITPATKDDGSQNGGLMVPDRKLREWKNSHPQGYVKWFEDIAALMPTIEFSERVVMAKVDPFPEQVPFKSILKRCVQILKRHRDLCFINNDAKNAPISIILTTLAAKSYQHLVLSRRFTSELDLLFSVIQHLPDFIEERVIQGQKIYYIPNETTSGENFAEKWNTHRERAEAFFSWHKKAISDFEKLEQVEGLDGLQRLLGEEVFGERDTSVVFNDYVDVINERRRNRTLSVASGVGLTTGIGTPVRRNTFYGK

SEQ ID NO: 561 - protein, 402 aa, Alphaproteobacteria bacterium
MNQIHRFDERLHQCKVALFQLLEAIGRELDLNPSRREDAETRYTAVGSWLVDSDEDRLKASQVFLAGSTATGTNVRPLGGDEHDVDLMCVLPTLTRDASPSEVKALVGRRLAENARYSEILEEMARCWRIVYANEFHLDITPAIPNPDCGNGGLLVPDKQLRRWKPSHPKGFRDRFDRRALLVPRFRDEVSKDALMADRSSVEPYPAYELIKGVLRRAVQLLKRHRDVYFEDKSTLSPPISVIITELAARAYAYLVEKHVFDNEFDLLLHVVKMLPAFIDERPQSDGKWAVWNRATQGENFAEKWNRDGARADAFFHWQRVAEAGFARLADLDGRDAIAAELRSLLGSRPVNKVLDDQTAAISAARKNQSLWVAPKVGLITATASSAAAPVRANTFFGRPDV

SEQ ID NO: 562 - protein, 401 aa, Acetobacter pasteurianus
MNNIQSYFGPHLQQVDRSSRIISLLDKVCMKIEPSQNQYDLAEERYLAVGKWIAGAADDLLQNSSICVQGSFATSTAIRPPEQSEYDVDLLCYVPNYDLSLQPISLKKALGDRLQQHATYGKMLEEKARCWRLNYANEFHMDITPAIPNQACKNGGCLVPDKELRRWKESNPRGYSKLFKARAALEPRFEKYESFSVEAAYDSVEPFPKRKEMQGFLRRIVQLSKFSRDFYFSKKSLALWPISIIITTLTSRSYEFCVGKYVFQDELDLLCKVVEHMPDTIICKDGISWQILNETTTGENFAEKWNTDPNRAKAFFAWHQKFLEDLRKLRVSVGLDVIRKDLSDSFGVEAVTEVFDDITTEVSSARQKQKLAVSAELGLTTDSACRAIIPKNTFYGFVQER

SEQ ID NO: 563 - protein, 372 aa, Acetobacter pasteurianus
MKIEPSQNQYDLAEERYLAVGKWIAGAADDLLQNSSICVQGSFATSTAIRPPEQSEYDVDLLCYVPNYDLSLQPISLKKALGDRLQQHATYGKMLEEKARCWRLNYANEFHMDITPAIPNQACKNGGCLVPDKELRRWKESNPRGYSKLFKARAALEPRFEKYESFSVEAAYDSVEPFPKRKEMQGFLRRIVQLSKFSRDFYFSKKSLALWPISIIITTLTSRSYEFCVGKYVFQDELDLLCKVVEHMPDTIICKDGISWQILNETTTGENFAEKWNTDPNRAKAFFAWHQKFLEDLRKLRVSVGLDVIRKDLSDSFGVEAVTEVFDDITTEVSSARQKQKLAVSAELGLTTDSACRAIIPKNTFYGFVQER

SEQ ID NO: 564 - protein, 398 aa, Acetobacter tropicalis
MQSHFGPHLQQMDRSSRIISLLDKVCMKIEPSQHQYDLAEERYLAVGKWIAGAADDLLQNSSICVQGSFATSTAIRPPEQSEYDVDLLCYVPNDDLSLQPISLKKALGDRLRQHATYGKMLEEKARCWRLNYANEFHMDITPAIPNQACQNGGCLVPDKELRRWKESNPRGYSKLFKARAALEPRFEKYESFGIESAHDSVEPFPKRKEMQGFLRRIVQLSKFSRDFYFSKKSIALWPISIIITTLTSRSYEFCVGKYVFQDELDLLCKVVEHMPDTISCKDGISWQILNETTTGENFAEKWNTDPERAKAFFAWHQKFLEDLRKLRVSVGLDVIRKDLSDSFGVEAVTEVFDDITTEVSSARQKQKLAVSAELGLTTDSSCRAIIPKNTFYGFVQER

SEQ ID NO: 565 - protein, 372 aa, Acetobacter tropicalis
MKIEPSQHQYDLAEERYLAVGKWIAGAADDLLQNSSICVQGSFATSTAIRPPEQSEYDVDLLCYVPNDDLSLQPISLKKALGDRLRQHATYGKMLEEKARCWRLNYANEFHMDITPAIPNQACQNGGCLVPDKELRRWKESNPRGYSKLFKARAALEPRFEKYESFGIESAHDSVEPFPKRKEMQGFLRRIVQLSKFSRDFYFSKKSIALWPISIIITTLTSRSYEFCVGKYVFQDELDLLCKVVEHMPDTISCKDGISWQILNETTTGENFAEKWNTDPERAKAFFAWHQKFLEDLRKLRVSVGLDVIRKDLSDSFGVEAVTEVFDDITTEVSSARQKQKLAVSAELGLTTDSSCRAIIPKNTFYGFVQER

SEQ ID NO: 566 - protein, 393 aa, Thiocapsa roseopersicina
MDDRPSDARLDLLANLDGALRGVELSPTQYDQLETAYHAVGNWLADSDDPLLKSARIYAQGSVRLRTSVRPLGADHFDVDLVCLLPAAHPSVHSAVKVSEIIGKRLAESGRYKLMLEPKNRCWRLNYAESSRFHMDITPAMPNPACSQQGILVPDRELRQLKPSNPERYADLFDMASKIEPTFTDLVLDFAKAIALARAEIDPLPDPMQPRDMLRRIVQLLKRHRDLYFESTDGHPPISIILTTLAATSYGREALRTWPNPWAFIQTVLARLPHYVQGLPGRYQVLNPSALGENFAEKWNTEPQKATDFFKWHRLLVADVEAYQRSEGLDQRIPIMRDRLVGPETNAWHRNRLSAIQRRRTDGTLVRAPITGGLLAAGHGTSVRANTFFGAAR

SEQ ID NO: 567 - protein, 393 aa, Thiocapsa sp.
MDDRPSDARLDLLANPDGALRGVELSPTQYDQLETAYHAVGNWLADSDDPLLKSARIYAQGSVRLRTSVRPLGADHFDVDLVCLLPAAHPSVHSAVKVSEIIGKRLAESGRYKRMLEPKNRCWRLNYAESSRFHMDITPAMPNPACSQQGILVPDRELRQLKPSNPEHYAELFDMASKIEPTFTDLVLDFAKAIALARAEIDPLPDPMQPRDMLRRIVQLLKRHRDLYFESTEGHPPISIILTTLAATSYGREALRTWPNPWAFIQTVLARLPHYVEGSPGRYQVRNPSALGENFAEKWNTEPQKATDFFKWHRLLVADVEAYQRSEGLDQRIPIMRDRLVGPETNAWHRNRLSTIQRRRTDGTLARAPITGGLLAAGHGTSIRANTFFGAAR

SEQ ID NO: 568 - protein, 405 aa, Pseudoalteromonas piratica
MSIDLYKNNYAALTAKQLRLLTELLEQACQALELSKAMRQRAEDSYKAVGKWLAESEDPLFDDVEIYPQGSQRIGTTNKPPFRAEFDLDFICYLPKAEGIHPDVCRAMVIERLKEHGTYKDLVTELNRGCRINYADNFHMDITPGIPDQNHANEFGAISVPDKKLKEWKASNPKGYARDFDQIAELVPAYSDDDESLFAMAALEARSIEELPKHQGFKGILRRSVQIMKQHRDLLFHENKEYDGKAPISIILTTLASRAYRDAIKNRVYGNELEVLLAVVESMTSYIETKYVDGKIEIWVTNPKNEHENFAEKWNVDPKRIEAFHYWHRNIIGKLEELASVKSIHLIREKLNQLIGESASEAAVDKHFESLNEERSNNNLFVAKTGAISTAVTSTPVKSNTFFGK

SEQ ID NO: 569 - protein, 395 aa, Sulfurospirillum arsenophilum
MALQQKDSLYWKLLVAITDQMSLPQSKFEDAEGKYLAVARWLADSGDGHFAKTDIYPQGSMRLGTTIKPYNEEEFDIDLVAHLPNITMDNNPNVIRNLIGKRLLEHGYYKTILEPLNRGWRLNYAGDFHMDITPSIPNTNTHFGTNPYRHDAEYVPDKKLQDWKDSNPKGFAKWFDEIDKIMPVSISNENRGLAFDANIEMLPSAEAFKGFLKRSIQLFKRHRDVYFAEKNKELTNYKPISILLTTMTANLYKDLVQGGISASPIELLKIIIRNLPNRIKTLRGEYWVENPTNAQENFAEKWNTDKNYYTAFKLWQESLYNDIEDILKLEGLNVVGNRMNDFFGQKYVTLAMESLNHEVANSRANGLLAGGIISSHNGLSSNVAKNTFYGSEQHN

SEQ ID NO: 570 - protein, 377 aa, Myxococcus macrosporus
MLSPPISRTPLLSANPSLDYLLAQVAEAVQLTTTQYTKATEHYEAVARWLEADDSLLAKLSPRIYPQGSMALETTVKPRGEVEYDLDLVCQMSHSPGSAMDLYSAVYERLAAHQTYRTMLSKKKRCVRLEYQGEFHLDIIPAIQDPFRGTTSLLVPDRELRGWTPSNPKGFASWFKSKAALRLVEKTARYDAEPLPALRDYDEKPPLAISVQLMKRARDIIFDGDDNAPRSILLSTLAGHHYQGRTCTLTSTFEILYGIQEQIRSASPNTIEVSNPTNPDERFSDSLTRERYTTLKEFTRHLTSELTKLLDARGLDTYQSSLESIFGVKPVATAFEKYGQLLNSRRNTRTLTYSPTGLNIITPTTSPRVPKNTYFGN

SEQ ID NO: 571 - protein, 362 aa, Rhodopirellula baltica
MLELLCETLQPTQTLWGDAQQKYNAVGNWLAAPESKLNLLKPDIKYQGSALIETVVRPWGREEFDVDLLCILNTDRVRHPNPMAVYDLVAARLAEHATYRRLMTRKERCIELNYAGQFHLDIVPAIPRFGLGQKLMIPDRKQKVWIPTDPFGYADWFFGRTPVTKMAAEQYEARADVQPLQPAKRAKDIAPLQRTVQLMKRRRDLFFDGNGDAPKSIALTTLASKHYGGEAMCTDALLTVLTRIHEEINNTSGILVIPNPVDRSENLGRHWNDRSYARFKRFISLFLDEMQELLQLRGWDKITEALEELFGDRARRAVEIYAKSLDAKRRSSKLGFSAGPVILTPAASTTTRMVPRNEFFGS

SEQ ID NO: 572 - protein, 375 aa, Elusimicrobia bacterium
MFRTADSTAQIDDLLTRICEELQIPPGKYTEVENRYAGVSDWLGAEDSPLAKHKPRIMSQGSLRIGTTVKPINHNEFDLDLVCQLHVDWKQIGNPVSLLDTVEKRLKAPGSNYTDLVERKNRCVRLNYANEFHMDILPACPDSTGPEGALMVPDREAQDWKASNPDGYANWFEGRAATLQVVMARATEPLPEQESVAEKKPLKLAVQLIKRWRDIYYDGKPELAPLSIVLTTLAAHNYRGQTSVKDAISGILDGIILGIPTIGRLTVLNPTNGKEDFSERWNENRDGYLAFIEGLKFFHRRWNDLDGKPGIHNAKQILEALFGEKLYQRALANQAEAIRKAHEAGRIGVKRGTGGVGLLGATYTQAIPRNTFYGS

SEQ ID NO: 573 - protein, 373 aa, Actinobacteria bacterium
MYATDPFINELDDLLAGICLKLQITPTQHKLAEDRYISVSKWLSDKSSHFYIANSDIYPQGSLRLGTTVKPLVNQEYDLDLVCEMGLDWNNFDPIQVLDAVESRLKENDSYSKILERKNRCLRLNYANEFHMDVLPAAPDTVRNHGCIKVPDRKAEEWKESNPKGYAEWFERQANQFGEVLAKAKVEPLPDPEDPRGKSTLKYIVQLLKRSRDVAFENDEEVAPISIVLTTLAGMYYRGILSINEAFAYTLHSLTNEISANDTRIVVRNPANQDEDLSERWDNNHKAYNEFVKWVNELSDTWKKLNIVRGPELVKMLQELFGEKVTNDVIKERAEIISRARKEDSLGITKSGLLTTSLASGITQVRPNNFYGD

SEQ ID NO: 574 - protein, 380 aa, Calothrix sp.
MQSVRRTDALFVTRLDKILENICRKLQLTVTQYNLAESHYQAVGKWLEDKSSILAPYRPILYPQGSLPMGTTNKPIGKEEYDLDFVCELLIDWWTICPIDLLSKVEYRIRQHEDYAKRMERGNRCIKLIYAHDFHLDIVPACSNSVLGEGQIRIPDRETKGWKDSNSRAYIQWFNSEAKVSSRNLDHAEPLPLQETLEQKPPLKCAVQLLKRHRDVAFKNKPDLAPASIVLSTLAAMHYQGQESVGEAVAAILQGIAITIARQQGKRLQVWNPVNNVPEDLGERWENPKAYHEFVVWIREFNRLWLELSAAKGYADISKLLVTLFDEQPTRDVIHDAIRLDEQHIAQNRVNGQLGIKPQIGTLTSQPSSIVVPKNTFYGQ

SEQ ID NO: 575 - protein, 375 aa, Paenibacillus sp.
MQEMFIQGTFIDDLLQRIGYKLQISPTQRNLAEMHYNAVAKWLTLNDVVFKEADVDIYPQGSLRIGTTVKPLKQQEYDLDLVIEIKEDWTDKDPIDLLNKIEKRLKENATYKPMVERKNRCIRLNYEHEFHMDILPAHPADTTYSTCVKVPDRKAEDWKDSNPKGYAQWFDKRSIYYQTLLEKKAKIDPLPEDDSFERKPPLKRAVQLIKRFRDVYFEDNPDQAPISIVLTTLSGHLYKGESSVAEALTNILNGIVRLIPTKEILVVRNPSNELEILSERWNQDPELYKSFVTFVHDFKERWDNLSLMSGLDDVTDELKAMFGEDVVMKSFREQTQFVEKNRSENKLGVLSGIGLITTSSSINIMPVRNNTFYGD

SEQ ID NO: 576 - protein, 380 aa, Psychrobacillus sp.
MIKNFEKNILVDDLLQRIGEKLQISKTQRKLAEERYEAVGTWLSKDGDLFDGSEINIYPQGSLSIGTTVKPLSKQEYDLDLVCEVDEPHEGKDPIDLLNTIEQRLRDNEIYKDKVERKNRCIRLNYANEFHMDILPAHPANPRPDTCVKVPDRKAEDWKDSNPKGYTAWLNDRSIIVKQSFEVRADIEPLPNDETVERKAPLKRAVQLIKRYRDIYFEKESDSAPISIVLTTLAGQVYEGQVSVNETITHVLNQIQVLVSKSDTRLVVLNPSNDKEDLSERWDGKPELYQKFVKFIRDFKENWGELEELQGLSEIAEKLKQMFGENVTNQAFKEQAAHIGKSRNNKGLAVIGSGLLVAATTEKAVAMERNTFYGEKKDSI

SEQ ID NO: 577 - protein, 376 aa, Bacillus wudalianchiensis
MFDSFSNQLDDLLQRVGHKLQISKTQRKLAEQRYNSVGIWLSDDQKFFKGKDVDIYPQGSLSISTTVKPLQQQEYDLDLVCEIKENWQGKDPLELLDSIERRLNEHDTYKKMVERKNRCVRLNYANEFHMDILPAHPTDNGNNTNVKVPDRKAEDWKDSNPKGYAAWLNERSEQYWNVLLEKKAVASIQPLPIDDDPNRKPPLKRAVQLIKRYRDIYFEDDPDSAPISIVLTTLAGKYYDGQVSVNDAIDVILEKILANIPREGRLIVVNPTNKQEDLSERWDGKPKLYHSFVSFVRDFKQHWSELNKIQGIDEIAKELKVMFGESIINESLKEQAEFMEKARKKQVLGVVGSSGLLVAAAKEPVIPLRKNTFYGE

SEQ ID NO: 578 - protein, 377 aa, Bacillus sp.
MDKVLSSNSSQLEDLLQRVGMKLQISKTQRELAESRYKSVGEWLSKDDTLFNGVDIDIYSQGSLRIGTTVKPLTKQEYDLDLVCEINQNWQGKDPLKLLDSIERRLKENKIYEGMVERKNRCIRLNYANEFHLDILPAHPLNQSTDTNLKVPDRKAEDWKDSNPKGYADWFINRSNQYKILFEKSASIEPLPSDERVEKKAPLKRAVQLIKRYRDVYFKDNCENAPISIVLTTLAGDVYSGQLTVNESITHILDNIIAHIPKDGERLVVLNPANRREDLSEKWDQDQKLYLSFINFMLDFKEHWAKLNKLQGIHEIAVELKNMFGENIINDALKEQAEFMEKVRKSNNLSILGSGLLVAASKEENRVSVKPNTFYGE

SEQ ID NO: 579 - protein, 376 aa, Bacillus cereus
MNEIFSASNQLDDLLQRVGEKLQISKTQRKLAEERYLAVGKWLSNDEELSNGADIEIYPQGSLSISTTVKPLSKQEYDLDLVCEINQSWQGKNPLILLDTIEKRLKENKLYEAMVERKNRCIRLNYANEFHMDILPAHPADMTSNTSVKVPDRKAKDWKDSNPKGYASWFNDRSYQYEMLLEKRADIKPLPSDDNIERKPPLKRAVQLIKRYRDVYFEENADSAPISIVLTTLAGQIYKGQSSVYKAISDILEGILMNLPSDGKRLIVLNPTNKKEDLSERWDGHPELYKSFVTFIRDFKQNWDRLNELRGIHEIAEELKEMFGENVINETVKEQAEYMEKARKTNQLGVFGTGILVAATKEENVTPIRKNTFYGE

SEQ ID NO: 580 - protein, 374 aa, Desulfosporosinus sp.
MEFLQSFDNHLEDMLHRLCVRLQITATQRELAESRYKSVTEWLAADESTFWGKDLDIYPQGSLRIGTTVKPLAHQEFDLDLVCEINRSWQGKNPLELLNAMEQRLRLHKTYAPMVQRKNRCIRLNYANEFHMDLLPACPSDSNDSGCLKVPDREAKDWKDSNPSGYAKWLDDRAKQYETFLEKRASIHPLPDEEPVEFKPPLKRAVQLIKRHRDICFLDYPNNAPISIVLTTLAGTIYNKQDSVYQTIESVLSGIISLIPGRGRLIVLNPTNKKEDLSERWDSEPLLYGMFKRYIEDFLKQWQQLKYARGTELNALIKSLFGEKVTNAVLMEQAMAIEEARKSSRLRSSWSLGSLTVLKTSSTPVRRNTFYGED

SEQ ID NO: 581 - protein, 385 aa, Planococcus faecalis
MLQTYSKDHQLDELFQSICEELQISKSQYDQAETSYNAVANWLSEDEERFPNIDIDIYPQGSLKIGTTVHPILNQEFDLDFVCELNLDWKKYDNPVEVLDLIEERLLEHDVYAPMVKRKNRCIRLNYKRNFHMDILPACRVKEDSNGCVKVPDRKLADWKDSNPKGYANWFEETAKDYDVSFNNQILMEKSAEIEKMPGVEPIQIKPPLKRAVQLMKRHRDVYFEEHPEKAPISIVLTTLAGEFYANQSSVNDAIEGILDGILNATQSGKITVYNPQNKLEVLSERWNEKPELYDSFLIFIRDFREKWTEISDAKEKGFIEVASLLKEMFGEEPISKGMSKQAKVNEAYRQAGKLGITAAGVMSFTPGVAAEEITTVKRNTFYGE

SEQ ID NO: 582 - protein, 379 aa, Paenibacillus stellifer
MANITYSTQMEDLLHRIGMEIQLTQTQYSDAETSYNAVANVLSEHDKFKDARLVIYPQGSLRIGTTVKPLKEQEFDLDCVLEIDGNEETFNDPMELLNLLEKILLSHGVYSSMVSKKNRCIRLTYASNYHMDILPARPTIGHAPYCVKVPDSITGGWKDSNPKGYATWFDKIANDFIKNEYFEKSAEIQPLPESEPVEIKPPLKRAVQLLKRGRDLYFKEDSEHAPISVILTTLAAQHYQKQGSVYEALLGILQGINQLTKNDESIVVLNPTNHKEIFSERWDQNPELYVAFKKFIGDFHNYWVELPKLKGAGLLETGNYLSNYFGKDLIEKSFTKEAQYKQALREKGKLGVLANGSILAATTVPHTIPISKNTFYGTP

SEQ ID NO: 583 - protein, 382 aa, Acidobacteria bacterium
MVSTLSPTASPVTQLDEILALIGTTLEITATQRSAAEQHYLAIARWLGGVEGAPFRLYEPQIYPQGSLRLGTTVKPLSNGEYDLDLVYELQVDYTHIPKPVALIDMLYDRLRDHGTYRDMVERKNRCVRVNYEGQFHLDILPAALDRACGGTCVRVPDCSTQGWKPSNPKGYAAYFDARAATVEFAERSFKASVEPLPDHVPHEAKTSLQREVQLIKRLRDITFADNCDLAPISIVLTTLAANNFSGERSVALVIGQTFDSIVAQIPTRGRLYVFNPSNPEEDLSERWDKCPEAYLAFCEAMRRWQRAWNALLELRGVDRVVAELERMFGPAPVRKAIDEQIRVLEKSRRQGRLGVDGAGVVVTTAVTAVHTPVPKNTFYGG

SEQ ID NO: 584 - protein, 394 aa, Unknown
  Description of Unknown: bacterium sequence
MPHVSNPTLTQNPRGRHRLDEHLDDVAEVLRLDSTRRRTAETAAGELYEWVQSDPGLQNLSPHLYPQGSFLIQTTVRPRDEGQDCDEFDLDMVIELREGWTGTPDLLFELVWSRLRMHPIYGKYAIKKRRCVCIDFPGEFHMDVLPARPDLNRRSKGFATAIEVPDRKLSDWKESDPRAFAEWFEQRCKDRLSERFLKASMTPISEDYGFGLDALRKSVQLTKRHRDVVFNGDDDAPRSIVLTTLLADNYYGISSTYLALCDSIDRVIAWAESAHGVPLVLNPVNEEENFAEAWDDKSFAIFKEYMADFSAKLKLLDKMHGPVDIGKCLAGLFDEGIAVAAMKRFGERQEQIFVDRKARYDPKSNCEIVVPSGVASAILGISTRAVPKGTNFGE

SEQ ID NO: 585 - protein, 371 aa, Mesotoga sp.
MDELLQRIGNELQLPQTKREKASQTYDAIFNFLDSDEDLFQGNDIDVFPQGSYKIGTTVKPLSGEEYDLDIVLKIKQIWHSDLSPNVLLDKLYRKFRDSDRYANMVEKKRRCVRIKYVDDFHMDILPAYPLANIESERLRVPDKQLNHWVPSAPRLYAKWFEDRCIKLQRKIIEVAQQEPLPHDLPFEVKPTLKRSVQLIKRRRDFYFSTKNDEAPRSIILTTLAGMYYQDKGSLFDDMGHILDSILSNVCSLQSPPAVFNPIENGENFAESWKANSAEFRAFKEFVSDFANRWKTLSSIRGINDISRHLEEMFGETETKEALTKYSEDIQALREAERLTMGNATGNLSSVGDSELNSTTVRKNTFFGESR

SEQ ID NO: 586 - protein, 384 aa, Mesotoga sp.
MLYEAYFVTSKPVMDELLQRIGNELQLPQTKREKASQTYDAIFNFLDSDEDLFQGNDIDVFPQGSYKIGTTVKPLSGEEYDLDIVLKIKQIWHSDLSPNVLLDKLYRKFRDSDRYANMVEKKRRCVRIKYVDDFHMDILPAYPLANIESERLRVPDKQLNHWVPSAPRLYAKWFEDRCIKLQRKIIEVAQQEPLPHDLPFEVKPTLKRSVQLIKRRRDFYFSTKNDEAPRSIILTTLAGMYYQDKGSLFDDMGHILDSILSNVCSLQSPPAVFNPIENGENFAESWKANSAEFRAFKEFVSDFANRWKTLSSIRGINDISRHLEEMFGETETKEALTKYSEDIQALREAERLTMGNATGNLSSVGDSELNSTTVRKNTFFGESR

SEQ ID NO: 587 - protein, 379 aa, Sphingobacterium sp.
MKNIYIPNTFNQQLDDLLNRIAEKLQLDDTRRSSAERSYNAVSEWIEADIGFFKNVLFNIYPQGSYRIGTNVKPLNGEEFDLDIVIHMMLPYESFDPIEVLNELERRLKEHGQYKTMIQRKNRCIRIIYANLFHIDILPAFQESDLDPNKIVVPDRLLRDWTPSNPKGYATWFESRYVTRNQLLLEKALRAEDLPEQIPYQLLQPIQRAVQLIKRFRDIYFKENPDDSTSSIILTTVAGMFYNGEASEYEAIKGIINRTYNALALCDGIMDIVNPANTEEKFSDKWINEPNLYKCFKKFISDFKNLWDKIDNSKGISGILDILKEMFGENTSTNSLIEQSEYITKARNAQQLGVNRTNGLITKVSPAATLVEKNNFYGE

SEQ ID NO: 588 - protein, 549 aa, Spirosoma linguale
MLPTQLPTNHFQISPLDDTLNRVAESLQLDPTRRQRIETSYKAVSEWIEKDLTFFRSTLVDIYPQGSIRIDTTVKPYRQSEFDVDFVCHLDFLTGKLHDALEVLDELERRLREHDTYKGRIKRKNRCIRIVYADDFHLDILVGCQELTDNPERLLVPDRQLKDWTFSNPIGYGNWFEQQAWVPQQAWQLLKESYQQRMMVEAAQKLTDPVPYALKPPLKRAVQILKRLRDVYFYNNPDLAASSIVLTTLTGYAYQKQLSIADIIAGWADYTLSRVRYDERRQPIPFEVPNPANPRENFGDKWKSEPTIFKAFVNFVLYLRDTWARITSATNPATRDELLQGLFGYERIQRILTEQRDWTAKVQKLSTLSGLIAAPTLHTKPDVKLTPDPTPIKNQPHRFHGGPRFAAGKIRQRNTVGFYQMHFLEKAYGTTFRCRLENGKLVAEGWIQPHELCGPYKVKIEYLPGMAPWVYIINPVIEPHPAIHMYSDRSLCLHFADDHRWTDRTRIAETTVPWIAEWLVCYEVWLLTDTWIGAEAPHEQTKITTTPIL

SEQ ID NO: 589 - protein, 549 aa, Spirosoma linguale; identical to SEQ ID NO: 588

SEQ ID NO: 590 - protein, 545 aa, Rudanella lutea
MTPTIPVVTPSGSDFQISDLDDLLNRLGESLQLDATRRRLAEERYKTVADWIERDEAFFKTALLNVYAQGSFRIRTTSKPYKRNEFDLDFVVHLDFLTGKNYDPMEVLNQLERRLRENDTYKGMIERKNRCIRITYANDFHMDIMVGCQETYYEPNRIIVPDRKTKNWTASNPIGYGDWFTGRAQLAPKRQEILQKAYNARNLEIRASENLPATLPYELKPPLERAVQIFKRGRDVYFYGQEDLATSSIILTTLAAEAYNGELSVFETIDRIITHIEQKSRNLWGGIEPFVIPNPANPKENFSEKWFEDRKLFVAFLKFIADLRRTWEALKVGANPTLRESLLESAFGENRIKRLVAEQRNYRDSFEKAKRLTPIAQAAGLGTLNTTATVKPTFEPAPVQNQPARRFGGKAFPLHSTQFSAGTNYLQQRWIDETYPGVFTCTVRNGVLTCTGKIKPTDDCDEYRICIEYVPGAPPQVFINSHRINPGKRIHMYSNGALCLHYPPDINWKHHTSVAAYTIPWIAEWIVCYELWKLTGKWEGAEFTH

SEQ ID NO: 591 - protein, 377 aa, Bacteroidetes bacterium
MYFLNSKTAQIDDLLARAAEKLQLDKARREKIESSYKAIQEVLENDQIYFDSKNFEIYPQGSVRIGTTVKPLARNEFDLDIVLHIKDNVYEQTDPMKVFTELKRVLQENLNYKEKVIPKTRCVRLNYAGDYHMDVLPGCQHNINNEDKIVIPDRELKDWLVSNPRGYAKWFMGKAESVTQTLLEKAYAAEDIPSDDFAAKKPLQRAVQIIKRYRDLFFEKSPDYATSSIVLTTLAGQLYQGQDSIFDTIDSIISQVYQKVNLSKAKRIKVLNPVDNEEDFTDKWEREPQYYTEFIRFSEALYQSWQKLKQDNGIVEESNILKGLIGENLYSESVKQQALVTEDFRKKGKVFSSSATGLLGSQKISNKPIQKNTFFGE

SEQ ID NO: 592 - protein, 382 aa, Flaviramulus ichthyoenteri
MILFKNKNTQLDDLLARIAEQIQLDDTRKERMETAYRAIESLLNEDIGFFKDAVFEIYPQGSVRIGTTVKPTGKNEFDLDIVVHIVMDWEKYSPQYIYNQLKRVLQNSDRYKDKVELKNRCIRLNYAGDFHMDILPGCQETSYDEDKLVIPDRELGDWTSSSPRGYGNWFINKSNLAKMTLLEKAYAMENLPADEFSKKKPLQRAVQLIKMYRDEYFKTNPKMATSSIILTTIAGEFYEGEESIFDTIENIINKIKQNFNIVGLVGNRLKILNPVNPQEDFSDKWDDDKEPELYEHFKKFILHLDKQWKILKEENGVIEEANTIKGLFGEKAFLRAQDSQVNQLEKARKMKSIGINTSTGVLVESLIDTTKPIKNNTFFGSE

SEQ ID NO: 593 - protein, 375 aa, Echinicola vietnamensis
MILLGKKATQIDDLLDRMAEEVQLDKTRRDRMKSSYEAVKEWIEADEKFFKPYKYDVYPHGSVRIMTTVKPFGREEFDLDIAIHLKYGTPHSPERIYNELRRRLNEHGLYRDMLEAKNRCIRLKYAGDYHMDILPGVQEVEYDRNRIMVPDRELGSWVSSNPRGYADWFIAQSNLVKESLLEKALRAENLPVDDFSKKKPLQRGVQLIKRYRDIYFQKDDSYKTSSVILTTIAGQFYQGEDSIFNTVDNIVSTIQNSIGQSYGRLKILNPVNADEDFTDKWDKEPEYYEAFKRFSFHLHSEWQKLKKDNGIIEESRIMKGLFGDDLFVKAQGSQAMEIERSRKSNALGVATGTGVLASTSSLGSIPIKNNTFFGE

SEQ ID NO: 594 - protein, 376 aa, Mucilaginibacter sp.
MIYLNNRQAQIDDILDRMAESLQLGDSRYDRMKGHYEAIKSWIEKDEKFFKPFAYELYPHGSVRILTTVKPIGKDEFDLDIALHIKTNHTSHTPQRIYQELKRRLGEHETYKAMMELKKRCIRLNYSGDFHMDILPGIQEFDWDENRLCVPDHELGRWVSSNPRGYAKWFIDRANTVKVSLLEKALRAENIPADNFKYKKPLQRGVQLIKRYRDIYFQEDDTYKTSSIILTTIAGLYYNGEESIFDTVENIVNQIRHNVNYLPSRLKILNPVNAQEDFTDKWDVEPQYYTAFKAFVLHLYNEWQELKKQHGVITESRILKGLFGDDLFTKAQRDQTTLLESYRKSQNLGISRETGNVVKAGTIASAAVKTNTFFGD

SEQ ID NO: 595 - protein, 376 aa, Flavisolibacter tropicus
MLLIEEKRTQIDDLLDKMAENLQLDATRQQRMKQHYEAVKDWIEADPVFFGPYKYDVYPHGSVRILTTVKPVEREEFDLDIAIHLKPGMGSHSPARIYAEVKRRLEAHETYKGMLEPKNRCLRLNYSGDFHMDILPGVQESEWDENKLKVPDHDLGRWVSSNPRGYADWFLAKANLVKMSLLEKALRAENLPADNFDQKKPLQRAVQLIKRYRDLYFQERFSDHKTSSIVLTTLAGMYYTGEESIFDTVDNIVSTIGRETAVAEKRIKVFNPVNPQEDFTDKWEDDPRYYIGFKAFCKHLQSEWQELKKHHGIPDESRILKGLFGESVVTKAYQSQASHLEELRGGGKLGINRTTGILSAAGSMASTVKPNTFFGA

SEQ ID NO: 596 - protein, 390 aa, Arsenicibacter rosenii
MESMLNYDDPIVQLDDQLDKMAEALQLDDTRRERMETAYKAVHQFVLDDTVFFKALVSEAYAQGSVRMGTTNKPYEGNEFDLDTVIQLKTIASKYPPDEIRRQLERRLREPGSRWKDTLEVKSRCLRIQYKNDFHMDLLVASQQSDFCKNTILVLDKETKQVCISNPRGHADWFIEKANLIVESLLEQADKRVKASASLERLPADVFKRKKPLQRSVQLLKRYRDIFFAGNSDYATSSIILTTIAGQYYNGEASIFSTMDGIINRIINDADDFIFMGSGRIKVLNPVNKNEDFTSKWDTEPQYYSEFLRFARHLRGEWNKFKYQQGVLVESRILKGLFGEDAYNLGSIKRSEEINKLRSNGLLRQDRQSGIITSSVIGSSLVKPNTFFGE

SEQ ID NO: 597 - protein, 385 aa, Spirosoma sp.
MINYDDPTIQLDDQLDKMAESLQLDDTRRERMETAYKAVHQFVMDDPIFFKGLVSEAYAQGSVRIGTTNKPYTGSEFDLDTVIQLRCISAQYSPSYILNQLERRLSEPGSRYRDKLDPKSRCIRIRYENDFHMDVLAACQESESCKNTILVANKDSGTIDKSNPRGHADWFIDQANKVIESLLEKADQRMAASLEKLPADNFRRKKPLQRSVQLLKRYRDIFFADDDSYATSSVILTTIAGQYYGGEPSIYTTMDGIISRIVTDANRFQMVVGGRIKVLNPVNLNEDFTSKWETEPKYYYEFLRFARHLKEEWQKFKLQQGVVTESRILKDLFGNDTYNAGSSLRMQEMDVRRSNGQLRQDRTTGILTASVASSTIIKPNTFYGD

SEQ ID NO: 598 - protein, 380 aa, Chitinophaga arvensicola
MLIFKEKNTQLDDLLDKMAESIQLNRTRKEKMEEAYAAVCNWLKDDDEFFKDVDFEVYPQGSVKTGTTIRPNIGDEFDLDIVVHLQLDWQKHTPSYIYNQLKRRLMASGTYAEMIELKNRCIRLNYAGEFHMDILPGCQRTYSDEDRILVPDRALGKWTPSSPRAYAKWFIDRANSIETSLLEKAYSLEDLPPDSFMDKKPLQRAVQLIKKARDVFFDDDEDYAPSSIILTTLAGHYYQNDDSIFGAISGIMTGISQLITSSKDSQFKLYNPVDITEEFTDKWNNDKKHYTQFKLFVNHFNSVWSELQTGRLTILQEDELIKSLFGDAAYDKAIRLQAELVEKYRANQKLLMEKKTGILTSASVAGTIPVPKNTFDGRKI

SEQ ID NO: 599 - protein, 376 aa, Roseivirga ehrenbergii
MLITSNAKTQLEDTLAKMAEAAELDKTRWSRLNTAYEAISKWLSDDPEFFGGVEIEIYPQGSVSIGTTTKPYGKTEFDLDVVIHIKLLSSNYDPKTIFNEVVRRLNENETYRKICEPKSRCVRLNYQGDFHLDVVPGCMVIIYNHELIDITDQKNEIWLRSSPKGYQKWFLDIANRVELTLLEMTFSAHKVEIEEYAKKKPLQRAVQLIKMRRNIYFDQNPENAPTSIILTTLAAQFYEGQSSISETFEGIISKLKNHIETLFPNRPFELPNPVNPSENLADIWVDKPELYKHFISFINNLHNEWQDLKKAHGIEEEAILMKGMFGNDPYIKAMEARAETVNQKRGNGLGILATGVMVDRAVEKSLPVMPNTFYGD

SEQ ID NO: 600 - protein, 376 aa, Reichenbachiella sp.
MLITSDAYTQLEDTLAKMAEAAELDQTRWNRLKTAYEAISKWLSEDPDFFGEVEIEIYPQGSVSIGTTTKPYGRTEFDLDVIIHIKLLSSNHQPETIFNEVVRRLNENETYQKMSESKSRCVRLNYKGDFHLDVVPGCMVVIHDNELIDIPDQKRKIWLRSCPKGYQSWFLEIANKVQLTFLEKAFSANKIEIEEYAKKKPLQRAIQLIKMDRNIYFNKHPEHAPASIILTTLAAQFYDGQPSISETFEGIIDKIRNHIKILYPNRPFEIPNPANPSENLADVWEDKPELYSHFISFIEKLYSDWQKLKKSHGIEEEAELMKGMFGEDSYIKAMEAKADMVNKRRGQGLAILPSGIMIDSHAEKSLPVKPNTFYGD

SEQ ID NO: 601 - protein, 393 aa, Flavobacteriales bacterium
MLDIFNNYELQREELLARIAHELELDQTRKDRMEQAYNKVLEVLQKDEVFFKDLELELYAQGSVRTNTTVKPINREDFDLDAVLHIYDLYNKFDPTKIYNALVRVIEADPYYKTICEKKDRCIRLNFKNGFHVDILPGCMVTEDDRERIAIPEKKLKNWSSGNPKGFGVWFLAKAQSTENFLLKSFSDSFVKAEVEAEPLPDTGFYEKTPLQRSVQLVKRYRDIYFQDKDNRVSSIVITTLMGLFYNGEESIYETINNCLSKIKSGYNTSIEAGQKFKIVNPVDEHEVFTDSWTDVHYYSFYAFVEDLYFKWEILKKGFDTSGEKYVLLFGEKLYKNSLQTQLKSLGKYSKDAAAVSSGLVLNEHAMTDKAGNINQNQGVKNERHHNFGGENA

SEQ ID NO: 602 - protein, 398 aa, Lishizhenia tianjinensis
MLDIFDNYELQREELLARIAHELELDQSRKERMEQAYGKVLEVLKKDEIFFKDLELELYAQGSIRIHTTVKPINREDFDLDAVLHIYDLYNKYDPVKIYNALVRVLEQDPYYKTILKKKDRCVRLDFKNDFHIDILPGCMAEVDNRERIAIPEKKLKDWSSGNPKGYGNWFLDKSKLENGFLLESFSKSFSNSFIKADVDAEPLPDTQFYEKTPLQRSVQLVKRYRDIYFQDRENRVSSIVITTLMGRFYGKEETIYETIDSCLAKIKSSYNKALEDGKRFKIYNPVDDKEDFTDSWTDDNYRSFYSFIEDLYAKWEYLKKNFEKSGEKYVSLFGEKLYKSSIQAQLKELSKFSKNKAALASGLILNNEAKTDRVGNVNKDYGVKNTAHHNYGGAYFN

SEQ ID NO: 603 - protein, 279 aa, Bacteroidetes bacterium
MIDLFNNYRLQREELLARIAQELQLDKTRIERMERAYHSVAEVLKKDDDFFNDLEIEIYAQGSKRIGTTVKPINDEDFDLDTVLHIYDLYYNHSPEIIYNALRKALEKNPYYKSIMERKARCVRLNFKSDFHMDILPACMPTSFDKEKIKIPERGLKNWSTANPKGFAGWFLTIANSFDTSLLKMHSRELLEAKVESEPLPDELYLKTPLQRAVQLIKRYRDIYFENKDYRVSSIVITTLVAELYNGEGSIFDAIDNITQKIKDSYTVSIKAGKRFKVW

SEQ ID NO: 604 - protein, 390 aa, Aequorivita viscosa
MIDIFKDYRLQREELLARIAQELQLDKTRLERMESAYHSVAEALKKDDDFFAPLEIEIYAQGSKRIGTTVKPINDEDFDLDTVLHIYDLYYNYSPEQVYNALIKALEKDTYYKSIMEKKPRCVRLNYKSDFHMDILPACMPDSMDKEKIKIPEKALRNWSSGNPKGFANWFLNIANSVDTSLLRMYSKVLLEAKVETEPLPEEFYIKTPLQRAVQLIKRYRDIYFKNKDYRVSSIVITTLVAKLYDGEDSIFDAIDNVTQKIKDSYLDSIKTGCKFKVLNPVNIEEDFTDSWTQNHYNSFYNFISDFHKKWQSLKNSFETSNTDYIELFGEGIYKKSLTEQIKMFSKNSDDDFTRSSGLIIGNNAMTDSKGNININKGIKNEPHHSFGGK

SEQ ID NO: 605 - protein, 391 aa, Fabibacter pacificus
MIDIFKNYDLQREELLARIAQELQLDQTRLDRMDSAYNAVSKLLESDEEFFDGFQIEIYAQGSKRIEATVKPINNEDFDLDTVLHIYDPYFNHSPEEIYNALVKALQKDSYYKEIMEKKTRCIRLNYKGDFHMDILPACMPNAFEKEIIKIPEKALKNWSSGNPKGFAKWFLNIANSVEEPMLKRYADVLLEAQIDTEPLPQELYMKTPLQRVVQLLKRYRDIYYENRDYRVSSIVITTLAARFYQGESSIFDAMDHILTRVTGSYTDSIRSGHRFKVLNPVNKDEDFTDSWTNKHYESFNRFITHLYSKWQKLKGSFETSKNDYIELFGEGVYKKSLNEQFMSFSKSTDDVLTKSSSLINGGMAYTDSNGQINRERGVKNGTHHSYGGEY

SEQ ID NO: 606 - protein, 391 aa, Chryseobacterium sp.
MIDIFKDYILQREELLARIAQELQLDKTRLERMETAYNTVADLLKKDSDFFNDLVIEIYAQGSTRTGTTVKPINDKDFDLDTVLHIYDPYYKHSPEDIYNALVKALEKDSYYKAIMEKKKRCVRLNYKSDFHMDILPACMPNSFEKEVIKIPEKALKNWSSGNPKGFSIWFLSAANTASEPLLRKNFDSLVKAQVETEKLPQEVYFKTPLQRATQLIKRYRDIYFQDKDYRVSSIVITTLLGQLYQGENSIFETIDNVVKRIKDNFSVAVNQGIRFKIYNPVNPEEDFTDSWTSSHYSAFYSFIADFHIKWQNLKFSFETSKEDYIKLFGEGIYKKALNEQIVAFSKSSNNVFTKASSLITTGAALTNVQGNINSNTGIKNESHHNFGGKY

SEQ ID NO: 607 - protein, 391 aa, Elizabethkingia genomosp. 4
MIDIFKDYALQREELLARIAQELQLDNTRLQRMESAYNSVAELLKNDEDFFDDLVIEIYAQGSKRIGTTVKPINEEDFDLDTVLHIYDPYYKHSPEEIYNALVRALEKDSYYKSIMEKKKRCVRLNYKSDFHMDILPACMPDLLNKETIKIPEKALKSWSVANPKGFSNWFLFAANSVKDPVLFRNSELLLKAQIETEDLPKELYLKTPLQRAVQLMKRYRDLYFQDKDYRVSSIVITTLLAQFYQSENSIFETIDSTIARIKRKYNEARMGGYRFKIYNPVNQEEDFTDSWTNAHYNAFYDFVSDFYTKWENLKHSFETSKEDYIRLFGEGIYKKALNDQIKSFSKSTNDIFSKASGLITSGTAFTDINGNINSVQGIKNGSHHNFGGEY

SEQ ID NO: 608 - protein, 390 aa, Chryseobacterium scophthalmum
MIDIFKDYILQREELLARIAQELQLDNTRLERMESAYNSVANVLKKNPDFFDGLEIEIYAQGSKRIGTTVKPINDQDFDLDTVLHIYDPYHLHSPEEIYNALVKALEKDSYYSSIMEKKKRCVRLNYKSDFHMDILPACMPNLFEKEIIKIPEKALRSWSTGNPKGFAKWFTSISESAEKPLLKSFSNLVLEAKIETEELPEELYFKTPLQRSVQLLKRYRDVYFQNCNYPVSSIVITTLLAHFYRSENSIFETIDNIMSKIKDNYNRALIGGYKFKILNPVNNEEDFTDFWTDEHYKSFYSFITDFHTRWTKLKSSFETSKEDYIQLFGEGIYKKALNEQIRTFSKFSDNEFVKTSSLITSGTAYTNARGIINAKDGVKNESHHNFGGK

SEQ ID NO: 609 - protein, 389 aa, Cyclobacterium marinum
MIDIYKDYFLQREELLARIAQELQLDKSRTVRMETAYNAVSDLLKKDNDFFDGLQIEVYAQGSKRIGTTVKPINGEDFDLDIVLHIYDPYYNYSPEVIFNALVKSLEKDSYYKEIMEKKNRCVRLNYKGDFHMDILPGCMPNLFQNEMIMIPEKALKSWSSGNPKGFSKWFLEIAATAEEPFLKRYAEVLLKAQVDTEKLPSEVYLKSPLQRGVQLIKRCRDIYFQDKDFRVSSIVLTTLIAQFYEGEESIFETLDQVINRIKASYLDAFNRNVKFKVINPIDPNEDFTDSWTIRHYDSFFNFISNFHRKWSSLKNPFEFSKDDYIQLFGEGIYKKTLSDQTLNFRNSTNDYFAKSSGLIYSGNALTDAKGIINTNLGYKNEPHYNFGE

SEQ ID NO: 610 - protein, 396 aa, Chryseobacterium zeae
MKNFYDDFQLQREDILARIAQKLELDTTRREKMEQSYKAVSDWLDKDEGFFKGKNIDIYAHGSVRIYTTVRPLNNDDFDLDIVLHLNHLYSSYSPQQIYKELIRRLKENDNYSRMLEQKNRCARLNYAGNFHMDILPGCIITVINPNKLHVPDKKLSNWTPTNPKDYSEWFLERANSVIAPVLEGYFRKAFSEGIMLKAETEDLPNESFYTKKPLQRAVQLIKRQRDIYFENMPEYRTSSIILTTLAAQLYSGEDTIYGTIDNIINKIILQLNGQKRIKVLNPIMLEEDFSEKWDTEPILYEYFKKFIADFYIHWQTLKQDLSKSADTYDLLFGAKESIYKDVLIKQTRLFSKISDDKLIKTSGIILGGNALTDRYGNINTEKGIQNERHRDFGDI

SEQ ID NO: 611 - protein, 393 aa, Chitinophagaceae bacterium
MNDIYSNFHLQREDVLARIAESLQLDKTRKERMESAYTSICTLISEDTGYFKGMDIDLYPHGSVRIGATVKPLKNDEFDLDMVLHINKPYYSFTPQQVYDELYKKLKNDGRYSNMVEKKRRCIRLNYAGDFHIDITIGCIIHSSDPNNLKVPDRELRNWVDSNPKGYADWFLKIANSVRESLLEGYYDKLYSVRAEIQELPTDEFYKKKPLQRAVQLIKRYRDIYFANNSDYATSSIILTTLAAHFYNGEPAIFDTIDNILSRIVSDSGRLSSGQRIKITNPVNPNEDFTDKWDTEPLLYKHFLEFSKDLYTKWQQMKKQFSESAPTYEFVFGENIYKGAIKEQVEKLGKISSDKLYNAGALIMSGQAKTDNRGNINPNTGTKNERHRDFGDK

SEQ ID NO: 612 - protein, 544 aa, Vitellibacter aquimaris
MNFQEYLYNHGFQREDLLARLAESLELGETRSKKMETAYNAIYDLLKGDPVFFSKIDFVVYPQGSKAIGTTTKPIGKDEFDLDIVVQIRDLYYKYSSSEIYNHLIRVFTENEVYRIKLEPKNRCARINYSGDFHLDVLPGCIIIENGDRLKVPDRELASWTSSFPKGYSGWFLDRARDVRQPILLRKAFSDFVSLNEAKAEQEDLPSENIYLKEPLKRAVQLTKRYRDVYFSEKPKYRTSSIILTTIFAQFYQGEASIYETIDNVLNRILEHYSEYQQLFESRGVYKRIKVLNPVDPEEDFTDKWDKDNEYYIQFIAFAKSYKEKWERLKKGDFGIAEELFGSTRTKTILKAQMEDFSRGQGDTLEKAGLTILTGNNYVDSRGNITENKGYKSAPNRNYGGLELKLNQGNLIKDSKNYIAAHIQKQFIEDNFPWLWTMVKDGKLLGKGKIKPNGCKKEYELLVEYDINRTGRKERVFVLNDNKIQFGNTPHLYPGNSLCLYYPKDLPLFLDLNFVDVIPWISEWLVMYELWNKYGVWLADEVKH

SEQ ID NO: 613 - protein, 543 aa, Winogradskyella jejuensis
MNFQDYLYRNGFQREDLLARLAESLELDETRSNKMETAYNAIYDVLKADPVFFSKVDFIVYPQGSKAIGTTTKPIGKDEFDLDIVVQIKDSYRNYTSSEIYNHLIRVFTSNEVYRPKLLKKNRCARINYAGDFHLDILPGCIIIPFEDKIMVPDRELATWTSSFPKGYAKWFTDKAEGIREPVLLRKAFSDYVTLSEAKAEQEDLPDENIYEKEPLKRSVQLTKRYRDIFFEKKPKHKTSSIVLTTIFGELYQGEASIYETIDNTLNRILERYTSYEKLYESSGVYKRIKVLNPVNEDEDFTEKWDKDKEFYTQFISFVRSYKEKWEQLKNGNFSVAEDLFGSTRTKTILKSQIENLSRNGKNELEKAGLAILSGKSYVNDRGRISRDSGYPSKPNRNYGGVELNLNSGKKDIQKNYIAAHIQKDYLDKHFPWLKTVITDGKLLGKGKIRPNGCKKEYEILVEYNINRKGRKERVYVLNDSQIKFGKTPHLYPGNSLCLYYPKDLSPHLDLNFVDVIPWISEWLVMYELWKKYGVWLADEVKH

SEQ ID NO: 614 - protein, 400 aa, Elizabethkingia anophelis
MKNNYTKYKEEEFKKEELLAIAAANLELDDTRKEQMISAYKAVNDVFDKDEEFFKDYTVNVYAQGSLLIGTTIKPLPGKEFDLDIVLNLDDSYLNHTPKEIYDEVFRVLDNHGTYSPLLQKKNRCIRINYNSDFHMDILSGCKITSDNTRLMIPNDKTLIDWSRTDPKGYAAWFQNISEKHKLRFMLTERYMMLTEAKVETEDLPRDVYVKSPLQRTVQIIKRYRDLYYENKDLAKTPAISSIVLTTLLAQSYNEELSIQTALKNAMAKMKHLADDYKYKGIRFQVYNPIDLYPDNEKREKFTDSWTDKHYESYVGFVTDLERKVSTFLSNSTNEQNYKDLFGNGYYKQNIQTLVKLEESFKGNPRLAALLSGTAYTDSSGKINTSSGVKNGSHGFYAKS

SEQ ID NO: 615 - protein, 400 aa, Elizabethkingia anophelis
MKNNYTKYKEEEFKKEELLAIAAANLELDDTRKEQMISAYKAVNDVFDKDEEFFKDYTVNVYAQGSLLIGTTIKPLPGKEFDLDIVLKLDDSYLNHTPKEIYDEVFRVLDNHGTYSPLLQKKNRCIRINYNSDFHMDILSGCKITSDSTRLMIPNDKILMDWSRTDPKGYDAWFKNISEKHKSQFMLTERFVMLTEAKVETEDLPKDVYVKSPLQRTVQIIKRYRDLYYENKDLVKTPAISSIVLTTLLAQSYDEELSIQAALKNAMTKMKSFADDYKHRGIRFQVYNPIDLYPDKEKRENFTDSWTDKHYESYVGFVIDLERKVSTFLSNSTNEQNYKDLFGNGYYKQNIQTLVKLEESFKGNPQLAALLSGTAYTDSSGKINTLSGVKNGSHGFYAES

SEQ ID NO: 616 - protein, 400 aa, Elizabethkingia meningoseptica
MRNNYTKYKEEEFKKEELLAIAAANLELDDTRKEQMISAYKAVNDVFDKDEEFFKDYTVNVYAQGSLLIGTTIKPLPGQEFDLDIVLKLDDSYLNHTPKEIYDEVFRVLDNHGTYSPLLQKKNRCIRINYNSDFHMDILSGCKITSDSTRLMIPNDKTLMDWSRTDPKGYDAWFKNISEKHKSQFMLTERFVMLTEAKVETEDLPKDVYVKSPLQRTVQIIKRYRDLYYENKDLVKTPVISSIVLTTLLAQSYDEELSIQAALKNAMAKMKHLADDYKYKGIRFQVYNPIDLYPDKEKRENFTDSWTDKHYESYVGFVIDLERKVTTFLSNSTNEQNYKDLFGNGYYKQNIQTLVKLEESFKGNPQLAALLSGTAYTDSSGKINTSSGVKNGSHGFYAES

SEQ ID NO: 617 - protein, 400 aa, Flavobacterium succinicans
MKNNMKKYTEQEYQKEELLAIIASNLELDATRQQQMKSAYTAVTDVLSNDEAFFKDYKINVYAQGSLLIGTTIKPLSGQEFDLDIVLHIESSYLNHTPSEIYDALYRVLSNHDTYKPLLEKKNRCVRIDYNSDFHMDILPGCIITINNNRLMIAENERRNSWSRTNPKDYGTWFKEIAERNKGSFILNERYNLMLKATVETEDLPLEVYQKTPLQSTVQIVKRYRDLYYQDIDTSKMPAVSSIVLTTLIAQCHEGNLSIQEALVNATQKLRKLAEGYKLRKEKFAVYNPVDDHEDKDKRENFTDSWEDKHYNSFVAFVEDFAKKLNAFLNNGTNETSYKELFGNGFYKQNIQTLVKLEERVKGNTQFATLLAGNAYTDNRGNINTTTGVRNGSHGFFAQP

SEQ ID NO: 618 - protein, 377 aa, Elusimicrobia bacterium
MNQTRATIHPIDYILERLCINLQISDSLYGSAEESYKAVGNWLAEKSDLAANKPAIYPQGSLKIGTTIKPIGNEEYDLDMICEFGNVNSMINPKELLNAVYQTIKSNSNYSDIAELKKRCVRINYKRQFHLDIVPAMPNTNDTGTCIFIPDKQENGGVGVWIPTNPKGYANWFEERCKIPRDILNKAAKLEHLPENEPFYDKPPLKRVVQLLKRWRNNVYKDIIEQAPVSIVLTTLAAEHYKNEINLSDAMTTILNSINERNKNGYYEVNNPTTSSPMELLSEKWKKNPECFNHFVIAFGSLTRMWNELKNDRGTVLENRLTLMFGNTDGLVKKAYMDYNNTITEMRKSESLSMSKSGILSTLGGGVKVRPNTFHGD

SEQ ID NO: 619 - protein, 377 aa, Acidobacteria bacterium
MATAEKAIWFQSSREQLDALLMEVCEGLQLSLSRHELAVERYGTVNEILEKAGSPFQFLRPRIFPQGSMALGTTCKPVEGPHDLDFVLQIDAPHWRWHPLAGLSALYEFLSSNETYRKMISLKNRVVRLTYADEFYMDILPAYTDLSSGGTCILVPDRARVSLCPSNPEGFILWFRNRCLTRTRRVMEKAKPVPAQEAVHEKEPLQLAVQLLKRWRDLAFAEECLAPISVVLTTLAGMYYAGEESVSEAMTTILSGIVNAIALEDLQGKRIVVRNPSNLLEDFGERWDANPQAYNAFKAGIRRLQKEWTVIVAGGRETDKELERLFGEYVRTALVKRAQRLQEARKAGALAVGSTGAITGLASGVARIRPNVFHGDA

SEQ ID NO: 620 - protein, 405 aa, Rhodococcus jostii
MQVAGRFAGLQGACKGGCGGGGRPVGWVRQDRAGSGGAANTSFRLRPRGRGGSSLRLSTGTGAAGSVFPIGVVVAPVVVDPGGCLGCVGERNEYDLDLVSQLDVAKTSTTQQELKNRVGALLDDYRKDHDGQACESPGKVSEGRRSWCLHYDNFHMDVLPAIPDADSPSATAIELTDRNLRNWQKSNPLAYVEWFRTQCAKQFEEERAILASSYGSVDAVPNHRVRTPLHRVVQILKRHRDIYFANDLDDRPPSSLITTLAGKGYEGETDLVDATMSAVQRMPEHIEKRSGRYWVENPACDGENFADKWNEYETRRLKFEDWRATVERDLNEFLLETKRVVALHQRIAKAFGNAPVEEALKTLGARTNTARENGNVHFSTGGLLTTASTATAVPAHRFFGGETAR

SEQ ID NO: 621 - protein, 383 aa, Gordonia terrae
MTILADTKEEQISQLLGATIAQLDINEAAFRTAESCYQDLGYHLSEAGAQVYVQGSFMLGTVVRPYHRAGEYDLDLVSLLDIAKTSITQEELKKRVGRLLADYNRDHNSTACESPGHVSEGRRSWCLHYEHFHMDVLPAIPDAESPSATAIELTDLNLRNWQKSDPLAYVEWFRSQCATQFDSERAALAKSYGSVDAVPKHRVRTPLHRVVQILKRHRDIFFANDLDDRPPSSLITTLAGLAYQGETDLIDATVSAVQRMHDHIENRGGRYWVENPACKGENFADKWNDYEIRRLKFDQWRAAVEHDLTSFVLETSGTTALHRRVASAFGSDPVEKALQQIGATTNRARVGGQVNLTPGGRLTTSTTATTVAAHRFYGGQTTR

SEQ ID NO: 622 - protein, 383 aa, Williamsia sp.
MTILADSKEQQISQLLGATIAELDINEAAFRAAESCYQDLGDHLSQAGAQVYVQGSFMLGTVVRPLHRAGEYDLDLVSLLDIAKTSISQEELKKRVGRLLAEYHRDHDGAACESPNQVSEGRRSWCLHYEHFHMDVLPAILDVESPSATAIELTDLNLRNWQKSDPLAYVEWFRRQCARQFDAERVALAKSYGSVDDVPKHRVRTPLHRVVQILKRHRDIFFAEDLDDRPPSSLITTLAGLTYQGKTDLVDATISAVQRMHDHIENRAGKYWVENPACAGENFADKWNDYEIRRLKFEQWRTAVERDLTGFVLETSGTTALHQRFAKAFGTDPVEQALQHIGAATNRAREGGNVNLSAGGRLTTAATTTTIPAHRFYGGQAAR

SEQ ID NO: 623 - protein, 383 aa, Nocardioides alpinus
MTTLATTQDEQISQLIDTTIEQLDITDEAFDAAERCYHDLGDRLSEANAEVYVQGSFLLGTVVRPHGDHVEYDLDLVSKLDTAKTSITQQELKDRIGDLLADYHAEHDGQACESPRKVSEGRRSWCLHYDDFHMDVLPCIPDAAAASDTAIELTDRNLRLWQKSDPQAYVNWFRGQCAKQFEEGRVMLSKTYGSVEAVPKHRVRTPLHRVVQILKRHRDIYFGEDHDDRPPSSLITTLAARSYLGEKDLLAATMGAVQRMPAHVEMRNGDYWVENPACEGENFADKWNDYEIRRLKFEAWRAAVEQDLAGFIEETNGTVALHQRVAKAFGSAPVEQAVKVLGTRTNLAREAGNVHFATGGLLTTAATTTAVQDHRFFGGQAPR

SEQ ID NO: 624 - protein, 379 aa, Rhodococcus sp.
MTILADTREAQVSQLLGTTIEHLDITDAAFKAAESCYLHLGEHLAQANAQVFVQGSFMLGTVVRPHNRTGEYDLDLVTQLDVAKTSITQKDLKEKVGALLADYRKDHDSDICESPAELSEGRRSWCLHYGKFHMDVLPAIPDADSRSETAIELTDRNLWNWQKSDPLGYVVWFREQCAKQFEEQRAILASAYGSVDAVPKHRVRTPLHRVVQILKRHRDIYFADDLDHRPPSSLITTLAAKGYEGETDLTDATIKAVQRMPKHIDERNGRYWVENPACAGENFADKWNEYEDRRMKFHAWRAAVERDLRDLLRLTDGAVALHKRMAKSFGDAPVQDAQKTIGERTNNARKNGQVHFATGGLLTTTTTPTPVREHRFYGG

SEQ ID NO: 625 - protein, 388 aa, Unknown
  Description of Unknown: Arthrobacter sequence
MTISLERTGFRDLEKVLGAGISTLDITEKEKALVTSRYQALGESLNEHWAESTADNRVYVQGSFALGTMTRRIHRNDDVDIDLVVLRGIQASSTTQVELKKDTGAGLRKFLAASQAKSSLVESERCWTLEYPGMHMDVLPAVPDTSPERGSDDGILITDHDVRSWQRSDPRGYALWFKQVTLEEVLLKEALLAKRGVDVDAVPNWNRKTTLQLAVQALKRHRDIYFNGRLNQQPSSIVITTLAARAYQQGENLFEVLQGIAGTIATHIQVANGQYVVANPVMPEENFADCWADERWRANAMFEWAEAVSRDINAIAARSGNDNVLKGVQMVLGENAAFAGARALSNPLVEARKSGDLRAQHGAATLAVTGTAATTRPVRKHDFHGGRV

SEQ ID NO: 626 - protein, 388 aa, Arthrobacter sp.
MTISLEQTGFRDLEEVLGASISTLDITENERVQITSRYESVGEILDKHWADSPANNRVYVQGSFALGTMTRKFHRNDDVDIDLVVLRGIQAASTTQSDLKEDTGAGLRKFVAASQPKASLAESERCWTLKYPGTHMDILPAVPDTSPERGSDDGILITDHDVRAWQRSDPRGYASWFRQVTREEVMLKEILLAKRGVDVDAVPAWTRKTTLQLAVQVLKRHRDIYFTGRLEQRPSSIVITTLAARAYQRGENLFEVLQGISGSFVEHIQMINGKHVVANPVMPEENFADCWANERWRAAAMFEWAEAVSRDVNAIAARSGNDNVLKGVRMVLGENAALAGARALSTPLVDARQSGFLRAESGTGALAIAGAATATRPVRPHIFHGGGM

SEQ ID NO: 627 - protein, 366 aa, Micromonospora aurantiaca
MNMSRDDRLARVLGAGIESFDIPEEQYLIAEATYKVACTFLRDYWADNEAGGALYPQGSMRLGTVTALIHRRDEYDLDMVCRHDLDKTETSRDDLKADVGEALKHFAKEHPELGLTLDDEGRRCWTFQHDTLPFHMDILPAIPNLEAGPNGILVTDTQASRWHHSAPIDYADWFLDVQYDEWRAGAVRVAENRQMDVEALPRRFFKTTLQRTVQALKRHRDIFFTDDLGNRPSSIIITTLAAQSYEPRGGLFDVLHHVVEQMPTHVDYKLGRYVIANPVESGENFADRWIGHPARPRRFFEWLEAALRDFTAIAEAHHTDDMLARTAHALGSRPAAAAHDALNADPGVTRRLVVAAPVPAGNERFA

SEQ ID NO: 628 - protein, 355 aa, Micromonospora aurantiaca
MLGAGIESFDIPEEQYLIAEATYKVACTFLRDYWADNEAGGALYPQGSMRLGTVTALIHRRDEYDLDMVCRHDLDKTETSRDDLKADVGEALKHFAKEHPELGLTLDDEGRRCWTFQHDTLPFHMDILPAIPNLEAGPNGILVTDTQASRWHHSAPIDYADWFLDVQYDEWRAGAVRVAENRQMDVEALPRRFFKTTLQRTVQALKRHRDIFFTDDLGNRPSSIIITTLAAQSYEPRGGLFDVLHHVVEQMPTHVDYKLGRYVIANPVESGENFADRWIGHPARPRRFFEWLEAALRDFTAIAEAHHTDDMLARTAHALGSRPAAAAHDALNADPGVTRRLVVAAPVPAGNERFA

SEQ ID NO: 629 - protein, 367 aa, Micromonospora rhizosphaerae
MTVMNRDDQLTQVLGAGIESFDIPEDQFKVAEFAYKAACDFLSTYWSGSGTGGALYPQGSMRLGTVTALIHRHDEYDLDMVCRHDLELSQIDPEDLKADVGDALENFVKEHPELRLTLDDEGRRCWTFVHDLLPFHMDVLPAIPNAAAEPNGIWATDTEGSRWHPSAPTDYADWFLGVLHDEWLAGAIRIAESRQMDVEQLPRNAFKTTLQRTVQALKRHRDIYFSDDPSNRPSSIIITTLAARSYEPGGDLFNVLHHVVHQMPDHVESRFGRYVIANPVEPDENFADRWIGHPVRARRFFEWLEAAQRDFTAIGDAHDTGDMLDQTALALGIRAARAAEQAVATGTTARRSAMIATRVPAGSDRFA

SEQ ID NO: 630 - protein, 364 aa, Micromonospora rhizosphaerae
MNRDDQLTQVLGAGIESFDIPEDQFKVAEFAYKAACDFLSTYWSGSGTGGALYPQGSMRLGTVTALIHRHDEYDLDMVCRHDLELSQIDPEDLKADVGDALENFVKEHPELRLTLDDEGRRCWTFVHDLLPFHMDVLPAIPNAAAEPNGIWATDTEGSRWHPSAPTDYADWFLGVLHDEWLAGAIRIAESRQMDVEQLPRNAFKTTLQRTVQALKRHRDIYFSDDPSNRPSSIIITTLAARSYEPGGDLFNVLHHVVHQMPDHVESRFGRYVIANPVEPDENFADRWIGHPVRARRFFEWLEAAQRDFTAIGDAHDTGDMLDQTALALGIRAARAAEQAVATGTTARRSAMIATRVPAGSDRFA

SEQ ID NO: 631 - protein, 364 aa, Actinoplanes derwentensis
MNADRDDQLSQVLGAGIESFDIPEDQFKIAEDAYQAISDYLRSYWPSTGGAMYPQGSMKLGTVTALIHRNDEYDLDVVYRRDLDMSQIASATLKADLGDALDHFANECPQLELKLDDEGRRCWTFVHDTLPFHLDILPAIPRPDAGPNGIWATDTEGPEWHPSAPLDYANWFFGVLDDEWRAGAAWIAEHRQMAIDRLPRNAFKTTLQRTVQALKRHRDFYFIGDPANRPSSIIITTLAALSYEPAGDLFTVLCHIVGQMPDHVESRFGRHVIANPVAPAENFADRWIGHPIRAQRFFQWIEAAQRDFTAIGDAQNIDEVLRRTEFALGTRAADAARQELATGTSSTRTTMVTTRVPAGNDRFA

SEQ ID NO: 632 - protein, 485 aa, Anaeromyxobacter dehalogenans
MATLSSRNQEFLGTLLSEVTQSLDIPEPLRNQAVERYEAVGAWLATEDSELQPFQPKVFPQGSFRLGTVVRPMNRNGAYDIDLVCELLVAKDEITQRDVWSLVGGRLKLNPEFGALTVPSTRCWTLDWSKSFHMDVLPSIPNVEAQPTGILLGDKKLAQWQKSDPIRYADWFKERMRVALRERRAALAESLGASVEDVPEWRVRTPLQRAVQVLKRHRDQTFSGEEDQKPLSIILTTLAALSYDNEPDLVDALIAIVEKMPQYIQVRDGKFFVMNPAEPSENFADRWNEDPKRRQAFLSWLNTLRTDISEWVHSTELKKAYPLLERGLGKEEITRAARTAEERFGMVSTASTLAAAARSQGEDIPHAQVPPWPLILGSNARLSAAVHRSRGGPKISELADQLLPKHVSILFQLETDVPPPCDVYWQVVNTGSEAAAAKGLRGGIELGAMSKWEDTKYRGTHWVEAFVVKRGACVVRTGRRLVRIS

SEQ ID NO: 633 - protein, 317 aa, Smithella sp.
MRITPQPNSELDKLLINTASILDIPDHVYEDATLKYEDVGNWLGAEDSELFNYAPDIYVQGSFRLGTVVRPISAKDEYDIDLVCHLSINKENISQKDLKEMVGMRLKKRKDLAEILKPSRRCWILEYPTGNHMPNFHMDILPAIPNIARQPTGILLTDTELKLWQKSNPKAYADWFYERMKVIFQERRAAFAESIQANIEDVPAWQVKTPLQTAVQILKRHRDIYFLDKQDLKPVSIIITTLAALSYENQPSVYDALIGIMQKIETNWGKKGFVEYRNGKWWVANPVDDDENFADKWNEYPARRESFLAWLKKVQRD

SEQ ID NO: 634 - protein, 339 aa, Verrucomicrobia bacterium
MLINAREKLASILQVSADTLDIPEHVYEDATIKYEDVGEHLAAADSDLRPYNPQIYVQGSFRLGTVVHPYSRGDEYDIDLVCQLDIKKESISQKDLKDKVGARLKTRPDLAKILGSSRRCWLLDYPREPGMPGFHMDVLPSIPNAERGPTGILLTDTELAHWQKSNPIAYAEWFKKRMEVVFRVKKAALAESMFASIEEVPDWRVKTPLQRCVQILKRHRDIYFDKHPEVRPVSIILTTLAAHAYQNEEDIFDALTGIAERMPSFIVYKNGKWRVDNPVDDGENFAHKWNEYPERRTAFLKWLKQVSLDFANVSKAPSLDAGLIMLEESLGKHTMGKVA

SEQ ID NO: 635 - protein, 382 aa, Nitrospira moscoviensis
MLIQTKEQLGRVLHYIADSLDMPEQLQEQAVAKYQEVGRWLADTESPLQGNTPDVYPQGSARLGTLTKPVTDRDEYDIDAVALLQVMKQSISQQELKQRIGDRLKQHPEYRVFLEEKRRCWTLNFENGLHVDVLPAIPDEEGLPESILITDRELTRWQHSNPKGYAAWFWSRMKSIFEEERRALAKALQAEVEAVPDWKIKTPLQRAIQLLKRHRDLHFQHDQDDKPASIIITTLAAWAYEGQTNLLDALAGMACTMPDHIESRKGVYWVVNPVNEEENFADKWKEHPQRRHKLLTWLNKVNVDLKTVGDVRGIPEIAQALGASFGSPVTRKAVTRLGDVFTQQRQSGKLWMASGTGTLGATGITKVRNHTFYGGMAKAEKP

SEQ ID NO: 636 - protein, 492 aa, Rhodopirellula bahusiensis
MQEVAQERLSDIFRYIAADLDITREQYEDAVVKYRDVGEHLGAEDSPLQSAYPVIYPQGSFRLGTMVKPYVDSDEFDIDLVCHLNLKKESVTQAELKKRIGNRLKDRSDLKKILKESRRCWLLDYPEQFHMDVLPAIPNLDRLPNGILLTDTELRYWQHSSPKDYADWFMERQEVILLEKMATYAERYQMSIEDVPEFDRELKTPLQRTVQLLKRHRDIYFAGDLCNRPVSMVITTLAARAYGNQGDLYDALDTITDRMTDFIEKRENGEWWVENPVNEDENFADKWNDYPERRDAFFHWLKVVRQDVCEALIQGSLEKSARVLCSAFGESVVTRASERAGVYSPSSNRMMIKSAESVPQPGTLVHQKAPIWPVQQQYQSMIKTTVHGSMGSGKRLWTMTKKPIQKGLWLRFELKTKVPQPFEVYWQVTNTGKEAFQAGQPRGDSFEKGSGSFGQINWEQTAYRGTHFVTGFVVRNGICVSQTPAYKVRIRD

SEQ ID NO: 637 - protein, 376 aa, Olsenella sp.
MNKDNSLLNELYAALAQELDISETMRRKAEMAYKSVGEWIDGDTDQPADVFVQGSFALGTVTRPVSGEDDDYDIDLVSELPGMTHFSPRAIKHHVGDRLKEHGTYAQKLKPEGKRCWTLLFDEFHMDVLPCTPDPTVCSTTAITLTNRERDGAYTTRSSDPRAYQSWFERRMGDSLTHARQRVVGKGYASVDKVPTFAVSTPLQMAIRILKHHRDVMFEGRDDAPISIIITTLAALSYDQQAGVFDAVSGVLGSMSEHIRREGGLYIIENPVDSKENFADRWNTEPWKARAYFDWISAARHDLVDKPLGSAGIDVLSDGLKGPLSENVVSRAFSRFGDRMYAERQANALHYGTREGITLATSATTVAVPNHRFYGA

SEQ ID NO: 638 - protein, 418 aa, Rhodopirellula europaea
MILRPQDTLNSLLVQVAKSLDVPEELHKAAVLEYEQLAFFLEELDEAAGRRSPEIYSQGSFALGTATQPVKSDDEYDVDLVYERMLKKEGKTQQQLKDEAGENLTEYVKHRRQTGQTVPELSEGSRCWCLNFPDQFHMDVLPAIPDAEQREIVATDAAKHILITDKSVRCWLPSNPRQFADWFRSTMEVRLEAIKKSMAEASLRRDGLVVNDWQIKQAAESIPEYEIKTPLQRAIQILKRHRDCRFDGDPENRPASILITTLAAKAYSNEANLLDALLNLVHRMPDHIEEREVNGQSVAWVENPINPSENFADRWQAEDYPDREKHFRVWLEQVGIELEEAIKGGGIHRVLDLLGASLGRQVVEASAKSLGYDVQRASSSGKLAVASSTATLITGTAPIPNTTPVRGHTFYGESKRNR

SEQ ID NO: 639 - protein, 390 aa, Streptomyces hygroscopicus
MNALHLMPEADTDSLEQMLSMLLDGAVETLDVSLDLYETAVHRYKEVGTWLGLHASPDYTIYPQGSFLLGTVVGPQTRTGEYDIDLVCRIPLHKTSTTQEQLKQRVGNQLIAYRRWKQKQGHTDGPISLESRRRCWTLGYTGFHLDVLPAIPDDEHQPHGILLTDKNLHAWQHGNPTGYARWFSTRSELSRAYLEKRASIADVPVWHIRSTLQRLVQVLKWHCMTFFADDTDNRPPSILLTTLAGRAYRGEDNLFTALRNVLAAMPGFIKRRNGQWWVANPAHEEENFTDKWNEYPERRQAFTTWFDELTATMDNLSRMHSEGLDAVYAHLTKSFDPGPLQHSFTRYANRMKSTATRQRMNTTGLLSTTTTTGPRRRPQTFHGQHTDARD

SEQ ID NO: 640 - protein, 373 aa, Streptomyces hygroscopicus
MLSMLLDGAVETLDVSLDLYETAVHRYKEVGTWLGLHASPDYTIYPQGSFLLGTVVGPQTRTGEYDIDLVCRIPLHKTSTTQEQLKQRVGNQLIAYRRWKQKQGHTDGPISLESRRRCWTLGYTGFHLDVLPAIPDDEHQPHGILLTDKNLHAWQHGNPTGYARWFSTRSELSRAYLEKRASIADVPVWHIRSTLQRLVQVLKWHCMTFFADDTDNRPPSILLTTLAGRAYRGEDNLFTALRNVLAAMPGFIKRRNGQWWVANPAHEEENFTDKWNEYPERRQAFTTWFDELTATMDNLSRMHSEGLDAVYAHLTKSFDPGPLQHSFTRYANRMKSTATRQRMNTTGLLSTTTTTGPRRRPQTFHGQHTDARD

SEQ ID NO: 641 - protein, 365 aa, Streptomyces violaceusniger
MLSMLLGGAVETLDISPDLYDTAVHRYKDVGTWLGLHESPEYKIYSQGSFLLGTVVRPQTPTGEYDIDLVCRIPLHKTSTTQDDLKKRVGDQLIAYRSWKQQQGHSDGPASLEPRRRCWTLGYTGFHLDVLPAIPDDDRQPHGILLTDKNLHKWQHGNPIGYADWFSARSELSHALLEKRASIADVPVWHIRSTLQRLVQVMKWHCMTYFGDDTDNRPPSILLTTLAGRAYRGEDDLFTALRNVLAAIPDFIERHNGQWWVANPAHKEENFTDKWNEYPERRQAFRTWFGEFTETMDNLSRMHSEGLDTVYSHLTKSFDPGPLQHSFTRYANRMKNTATQQRMSTTGLLSTTSVGPRRRPQTFHG

SEQ ID NO: 642 - protein, 372 aa, Streptomyces canus
MLSMLLDGAVEVLDISPDLYDNAVGRYEEVGTWLAEHGSPGWQIYPQGSFRLGTVVRPGTPSGEYDIDLVCWLPLHHESTTQEKLKQRVGDQLTAYSQWKQEQGDTDGPETLEPRRRCWTLGYPGFHLDVLPAIPDQDHQPTGIRLTDKDLWEWQRSNPIGYADWFRQRSELSLQILDKRHASVADVPTWPVRSPLQRVVQILKWHCMIKFAEDSDNRPPSILITTLAGHAYSGEEDLFTAVRSVLDNMTGFIEKRDGKWWVPNPAHEEENFTDKWNEYPERRRAFHAWFDEIATTVTELAGMEGKGLPAVFDRLVKSFQHDPMLRSYERYAARMGSATNHRMGATGLLSASATGPRKREHTFHGQHSHPRD

SEQ ID NO: 643 - protein, 372 aa, Streptomyces sp.
MLSMLLDGAVEVLDISPELHDNAVERYEEVGTWLAENGSPGWQIYPQGSFRLGTVVRPGTPGGEYDIDLVCRLPLRPESTTQERLKQRVGDQLTAYLKWKQDRGHTDGPESIESRRRCWTLGYPGFHLDVLPAIPDEDRPPTGIRLTDKDLWQWQRSNPIGYADWFRRRSELSRQILEKRHANVADVPTWPVRSPLQRVVQILKWHCMIMFAEDIDNRPPSILITTLAGHAYSGEDDLFTAVRSVLDNMLTFIERRDGQWWVPNPAHKAENFTDKWNEYPERRKAFHAWYDEIATTVSELAGMETKGLDAVFERLAKSFDPAPVRRSYERYAARVSASTNNRMGPTGLLSPTTAGPRKLKNTFYGQHSSPRN

SEQ ID NO: 644 - protein, 372 aa, Streptomyces sp.
MLSMLLDGAVEVLDISPELHDNAVERYEEVGTWLAENGSPGWQIYPQGSFRLGTVVRPGTPGGEYDIDLVCRLPLRPESTTQERLKQRVGDQLTAYLKWKQDRGHTDGPESIESRRRCWTLGYPGFHLDVLPAIPDEDRPPTGIRLTDKDLWQWQRSNPIGYADWFRRRSELSRQILEKRHANVADVPTWPVRSPLQRVVQILKWHCMIMFAEDIDNRPPSILITTLAGHAYSGEDDLFTAVRSVLDNMLTFIERRDGQWWVPNPAHKAENFTDKWNEYPERRKAFHAWYDEIATTVSELAGMETKGLDAVFERLAKSFDPAPVRRSYERYAARVSASTNNRMGSTGLLSPTTAGPRKLKNTFYGQHSSPRN

SEQ ID NO: 645 - protein, 372 aa, Streptomyces sp.
MLSMLLDGAVEVLDISPELHDNAVERYEEVGTWLAENGSPGWQIYPQGSFRLGTVVRPGSPRGEYDIDLVCRLPLRPESTTQERLKQRVGDQLTAYRKWKQDRGHTDGPESIESRRRCWTLGYPGFHLDVLPAIPDEDRPPTGIRLTDKDLWQWQRSNPIGYADWFRRRSELSRQILEKRHANVADVPTWPVRSPLQRVVQILKWHCMIMFAKDVDNRPPSILITTLAGHAYSGEDDLFTAVRSVLDNMLTFIERREGQWWVPNPAHEAENFTDKWNEYPERRKAFHAWYDEIATTVIELAGMETKGLDAVFERLAKSFDPAPVRRSYERYAARVSASTNNRMGPTGLLSPTTAGPRKPKNTFYGQHSSPRN

SEQ ID NO: 646 - protein, 368 aa, Streptomyces sp.
MLSMLLDGAVEVLDISPELHDNAVERYEEVGTWLAENGSPGWQIYPQGSFRLGTVVRPGTPGGEYDIDLVCRLPLRPESTTQERLKQRVGDQLTAYRKWKQDQGHTDGPESIESRRRCWTVGYPGFHLDVLPAIPDEDRPPTGIRLTDKDLWEWQRSNPIGYADWFRQRSELSRQILEKRHANVADVPTWPVRSPLQRVVQILKWHCMIMFAEDIDNRPPSILITTLAGHAYNGEEDLFTAVRGVLDNMLTFIERRDGQWWVPNPAHEEENFTDKWNEYPERRRAFHAWYDEIATTVIELAGMEAKGLDAVFERLAKSFDPDPVRRSYERYAARTSAATNNRMGSTGLLSPTTAGPRAPKNTFYGQHS

SEQ ID NO: 647 - protein, 385 aa, Micromonospora krabiensis
MDTIEQMLSMLLDGAVETLDISPHLQQLAVERYEEVGTWLAEHGEPDWRIYPQGSFRLGTVVRPSTRTGEYDIDLVCRVPRRKENITQAQLKQLLGDMLHAYLRWKNRQGHTDGPKSCESRRRCWTLEYPDHGFHLDVLPTIPDIEHPPTGILLTDQNLREWQHSNPIGYADWFKRRCEQGRSLVEAKRHLNVADVPDWTVRSTLQRIVQVLKWHCMLRFANDPDNRPPSILITTLAARAYRGEQDLFTGARAVLDGMTSFVENRHGKWWVPNPAHEEENFADKWNEYPERRLAFIAWHRGIVTVLDDLAGLQGKGLQVIASRMSESFSAGPVFKSVESYGDRMRHSRETGALRMTSTGLLTTTATTGPRVRDHHFYGEHPDPRR

SEQ ID NO: 648 - protein, 379 aa, Micromonospora krabiensis
MLSMLLDGAVETLDISPHLQQLAVERYEEVGTWLAEHGEPDWRIYPQGSFRLGTVVRPSTRTGEYDIDLVCRVPRRKENITQAQLKQLLGDMLHAYLRWKNRQGHTDGPKSCESRRRCWTLEYPDHGFHLDVLPTIPDIEHPPTGILLTDQNLREWQHSNPIGYADWFKRRCEQGRSLVEAKRHLNVADVPDWTVRSTLQRIVQVLKWHCMLRFANDPDNRPPSILITTLAARAYRGEQDLFTGARAVLDGMTSFVENRHGKWWVPNPAHEEENFADKWNEYPERRLAFIAWHRGIVTVLDDLAGLQGKGLQVIASRMSESFSAGPVFKSVESYGDRMRHSRETGALRMTSTGLLTTTATTGPRVRDHHFYGEHPDPRR

SEQ ID NO: 649 - protein, 381 aa, Frankia coriariae
MLSMLLDGAVETLDIAPHLQQLAVERYEEVGSWLAEHGGYRCRIYPQGSFRLGTVVRPDSRTGEYDIDLVCWLLIAKESITQAELKQRVGDLLHAYLRWKKRHGHTDGPKTCQARRRCWTLSYPDHGFHLDVLPTIPDVDHPPTGILLTDKQLYRWQHSNPIGYATWFRRQSEQLQQLLVEAAAKRHINVADVPEWEVRSTLQRVVQILKWHCMLRFAHNPDNRPPSILITTLTAQAYHGEVDLFTATRNLLNRMDDFIENRHGKWWVPNPAHEEENFADKWNEYPERREAFFAWHRDITTVLDDLVQLQGKGLQVVASRMAESFGPDAVQLSAQRYGDWLRRQTESGALRMTGTGLLTTTVAGTPVRRHTFHGQHTDPRG

SEQ ID NO: 650 - protein, 381 aa, Frankia sp.
  MOD_RES (329)..(329): Any amino acid
MLSMLLDGAVETLDIAPHLQQLAVERYEEVGSWLAEHGGYRCRIYPQGSFRLGTVVRPDSRTGEYDIDLVCWLLIAKESITQAELKQRVGDLLHAYLRWKKRHGHTDGPKTCQARRRCWTLSYPDHGFHLDVLPTIPDVDHPPTGILLTDKQLYRWQHSNPIGYATWFRRQSEQLQQLLVEAAAKRHINVADVPEWEVRSTLQRVVQILKWHCMLRFAHNPDNRPPSILITTLTAQAYHGEVDLFTATRNLLNRMDDFIENRHGKWWVPNPAHEEENFADKWNEYPERREAFFAWHRDITTVLDDLVQLQGKGLQVVASRMAESFGPDXVQLSAQRYGDWLRRQTESGALRMTGTGLLTTTVAGTPVRRHTFHGQHTDPRG

SEQ ID NO: 651 - protein, 381 aa, Mycobacterium chimaera
MDTIEQMLSMLLGGAVEVLDISPDLQQLAVDRYEEVGNWLAEYADVRCDVFPQGSFRLGTVVRPATATGEYDIDLVFRMLIAKEDTSQAQLKADVGDLLNSYANWKKVHGHTDGPTGLHDRRRCWTLDYTDHGFHLDVLPAIPDTRFPPTGILLTDKQLFHWQHSDPIQYSSWFRGRSKELQRKLIAAAEARQMNVGEVPEWTVRSTLQRVVQVLKWHCMLYFADNCDDRPPSILLTTLAAKAYRGETDLVIAAQTVLAGMHDHIETRNGKYWVPNPAHEKENFADKWNDYPRRRDAYLAWHHDISTTLNDVAGMQGAGLQAVTARLEKSFGRNEIRLSAKRYGKQLAEQREAGNLRLRPSGLLSTSAIGTVVPNHTFYGR

SEQ ID NO: 652 - protein, 384 aa, Unknown
  Description of Unknown: Mycobacterium sequence
MSTMTMNPLSALLAGAVDLLDIPPDLQKIVVARYQDVGNFLADNGGARCSVYPQGGFLLGTAIFPPQRTEYDIDLVFRDGITKDDTTQADLKERVGGMLDDYNDYKFGSDDAPDAFFEKRRCWTLSYSSQGFHLDVLPAVIDTDFRTSPNGILLTDTKLRPWQHANPKDYAIWFRGRSEEMRRKIAASARAENVADVPNWAVRSTLQRLVQVLKWHCYLDFANDVDNRPPSVLITTLAAHAYQGQDDLGDALLEVIDDMPNFIKTSNGRWLVLNPAQPKENFVDKWNEPDTAHRRQAFNSWLRRIQHDIETAANARDSGLDVLVDRLSGTFDRGVLAKSAANWARTTVDLRGQRRLGIASGTGALVIGSGRPTPPHGFYGRGRA

SEQ ID NO: 653 - protein, 384 aa, Mycobacterium abscessus
MTTMTMNPLSALLAGAADLLDIPPHLRNLVVARYQDVGQFLAENGDDRCSVYPQGSFLLGTAINPPQQTEYDIDLVFRDGITKDETSQAELKERVGGMLKAYNDYKVGSDDAPDDFSEKRRCWTLSYSSQGFHLDVLPAVIDTDFAKSPNGILLTDTKLRPWQYANPKDYAIWFRGQSEEMRRKIAASARAGNVADVPNWVVRSTLQRLVQVLKWHCYLDFANDVDNRPPSILITTLAAHAYSGQDELDAAILEVIDRMPNYISKSNGRWLVPNPAQPKENFVDKWNESDTAHRRDAFNDWLRRVQRDIEFASDAEASGLDILVNRLSSTFDRGVLEKSAANWARATVDLRRQERLGISSGTGALVISSARPNPRHGFYGRGPA

SEQ ID NO: 654 - protein, 388 aa, Mycobacterium kumamotonense
MTTTTTTTTMNALSALLTGAVDILDIPPHLRDIVVARYNDVGQFLAENGGARCSVYPQGSFLLGTAIHPPQQTEYDIDLVFRDGITKDDTSQADLKERVGGMLEAYNDYKAGTDEAPDEFSEKRRCWTLSYSSSGFHLDVLPAVIDNDFTKSQNGILLTDTKLRPWQHANPKDYATWFRGQSEEMRRKIAASARANNVADVPNWAVRSTLQRLVQVLKWHCYLDFADDIDNRPPSILITTLAAHAYRGQDDLGEAILEVIDGMPNSITKCNGCWLVLNPAQPKENFADKWNEPNTAHRRQAFSGWLRRVQRDIENAAGAANSGLDILVDRLSGSFDRRVLEKSAANWARDTLKLRQQGRLGITSGTGALVIDSPRPTPPHGFYGSGRT

SEQ ID NO: 655 - protein, 356 aa, Mycobacterium fortuitum
MVIARYRDVGEFLAANGDHSCAIYPQGSFLLGTAIQPPRDAEYDIDLVFRESTSKEDTTQAELKERVGDLLQAYYDHKAGSADAPEDFCEKRRCWTLSYSGEGFHLDVLPAVVDNDFQRSKNSILLTDTKLRPWQYANPKDYAIWFRAQSDEMRRKIAASARANNVDDVPNWAVRSTLQRLVQVLKWHCYLDFIDDVDNRPPSILITTLAAHAYRGQDDLGQAILEVLEGMPDYISKIGGRWQVLNPAQSKENFADKWNEPDTAHRRQEFNRWLEKIQNDLHSAYNAQGLGIDVLVNRLGTTLDRGILAKSAANWARTTIDHRAAGRLAVAPGVGALTIGSGRPSPAHQFYGRAPR

SEQ ID NO: 656 - protein, 390 aa, Amycolatopsis lexingtonensis
MPPPVEETISLLFTGAADILDIPPKLHSVAVERYEDVGNFLVLSGGAEWSVYPQGSFRIGTVIKPPTSNTEYDIDLVCHKDVSKDDTTKDELKTEVGELLQAYDGFKTEEGNGDGPALCVAGRRAWTLTYPDLGFHLDVLPAIPDDERPPTSIRLTDTNSHFWQYSNPKGYSDWFQGRSEELHRKLQVKARAAGVAMVPMWTERSTLQRMVQVFKWHCYRYFAKDIGDRPPSVLITTLAAWAYQGEEDLFTAAINAVNDMPAHIENRDGKWWVPNPAHRLENFADKWNEPNERREKFHSWLGSLRQTLTEATRSTRRDTASVIGSLGGAFDEGLLLKSAQRMGLENKNPNVIAAARTASAGLAVTTAASGKSTGRFGEVPAVRTRSGRAG

SEQ ID NO: 657 - protein, 384 aa, Amycolatopsis xylanica
MTDSTEDIVSTLLTGAVEHLDIPESLRDKTVSCYGDVGESLLEQGGDLWSVYPQGSFTLGTVTRPPNEDGEYDIDIVCHKAVKKTSTTQEKLKNEVGDMLEAYEKEKADDDTDESPILSINESRRCWTLSYDNFHLDVVPCVSDEEYPPTSILVTDLKLRPWHHSNPKGYADWFRDRSPEMLRALEAKAEEIGVPIVPNWTVRSTLQRMVQVMKWHCALHFADDLDDRPPSIIITTLAAHAYSGENDLFTATINAVGNMPKHITEESDKLWVRNPAHELENFADKWHEYPERHEKFLSWLDTLATVLDSAGDSAGRGLDYLVNRLGEAFDLGLLRKSARRMGLETKQLRDAGKLGMTRNAGALTVASRSTSPVPFHTFHGQTQR

SEQ ID NO: 658 - protein, 520 aa, Nonlabens dokdonensis
MIKTFYPKTNLNKVLEDITIALDITQRQYADAESRYQAVGKFLGDCPKISRYNPQVYPQGSFRLGTVVRPLLDGEEYDIDLVCLLQSSYNQTTQKHIKNLIGDRLKEPQYINQLDREHRRCWRLNYHTESKFHLDIIPAIPDDDSIKILNESRLPQNYINTAIGITDNTSDYYNSLSNDWTKSNPKGYAEWFKDQMKIQLNESIKNLVGLKGATIDDVPLYKIKTPLQRAVQILKRHRDLHFEHDDLDRPISIIITTLSAQAYNNENNIYDALISILQNMESFIGVDAEGNSVITNPVDVRENFADKWIEFPAREENFFLWLSRARMDFESLADVSNLEKLEMNLNEALGSRVVSRSILKNRSLFNSDSLPTVLRYPNAIDYSPNEQFIEEQYPMHLIYDLKINCKVKQDGFREQSLNNLFILKKNNSLKFFIQKNSTPKPYEVKWKVRNKGVKAKSHGVRGKIVNDNGTESKTEHSSFYGKHFVECYIIKNGMCVARHKIDVPIAGPLKVIASSNSRFF

SEQ ID NO: 659 - protein, 520 aa, Nonlabens dokdonensis; identical to SEQ ID NO: 658

SEQ ID NO: 660 - protein, 382 aa, Anaerolineae bacterium
MISKRHDDLRMLLQALAEFLDISDTQYDAAVSHYKAVGEWLNEENSSIVKHDPNIYSQGSFRLGTMIKPISDGDEYDIDLVCELKNLRKGEVSQKQLKDMIGDRLKENERYRKIIEECNRCWKLKYSDATRFHMDILPAIPADTVDDISPTTDPELSFSAILITDKELREWQRSNPIGFAEWFKERMRAQFEAMRMLVAKSLRATVEQIPDYKVKTPLQRSIQILKRHRDIMFSDDIDDKPISIIITTLAAHAYNNESDLIDALLNIVSGMPLYIEYRDGVTYIPNPTNPLENFADKWNPKKHPRREEKFRQWLEQVQTDLDVALRADDLHDIIKKLKPRFGDNLINKVATTTFPDWRSSAGVSATLAPQISISKPIKPWGK

SEQ ID NO: 661 - protein, 391 aa, Haliscomenobacter hydrossis
MIKVENRVQLNYLLERLAEALDITPTQFAEAKAHYEAVGAYLGADGSALAHLNPAIFPQGSMRLGTVVRPLSDEDQYDVDLVCKVEGTTADFTQYELKQMIGDRLKESDRYRNMLDEEYRFCWTLNYADATRFHMDILPAIADINALQELPQINPHWTVHALHITDQLSETYKKYSNDWPKSNPTGYAEWFMSRMKTQFEARRKAMALEMRASVEEIQDHQVKTPLQRSVQILKRHRDIMFEGKEHRPISIIITTLAARAYAEEADVYTAIGNILDRMPAHIRRINGVAVIENPVNPIENFAADWAKFPQQEENFYKWVVQAKKDFISALSFENITDIRALLHNSFGDKIANRAINLTLEIFPASPSLEDQKNQALLAMATKATVKPWCRS

SEQ ID NO: 662 - protein, 388 aa, Planctomycetes bacterium
MKSQLGQFLMYLAESLDISDTRYVEAEDRYKAVGQWLGKEGSILAQYNPQIYPQGSFRLGTVIRPFDDREEYDIDLVCELQESKEVITQQQLKKMVGDRLKANGDYDRMLDKEEGRRCWTLNYSNGAQFHMDILPAIPEDEGVKQLLFANGVPPVLAEKAISITDIKSNSYNSLDHDWPRSNPKGYADWFHERMKVRFDSLRKSMAESLRAATIEAVPEFRVKTPLQRAIQILKRHRDMMFINDCDDKPVSIIISTLAAHAYKNEADIVDCILSLLDEMPLFIESRGGVSWVPNPVNPMENFADKWHEHPQRELKFRKWLRQVADDLRSALQEGNVGKLQEVFRARFGTRAVNEALAKSEKVMVGAAIADSKTPPRIEIHTPNKPWKA

SEQ ID NO: 663 - protein, 394 aa, Chloroflexi bacterium
MSRILRPEIGYLLNEIAQSLDISNTLFEDAEKKYRAVGSWLGEGDSPLAKFTPEIYPQGSFLLGTVIKPLSDEDEYDIDLVFRLLILKDQISQKELKNLVGDRLKASEVYKHMLDEEGKRCWTIKYAESAQFHMDILPAIPDELYSSILQKEGIPVNFASTSINITDKTLENYGSISNDWPRSNPKGFAAWFQSRMLIQYSELYKRVFGEAFKAEIEKVPNYRIKTPLQRCIQLLKRHRDINFINDQDNKPASILITTLAANAYENEADIVDAMVSIIDRMPSFLVKRNGVAWVPNPIDPTENFADRWVDNPNRERNFGYWLQKVKSDFNRILTCYDSDSASKILTPIFGERVSNSSIAKLEEKSQSQAPFYNSVLQKTPPIVNITNPPKPWRA

SEQ ID NO: 664 - protein, 513 aa, Actinobacteria bacterium
MPSVLKNQLSSLLQYLSESLDVPESRYKEAEERYQGIGRWLCRNESTAATFRPEIYPQGSFRLGTVIKPISENEEYDIDLVCELALSKDQLSQKQLKDLVGHEIKAYALARNMASLPEEGRRCWTLNYADGAQFHMDILPAIPDGEAFRRLLKFSGITGDDYTDKAIAITDNTVPNYGNIDDDWPQSNPKGYAEWFKDRMKTQFDFRRELLAKSIKAKVEDIPDYRVKTPLQRAVQILKRHRDIMFAEDQDNKPISIIITTLAAHAYENEADLLDALGNIVDKMPGFIQWHNGIAWVPNPVNPLENFADMWAEHPEREQNFRRWLQQVHVDINEALQKETIQSAGRSLEKRFGNRPVSEALQNLPHEFDSVHGLMAGSAKSPSRFTVAHRHQPRWPIQLKSFVKIKGHVKQNDTWYEFSSDTTPLPKHCDLWYEAETDVPRPFDVYWQIVNTGTEAERSNGLRGEILPARTAGRGGLTQYESTLYTGMHWIECFIVKNGICVARSGEFVVNIE

SEQ ID NO: 665 - protein, 396 aa, Fibrella aestuarina
MTTLSPSLTDYSSILTRITELLDITPAQYEKAVSHYKAVGKWLDAPGSSLALYKPIIYPQGSFRYGTVIKPLTDEEEFDVDLVCRLLINKRLVNQQTLKAMVGNRLKAHTDYRRMLDKEGRRCWRLNYNEAERFHLDILPSIPDDFGWLIQAGVLPELASHALCITDRETWGVGIEWPRSNPEGYARWFHSRMKYIFAQERIRLANRMEMKVEDVPEYRVKTVLQRIVQLLKRHRDIMFGDDAEKPISIIITTLAAWAYQEEPDLERAMRQVLTAMPGLVRVEQGKYVIPNPVNPLENFADRWADTPRKAEKFFQWIAQAQLDFAKIGQIKGLPNAASSLKAQFGENIVNRALNSIGNDARQLRESGQLTMERSTGIISSAVGGLTVPQHTFHGLH

SEQ ID NO: 666 - protein, 393 aa, Fibrisoma limi
MVTTQLTEASRILEQLAQVLDITPSQYRQAVERYKAVGSYLERVDSPLAPFKPTIFPQGSFRYGTVIKPITDRDEFDVDTVCLLQLTRQQTTQPQLKKMVGDWLKKDANYARMLAEEKRRCWRLDYAEATRFHLDILPSIPDRYQWLIDMEVPLEFARHALCITDKETWSTDIDWPRSNPEGYALWFERQMQIILGQRRQLLAEQLQLEAKDVPLYEVKTPLQRSIQLLKRHRDFTLGDDEDKPISIIITTLAALSYREEPDVYSALQNILQNMTQYVLWKDGQWVICNPVNPLENFADRWKDSPRKATLFFNWVNQARLDIGNIVKRQGLFEVASAMKPIFGETMVNRAVNQFGEQYRQLREEGSLRMQKSTGILTTASGIKVPNHTFHGRS

SEQ ID NO: 667 - protein, 402 aa, Runella limosa
MTPEIDREYSKILDKIAEKLDLTDTQYEIATRSYQAVANWLDAPDSSLRPYRPHISPQGSFRYGTVIRPLLEDEEYDVDLTCKLHICESHITQWGLKKVVGDRLKQHDTYKSMLAPEKRRCWRLQYNDQFRFHLDIVPSIPDIPEYIQQLTLLAVPRSLAVHALCITDNETWHTDIDFPKSNPEGYALWFVQTMKGEFDRRRMLLAKQLRMSVDDVPEYRVKTPLQRVVQLLKRHRDLRYGDNPNAPISIIITTLAAKAYQNETDIFVTLRNVLSRMSSFIEIDSKGNKVVKNPVNPLENFADKWAENPEKERLFYEWLGRAKRDFDQLAQKRGLPELSVPLKEYFGEGVVNKALNEIAEQTLKEREANRLFMAAGTGTLSSQTSPKNVPVTQHNPYGSHKD

SEQ ID NO: 668 - protein, 372 aa, Runella zeae
RSYQAVASCLDAPDSPLRPYRPHISPQGSFRYGTVIRPLLEDEEYDVDLTCKLHISESQISQQWLKQVVGDHLKANETYKRMLAPEKRRCWRLQYNDQFRFHLDIVPSIPDSPQYIQQLTTLLAVPSSLAIHALCITDNETWHTDVDFPKSNPEGYALWFLQTMKVEFDRRRMLMAEQMKMSVDDVPEYRVKTPLQRVVQLLKRHRDLRYGDNPNAPISIIITTLAAKAYQNETDIFVALRNVLSRMASFIEWDDQGNRVVKNPVNPLENFADKWAENPEKKELFFEWLNRAKRDFDQLAQKRGLPELAVPLQQYFGENIVRKALNEVAEQTLKEREANRLFMAAGTGILSSQQTPKSVPVTQHNPYGSDKG

SEQ ID NO: 669 - protein, 416 aa, Pedobacter borealis
MSNQFLTFSERQYAGAVLEKLGQAIDLTDSQYQDAIDRYGSVGRFLGDPTGSLYIYNPRLVPQGSFRIGTVVRPDRDDCEFDVDTTCWLYINLPNSQYRIKKLIADRLNSSATYQRMLKEKHRCWRLIYSEATHFHLDIVPAVPDDYQWLLRLGVPEKYAKHAIKITDNRNSNYYDTTTEFPRSNPEGYALWFLDVMQVQADQIRNKLSIELKMSIDKIPEYKVRTPLQRAVQLMKKHRDQLYGDNDLKPISVIITTLAARSYTDVMMHQSSSNLFYDIVLKIVEQMPNYIEKRNGTSWITNPVNPSENFADKWLGEPRLEAKFYEWHNRFLSLLKGSEISKQFEAAPEILNLSFGINTVRRAFGVNSQDTDRLSRLRTTASVIGSSNAYTNSEGHITSNPNGTKNQEHRFHFNDK

SEQ ID NO: 670 - protein, 414 aa, Aureispira sp.
MIVSQHQKTKEYSQLLEKISDEIDIPLSLYKTAEDRYKSVGEWLGRKDSALSKYSPHIYPQGSFLIGTVTKPIFEEDGCDIDLVCCLECSKDDTTWARLKEMVGDELETNGKYKNMLDEEKRRCWTLLYSGKEPIPFHLDILPAIPNEVFIQEDNPFRKNAILITDNVHKRFMTSNPKGYAEWFKIQMQLQKSFDYNNHVKLMAKSMGCQIEEVPTYALKTPLQRVIQILKRHRDIEYKDKSEEEREAKPISIIITTLAAKAYASIQSFVNDDLYTIAKAIIDEMPNHIENKKNSQGEYIRWIENPTDRTENFADKWESDIRREYAFREWLDSVKNTLEKAFNKQGVHLIGETLKLSFGERTINKALEEFHNERVGNHRKDGLLGVSGKNASLTKIDGIKKVSKVPKNTFYGEE

SEQ ID NO: 671 - protein, 413 aa, Algibacter alginicilyticus
MMNELYKNEINEILEILGENLDISESQYKAAVKSYEAVGDWLSKESSTLYPYSPRIIPQGSFMLGTITRPINDEDDIDIDLVCKLNGKPSHWTQKHLKDAVGDRLKEYSVYKEMLESLDGGRRCWTLEYSDEANYHLDILPSISDKNFTVLLNESFNNYQNLDADKLAIRITDKEDLFYSVMTHTEWWRKCNPFGYAKWFFQRAIYSSTKMFALNESVDPVRPFQKEKMPLQRVVQLLKRHRDIMFSSDEYDSENKPISIIITTLASKAYDKSENIVDAYVNIVSKMRSYIETRLNAKTGQYERWVSNPINNEENFADKWSEVAQKEEYFYAWLDKLEEDLATIQYGQNKGLFSLNESLSAQYGNRVVNKVFAEYGEKNKILRENGLRKMAVGTGMLGSIGKSIPNHNFEGNI

SEQ ID NO: 672 - protein, 412 aa, Algibacter alginicilyticus
MNELYKNEINEILEILGENLDISESQYKAAVKSYEAVGDWLSKESSTLYPYSPRIIPQGSFMLGTITRPINDEDDIDIDLVCKLNGKPSHWTQKHLKDAVGDRLKEYSVYKEMLESLDGGRRCWTLEYSDEANYHLDILPSISDKNFTVLLNESFNNYQNLDADKLAIRITDKEDLFYSVMTHTEWWRKCNPFGYAKWFFQRAIYSSTKMFALNESVDPVRPFQKEKMPLQRVVQLLKRHRDIMFSSDEYDSENKPISIIITTLASKAYDKSENIVDAYVNIVSKMRSYIETRLNAKTGQYERWVSNPINNEENFADKWSEVAQKEEYFYAWLDKLEEDLATIQYGQNKGLFSLNESLSAQYGNRVVNKVFAEYGEKNKILRENGLRKMAVGTGMLGSIGKSIPNHNFEGNI

SEQ ID NO: 673 - protein, 412 aa, Cellulophaga baltica
MNESYKNEINEILEILGENLDISESQYKAAVKSYEAVGNWLSKEGSILYPYSPRIIPQGSFMLGTITRPINDEDDIDIDLVCKLNGKPSHWTQKHLKVAVGDRLKEHSVYKEMLESLDGGRRCWTLEYSDEANYHLDVLPSISDKNFTVLLSESFNNYQNLDTDKLAIRITDKEDLFYSLMTDTEWWRKCNPFGYAKWFFQKAIYSSKRMFALSESVDPVRPFQKEKMPLQRVVQLLKRHRDIMFSSDEFDSENKPISIIITTLASRAYDKSENIVDAYVNIVSKMRSYIETKYNAKTGKYERWVSNPINNEENFADKWTDVVQKEEYFYAWLDKLEEDLATIQYGQNKGLFSLNESLSAQYGNRVVNKAFAEYGEKNKILRENGLRKMAVGTGMLGSIGKSIPNHNFEGNK

SEQ ID NO: 674 - protein, 412 aa, Unknown
  Description of Unknown: Flavobacteriaceae sequence
MTESYKKEINEILEILGENLDITENQYNAAVESYEAVGDWLSKEGSFLFPYSPRIIPQGSFMLGTIIKPICEDDDIDIDLVCKLNGKPAHWTQKHLKEAVGDRLKEHSVYKNMLESQDGGQRCWTLEYSDQANYHMDILPSIADKNFTVLLNEAFNNHQQLDTNKLAIRITDKENIFYSIMTETEWWLKSNPFGYAKWFFQRAIYSSKRMFALSESVDPVRPFQKEKMPLQRVVQLLKRHRDIMFSSDEYDSENKPISIIITTLASRAYDKGENIADAYINIVSRLRSYIETKLNPKTGQQERWVSNPVNEAENFADKWALVAQKEEYFYAWLDKLEEDLSAIKYGENKGLHILNESFSAQYGNQVVKRTFAEYGEKNRILREKGNRKMAIGTGLLGSVGKPIPNHNFEGNI

SEQ ID NO: 675 - protein, 404 aa, Salegentibacter mishustinae
MNEILEILGENLDITENQYNAAVESYEAVGDWLSKEGSFLFPYSPRIIPQGSFMLGTIIKPICEDDDIDIDLVCKLNGKPAHWTQKHLKEAVGDRLKEHSVYKNMLESQDGGQRCWTLEYSDQANYHMDILPSIADKNFTVLLNEAFNNHQQLDTNKLAIRITDKENIFYSIMTETEWWLKSNPFGYAKWFFQRAIYSSKRMFALSESVDPVRPFQKEKMPLQRVVQLLKRHRDIMFSSDEYDSENKPISIIITTLASRAYDKGENIADAYINIVSRLRSYIETKLNPKTGQQERWVSNPVNEAENFADKWALVAQKEEYFYAWLDKLEEDLSAIKYGENKGLHILNESFSAQYGNQVVKRTFAEYGEKNRILREKGNRKMAIGTGLLGSVGKPIPNHNFEGNI

SEQ ID NO: 676 - protein, 412 aa, Nonlabens sp.
MTEEYKNEVIEILENLGKQLDISESQYNEAVKSYEAVGEWLSKEGSPLYPFNPRILPQGSFMLGTIIKPINDEDDIDMDLVCKLSGKPSNWTQKHLKDAVGDRLKGHSTYEQMIEDKDGGRRCWTLEYSDDANYHMDILPSISDKNFTVLLSESFNNSQHLDTNTLAIRITDKEEYNYSTEINTEWWMKSNPFGYAKWFYQRAIYSSTKMFALSESVDPVRPYQKEKLPLQRAIQLLKRHRDMMFSSDEYNSENRPISIIITTLAARAYDRSENIVDAYVNIVSRMRDLIETKLNPKTGLYERWVSNPVNNEENFADKWSEVPQKEEYFYKWLDKLEEDLETVKYSQGVGLQKLNESFSAQYGDNVVNKAFAAYGEKNRILRESGLRKMASGTGILGSVGTSVPNHNFEGNV

SEQ ID NO: 677 - protein, 415 aa, Aquimarina agarivorans
MNNNYKNELSEILNELGDHLDISKAEYDAAVKSYEAVGDWLSKPTSPLHQFNPKILPQGSFMLGTMIKPINQEDDLDVDLVCKLENKPYDWTQKDLKNAIGNRLKNHDTYNSMIEDIDGGQRCWTLKYSDNSNYHMDILPAFADENFTVFLNESFNNYQDTDTKKIAIRITDKELDNYDTEIDTDYWMKSNPFGYAKWFIQKATISSTKMMTLNEAVDPLREFEKEKPPLKRVIQLLKRHRDIMFSDSAYDIENKPISIIITTLASRAYDKSENLIDAYINIVSNMKSFIEDRVNIKTGKTEKWVVNPINNEENFADKWTITPQKETYFYEWLDELEKDLEKIRNSHNVGLHNLNESFTKMYGKNISNNAFKSYGNKKRIIRENGKLSMSKATGLLGTSGIKIKNHEFRGSVNEK

SEQ ID NO: 678 - protein, 424 aa, Chryseobacterium daeguense
MEQLYKTEISEYLEELGKELDITQKEHEGIVESYQAVGNWLSKDDSSLTPYNPKILPQGSFMLGTIVKPINPADDIDIDLVCKLEKKPIAWTQRDLKIKVGERLKSNSTYDRMLWEHKDGENYDEGGRRCWTLKYADVSGYHMDILPSFSSESLTYLMEKTFSINSELSEHDLQALAIRITDTEKENYSTDNNIENWHKSNPFGYAQWFLQKALISKRKMFSLNESIDPVREYEKEKLPLQRVVQLLKRHRDIMFSSDEYECENRPISVIITTLATLAYDKSENLIDAYSGIVTRMRNFIENRFNPVTGQYEKWVANPINRVENFADKWTDVRQKEEYFYLWLDKLEEDLEKINNSKGKGLQYLNESLSKMYGKEVTNKVFVNNGRKKVDLRQQGQLKMAGVTGMLGEVGRKVQKHNFEGDFGE

SEQ ID NO: 679 - protein, 406 aa, Odoribacter splanchnicus
MTNEQSKQFSEILIELATLLDVTETEFQTISRSYEDVGRFLAEENSPLQAYNPSIHPQGSFLLGTVVRPICEDDDLDIDLVCELENKPDEWVQYDLKNAVGNRLKSSPKYKDRLDKEGKRCWTLLYGDNKYHLDVLPSLVCNDYHNRVTKYFTEGTGANPEELAIHITDYTRADYYTEKNEDYWMVSNPFGYAQWFLSSAQKAYRQQRMFAAEATIDPVPKFKKDKYVLQRVVQLLKRHRDKMFDGDDDKPISIIITTLATRVYNDELDLFKAFKHIANNLTKYIEDRNGMKYIANPVNRSENFADRWPAKPRKQKKFYEWVNQLQIDINRLESTAGQGLPAIRKVLDDMFGESISKKTYDNYGKLLLERRKSGNLKAGISTATLGLSGVVKVAAHNFYGTDEEKS

SEQ ID NO: 680 - protein, 409 aa, Odoribacter splanchnicus
MNKMTNEQSKQFSEILIELATLLDVTETEFQTISRSYEDVGRFLAEENSPLQAYNPSIHPQGSFLLGTVVRPICEDDDLDIDLVCELENKPDEWVQYDLKNAVGNRLKSSPKYKDRLDKEGKRCWTLLYGDNKYHLDVLPSLVCNDYHNRVTKYFTEGTGANPEELAIHITDYTRADYYTEKNEDYWMVSNPFGYAQWFLSSAQKAYRQQRMFAAEATIDPVPKFKKDKYVLQRVVQLLKRHRDKMFDGDDDKPISIIITTLATRVYNDELDLFKAFKHIANNLTKYIEDRNGMKYIANPVNRSENFADRWPAKPRKQKKFYEWVNQLQIDINRLESTAGQGLPAIRKVLDDMFGESISKKTYDNYGKLLLERRKSGNLKAGISTATLGLSGVVKVAAHNFYGTDEEKS

SEQ ID NO: 681 - protein, 409 aa, Alistipes finegoldii
MNTEQVKQFDSIFNALSESLDITETQYEAAVRSYRAVGDWLAKADSVLVSYNPIIRAQGSFMLGTMIRPLNEQDDLDIDLVCELTGKGASWTQYDLKHKVGNRLKDHETYKRMLDEEGRRCWTLKYAQESNYHMDILPCLVAKDYKTVMERSFSASLGAIRELDNLAIRITDKESANYRYDPSPENWMKSNPFGYGIWFIQRATAGDRQKMMLLAESVRAVPKYQSNKTPLQRAVQILKRHRDIMFAGDEDKPVSIIITTLAAKAYQGEGSITEALQTILIHMDKYILNEFDPQSGKTIKKVENPVNPEENFADKWIEHPKRQDNFYKWLEKVRKDLSLILQLRGMHVIAESMMPRFGRQAVSQGFDSLAEKARSLRESGTMKMAAGSGILGSAGSVSAKAHHFFGNHE

SEQ ID NO: 682 - protein, 412 aa, Alistipes onderdonkii
MINMNTEQVKQFDSIFNALSESLDITETQYEAAVRSYRAVGDWLAKADSVLVSYNPIIRAQGSFMLGTMIRPLNEQDDLDIDLVCELTGKGASWTQYDLKHKVGNRLKDHETYKRMLDEEGRRCWTLKYAQESNYHMDILPCLVAKDYKTVMERSFSASLGAIRELDNLAIRITDKESANYRYDPSPENWMKSNPFGYGIWFIQRATAGDRQKMMLLAESVRAVPKYQSNKTPLQRAVQILKRHRDIMFAGDEDKPVSIIITTLAAKAYQGEGAITEALQTILIHMDKYILNEFDPQSGKTIKKVENPVNPEENFADKWIEHPKRQDNFYKWLEKVRKDLSLILQLRGMHVIAESMMPRFGRQAVSQGFDSLAEKARSLRESGTMKMAAGSGILGSAGSVSAKAHHFFGNHE

SEQ ID NO: 683 - protein, 412 aa, Alistipes finegoldii
MINMNTEQVKQFDSIFNALSESLDITETQYEAAVRSYRAVGDWLAKADSVLVSYNPIIRAQGSFMLGTMIRPLNEQDDLDIDLVCELTGKGASWTQYDLKHKVGNRLKDHETYKRMLDEEGRRCWTLKYAQESNYHMDILPCLVAKDYKTVMERSFSASLGAIRELDNLAIRITDKESANYRYDPSPENWMKSNPFGYGIWFIQRATAGDRQKMMLLAESVRAVPKYQSNKTPLQRAVQILKRHRDIMFAGDEDKPVSIIITTLAAKAYQGEGSITEALQTILIHMDKYILNEFDPQSGKTIKKVENPVNPEENFADKWIEHPKRQDNFYKWLEKVRKDLSLILQLRGMHVIAESMMPRFGRQAVSQGFDSLAEKARSLRESGTMKMAAGSGILGSAGSVSAKAHHFFGNHE

SEQ ID NO: 684 - protein, 408 aa, Bacteroides fragilis
MLTQEEKKQFSEILETLGETLDITETQYNTAVSSYGAVGEWLAKPESSLAPYKPVIRPQGSFLLGTMIKPICEDDDLDIDLVCELTGKNPQWTQYHLKQVVGNRLKANETYKNMLDREGRRCWTLMYSDSANYHMDILPSLVCSGYNIVLEKAFSDTELEKDYESLAIRITDNEQNNYYTDTIAENWMKSNPFGYGRWFFNAANVVSLHKSIMLAEAVNPVPKYNKEKLPLQRVIQILKRHRDIMFNGDEDKPISIIITTLASRAYNKEMSIIDALTNVIINMRNYIESRYDSNIGRTVKWIPNPVNPEENFADKWVEHPQREKNFYKWLNQVEQDIQTIIQQRGLHNISESMEKPFGEKIVTKIFSTLGRKNFNLRENGVLKMATGTGILSTVGSVTAVAHNFHGND

SEQ ID NO: 685 - protein, 408 aa, Bacteroides dorei
MLTQEEKKQFSEILETLGETLDITETQYNTAVSSYGAVGEWLAKPESSLAPYKPVVRPQGSFMLGTMIKPICEDDDLDIDLVCELTGKNPQWTQYHLKQVVGNRLKANETYKNMLDREGRRCWTLMYSDSANYHMDILPSLVCSGYNIVLEKAFSDTALEKDYESLAIRITDNKQNNYYTDTIAENWMKSNPFGYGRWFFNAANVVSLRKSIMLAEAVSPVPKYNKEKLPLQRVVQILKRHRDMMFDGDEDKPISIIITTLASRAYNKETSIIDALTNVSTNMRNYIESRYDSSIGRTIKWIPNPVNPEENFADKWVEHPQREKNFYKWLNQVEQDIQTIVQQRGLHNISESMGKPFGEKIVTKVFSALGRKNFNLRENGVLKMAIGTGILSTVGSVTAAAHNFHGND

SEQ ID NO: 686 - protein, 408 aa, Bacteroides xylanisolvens
MLTQEEKKQFSEILETLGETLDITETQYNTAVSSYGAVGEWLAKPESSLAPYKPVVRPQGSFMLGTMIKPICEDDDLDIDLVCELTGKNPQWTQYHLKQVVGNRLKANETYKNMLDREGRRCWTLMYSDSANYHMDILPSLVCSGYNIVLEKAFSDTALGKDYESLAIRITDNKQNNYYTDTIAENWMKSNPFGYGRWFFNAANVASLRKSIMLAEAVSPVPKYNKEKLPLQRVVQILKRHRDMMFDGDEDKPISIIITTLASRAYNKETSIIDALTNVGTNMRNYIESRYDSSIGRTIKWIPNPVNPEENFADKWVEHPQREKNFYKWLNQVEQDIQTIVQQRGLHNISESMGKPFGEKIVTKVFSALGRKNFNLRENGVLKMAIGTGILSTVGSVTAAAHNFHGND

SEQ ID NO: 687 - protein, 408 aa, Bacteroides clarus
MLTQEEKKQFGEILETLGETLDITETQYNTAVSSYGAVGEWLAKPESSLAPYKPVVRPQGSFMLGTMIKPICEDDDLDIDLVCELTGKNPRWTQYHLKQVVGNRLKANETYKNMLDGEGRRCWTLMYSDSANYHMDILPSLVCSGYNIVLEKAFSDTVLEKDYESLAIRITDNKQNNYYTDTIAENWMKSNPFGYGRWFFNAANVFSLRKSIMLAEAVSPVPKYNKEKLPLQRVVQILKRHRDIMFNGDEDKPISIIITTLASRAYNKETSIIDALTNVITNMRNYIENRYDSSVGRTIKWIPNPVNPEENFADKWVEHPQREKNFYKWLDQVEQDIQAIVQQRGLHNISESMGKPFGEKIVTKVFSELGRKNFNLRENGVLKMATGTGILSTVGSVTAAAHNFHGND

SEQ ID NO: 688 - protein, 408 aa, Bacteroides nordii
MLTQEEKKQFSEILETLGQTLDITETQYNAAVSSYGAVGEWLAKPESSLAPYKPVVRPQGSFMLGTMIKPICEEDDLDIDLVCELTGKNPQWTQYHLKQVVGNRLKDNETYKNMLDEEGRRCWTLMYSDSANYHMDILPSLVCNGYNIVLEKAFSNTTLDKDYESLAIRITDNKQNNYYTDTIAENWMKSNPFGYGRWFFNAADVLSLRKSIMLSEAVNPVPKYNKEKLPLQRVVQILKRHRDMMFNGDEDKPISIIITTLASRGYNKETSIIDALTNVVSNMRNYIESRYDSNAGRMVKWIPNPVNPEENFADKWVEHPQREKNFYKWLDQVEYDVQTIVHKRGLQYIAEAMKKPFGEQTVTKTFSTLGERNLNLRESGALKMAIGTGILSSVGSVTAATHNFHGND

SEQ ID NO: 689 - protein, 408 aa, Parabacteroides sp.
MLTQEEKKQFSEILETLGETLDITESQYNAAVSSYGAVGEWLAKPESSLAPYKPIIRPQGSFMLGTMIKPVCEEDDLDIDLVCELTGKNPQWAQYHLKQAIGDRIKANETYKNMLDEEGRRCWTLAYSDNANYHMDILPSLVSIGYDTVLEKAFSASALDEKYDSLAIRITDNEQSNYYTDTIAENWMKSNPFGYGRWFFNVADVTTLRKSMMLSEAVNPVPKYNKEKLPLQRVVQILKRHRDMMFNGDEDKPISIIITTLASKAYNKETSVIDALTSVIANMHSYIESRFDPKVGKVIKWIPNPVNPEENFADKWVEHPQREKNFYKWLDQVESDIQTILQKRGLQYIAEAMKKPFGEQAVTKTFSTLGENKLNLRESGSLKMAAGTGILSSIGSVAAASHNFHGND

SEQ ID NO: 690 - protein, 408 aa, Parabacteroides chartae
MLTQEEKKQFSEILETLGETLDITESQYKAAVSSYGAVGEWLAKPESSLAPYKPIIRPQGSFMLGTMIKPVCEDDDLDIDLVCELTGKNSQWAQYHLKQAVGNRLKANETYKNMLDKEGRRCWTLMYSDSANYHMDILPSLVCSGYDTVLEKAFSASALAENYESLAIRITDNKQSNYYIDTVAENWMKSNPFGYGRWFFNAADVSTLRKSIMLSEAVNPVPKYSKDKLPLQRVVQILKRHRDMMFNGDEHKPISIIITTLASRAYGKETSIIDALTNVVANMRTHIESRYDPNLGRMVKWIPNPVNPEENFADKWVEHPQREKNFYKWLDQVESDIQAIVQKRGLQYIAEAMKKPFGEQAVTKTFSTLGEKNLNLRESGALKMATGTGILSTAGTVTAAAHNFHGND

SEQ ID NO: 691 - protein, 411 aa, Bacteroidetes bacterium
MERKLTKEQREQFSDILEELGKTLDITEAQFDAAVRSYQAVGAWLSKEDSLLSPYQPLIRPQGSFLLGTMIRPINENDDLDIDLVCQLTGKDSTWTQKELKQIVGNRIKEHEQYKKMLLSPDGRRCWTLMYAEDSNYHLDILPALISQGYYTLEKSFSAVDSSDYDSLAIRITDKLRLDYDTSINPNEWLLCNPFGFGRWFFQRASLDLMKSFSLTEAVKPVPKYQLNKLPLQRAVQILKRHRDMMFNGDQHKPISIIITTLAARIYSKETDVISALVNVVGELDTTIEERYDERLGRYVKWIPNPVNPLENFADKWAEYPEKERNFYMWVKQLRHDIYNILGQIDNGVHYIREAMQTPFGRSEVIKAFSNYAEHTRELRESGKQFITPKTGIVNSAGTLIKNHNFYGAGE

SEQ ID NO: 692 - protein, 219 aa, Mucilaginibacter sp.
MLSNLQKEQFNEILEELGNNLDITQTQYNAAVKSYQAVGLHLAKHDSIIGKYDPEILPQGSFMLGTMIQPIHEDDDLDIDLVCQLVGKEEKWTQYDLKQKVGEQLRAHATYATMIKDPEGRRCWTLEYSEQANYHMDILPCIVDSGFRILLEKAFSASESSEINELALRITDRETDDYKIETNHLNWLKTNPFGYGRWFFNRASLSFTKSFNESIQPVP

SEQ ID NO: 693 - protein, 414 aa, Emticicia sp.
MLTIEQKKQFDEIFEELVNNLDITESQYKAAVSSYNAVGNWLSSKDCILSKYNPEILPQGSFLIGTMIKPMNDEDDLDIDLVCELTGKNIDWTQEDLKTIVGNRIKENETYKEMLADEGRRCWTLEYRNDSEQVKERYHMDILPAIINEGYNVILEKAFSETNEMDLESLSIRITDNETDNYKSETDISEWMKSNPFGYGKWFINRATLSLRKAFSLNESIKPVPTYQKEKLPLQRVVQILKRHRDKMFLGDEDKPISIIITTLAGKAYNKETDLFSALSNVISNMESHIDEKYDFELQKRIKFISNPINEEENFADKWVDYPKREENFFKWLRKLQSDFKNILNQTNGLQFINESMKEPFGESLITKTFSNYGERLKGEREKGNLKVASLTGTIGTIGATIKNHNFYGFEEEK

SEQ ID NO: 694 - protein, 414 aa, Lutibacter oricola
MLTIEQKKQFNDIFEELSNNLDISETQHNNAVKSYQAVGNWLSQEGTVLAKYKPQILTQGSFLLGTVIQPINDTDDIDIDLVCELTGKNADWSQKDLKRIVGARLKQNDVYKEMLDKEGRRCWTLEYRKESDNLKEKYHMDILPSIISEGYSMILEKAFSHTDISNVDNLAIRITDNESDNYDFDSNTENWLKSNPFGYGKWFFNRAEISIKKMFSLNESIKPAPEYQQNKLPLQRAVQILKRHRDIMFNGDEDKPISIIITTLSGKSYNQEENLIDAIKNIINKMHLHIEERYNNDLNKTIKYIPNPVNEEENFADKWIQYPQREKNFYLWLDKVKADFSNILSKSQGLQFINESMQNPFGEKLTTKTFSSYGERQRINRENGNLKVSSITGTIGAVGTKIKNHNFYGAEEKE

SEQ ID NO: 695 - protein, 410 aa, Flavobacterium haoranii
MLTTQQKQQFSEILNELGKSLDISETEFNAAVASYNAVGNWLSSENSALAPYKPEILPQGSFLLGTAIKPISEKDDIDIDIVCKLTGKNPIWTQAHLKKIVGDRLKENETYKQMLDKEGRRCWTLEYRKYSQKNDQYHMDVLPAIIASGYSILLEKAFTNMHDSNVDALAIRITDNLEPNYPSETNQENWLKSNPFGYAKWFINQATISAEKMFSLNEAVKPVPKYQSNKLPLQRVVQILKRHRDIMFDGDDEKPISIIITTLAARAYKKQTDILEALLDVIENMHDFILDKQDEKTGEWYKFIENPVNKVENFADKWRENPRKQKKFYDWLTAVKKDIQETTQLTGSHNIMTRLSESFGEKEVKKAFNNIGDRARLLTENGNNRFDTKLGVMTGAANVIKPHNFYGEEE

SEQ ID NO: 696 - protein, 410 aa, Flavobacterium xinjiangense
MLTIQQKTEFSEILDELGETLDITESQFNAAVTSYNAVGNWLCNDDSKLKPYSPSVKPQGSFLIGTTIQPYTDGQDIDIDLVCELTGKNPRWTQKDLKDIVKEQLESHKKYESILDEEGRRCWTLKYRENSINNDQYHMDILPAVIANGYNVVLTKFFSESRNINFDSLAIRITDKELLNYEVATDPDHWLQSNPFGYAKWFIDRAETSRLKLFSLNESIQPVPKFQKGRLPLQRVVQILKRHRDMMFKDDKEKPISVIITTLAAYAYEGQTNVLDALVGVIDRMHLFVEDEIDQDTREAYRFVGNPVNLSENFADRWRDTPAKERKFNDWLKKVKFDINNAAQQNGQHNIIRTLSESFGDNAVKKTFSNIGNRKQLLTEQGNNRFDAAVGLSTAGASAIKPHKFYGSKD

SEQ ID NO: 697 - protein, 415 aa, Unknown
  Description of Unknown: marine bacterium sequence
MLTLEQKKQFNDILEELGGALDISQTEYDAAVKSYNAVGQQLAKENSILRQYDPEILPQGSFMIGTMIKPVNPNDDLDIDLVCQLNGKNLNWTQKELKNKVGFQIADNDIFKPLLENPDGRRCWTMRYRENSKNSERKYHMDILPCVTGANYKEIFEKAFSNNDLEDLDSLAIRITDKESQYYDSSYQYLWLKSNPFGYAKWFFNRASVSDIISKSILEASIQAVPKMQKNKLPLQTVVQILKRHRDLMFSDESHSDDKPISIIITTLAAKAYNKESNVISALSNIVASMGNFIIDKYDENVNRVIKWVGNPINNEENFADKWVEYPKRQDNFFKWLEQVKKDLDVAFKQRGGLHLVQESLEKPFGKAVVQKAFKNYGQKLLLDRENGDLGIHKHTGEISKSGKLIIQPHKFFGL

SEQ ID NO: 698 - protein, 412 aa, Fluviicola taffensis
MLTLEQKNQFSDIFNDLTDNLDITQTQYDNAVTSYKAIGDQLSKEGSLLKPYKPKIRPQGSFMLGTMIKPIHGDDDLDIDLICELSGKQSGWTQSDVKSIVGAQLAANETYKEMLKIPEGKRCWTLEYRKNSKIDSEQYHMDILPSIVNEGFYIMLSESKNFSSTEDWKSYALRITDNTLANYNSETNHIQWLKSNPIGYGKWFFMRATLTKEIKMFNESIDPVPNNKRTKLPLQRVVQILKRHRDMMFEGDEAKPISIIITTLAAKAYNHQSDVFEALSEIVSRMDYFIEERENFYGKKIKWISNPVNPDENFADRWETHPEREVNFYKWIVQVKLDIQTIINSRNLGLQWISESMSKPFGNDIVRKVFSDYGQREKLIREAGKQTVAKSGFLGAAGGIKVQNHKFDGSNE

SEQ ID NO: 699 - protein, 417 aa, Cytophagales bacterium
MLSKEEQEQFSKIFEELGKTLDISETQFNAAVASYQAVGNQLTKEGSALAIYQPEILPQGSFMLGTMIKPISEEDDIDIDLVCNLHGKNPFWTQQKLKEEVGKQLAENMVYKDMMEDKRRCWTLTYRKDSPNLKERYHMDILPSIVNSNYKITLERELKMALDMSTTKQLEICITDNQTNNYRTETDHQKWLLTNPFGYGKWFFDRAINNSDLYKELSRAIRPVPEYSNKKLVLQRVVQILKRHRDIIWYNRTDKDDKPISIIITTLAAKAYKKEQNLMETLLNVVERMGNEIEEKYSIQHGDYIKWIANPVNDKENFADKWPDNPRKEDNFYDWLKAVKLDLNKIIAKKGLGLPDIGEAMSQPFGKDLVKNAFTSYGELSLLSRTDGNMKMAASTGILSSVGRTIVPAHQPFGANE

SEQ ID NO: 700 - protein, 407 aa, Tannerella sp.
MRELTTEEHKQFNEIFENLGASLDVPESRYDELVSSYQAVGNFLGDESSPLAPYKPEIQPQGSFLLGTMIIPVNENDDLDIDLVCELMEKHPDWTAENLKAKVGERLKVSERYKKLLDEEGRRCWTLLYRKNSENASDKYHLDILPCVNNEKTRLREQYFSVSVEQVDKLALRITDRELSNYKYETDSSKWLKSNPFGYAKWFEDRCSVLTRRTVLFSEAKVGNVPAYKEKKSPLQRVVQILKRHRDLMFNGDESKPISIIITTLAARAYNKETDVLDALVNVVNSMERYIEREPNTGLCIVRNPVNPDENFADKWVETPQKQLNFFAWLKQVKQDVEQIIEKRGGLQLIAESMNKPFGRDVVQRTFCAIADNQRKNRDNNTLRATITGTLGTVGTVVKAHTFHGDE

SEQ ID NO: 701 - protein, 407 aa, Bacteroides vulgatus
MRELTTEEHKQFNEIFENLGASLDVPESRYDELVSSYQAVGKFLGDESSPLAPYKPEIQPQGSFLLGTMITPVNENDDLDIDLVCELMEKHPDWTAENLKAKVGERLKVSERYKKLLDEEGRRCWTLLYRKNSENASDKYHLDILPCVNNEKTRLREQYFSVSVGQVDKLALRITDRELSNYKYETDSSKWLKSNPFGYAKWFEDRCSVLTRRTVLFSEAKVGNVPAYKEKKSPLQRVVQILKRHRDLMFNGDENKPISIIITTLAARAYNKETDVLDALVNVVNSMERYIEREPNTGLCIVRNPVNPDENFADKWVETPQKQLNFFAWLKQVKQDVEQIIEKRGGLQLIAESMNKPFGRDVVQRTFSAIADNQRKNRDNNVLRATITGALGTIGTVVKAHTFHGDE

SEQ ID NO: 702 - protein, 415 aa, Flavobacterium sp.
MTEQQKLDFSEILETLGENLDITETQYNAAISSYQNVGNWLSKEDSELKTYNPLIRPQGSFILGTIIQPICEDDDLDIDLVCELSKKKHSWTQFNLKEIVGNQLKAHKGLDDLLDEEGRRCWTLKYRKDSENIKERYHMDILPAIISEGYETILNESYKRMFDESDIGKLCLSITDKENQNYYTSTDPKEWLKSNPLGYAKWFFSRATIQTNKMFSLNEAVRPVPRFQKNRFPLQRVVQILKRHRDIMYRDRKDKLDKPISVIITTLASKAYNKETNIIEALVNVINNMESFIKDYNPITGKKEKYIENPVNKEENFADKWNEFPKREENFYEWLKKVKEDVDNITSQSGYGLQRINESMQMPFGGELVKKTFNNYGLKIRNLSETNSLKVDVASGAIGSVGINMKKNNFEGINE

SEQ ID NO: 703 - protein, 416 aa, Unknown
  Description of Unknown: Flavobacterium sequence
MLTEQQKNDFSEILETLGENLDITETQYNAAISSYQNVGNWLSKEDSELKAYNPLIRPQGSFILGTIIQPICEDDDLDIDLVCELSKKKDSWTQFNLKEIVGNQLKSHKGLDDLLDEEGRRCWTLKYRKDSENIKERYHMDILPAIISEGYETILNESYKRMFDESDVSKLCLSITDKESKNYYTSTIPKEWLKSNPLGYAKWFFSRATIQTNKMFSINEAVRPVPSFQKNRFPLQRVVQILKRHRDIMYRDRKDKIDKPISVIITTLVSKAYNKETNIIEALINVINNMEYFIKDYNPITEKREKYIENPVNKEENFADKWNEFPKREENFYEWLKKVKDDVENMTSQSGYGLQRINESMQVPFGDELIKKTFNTYGLKIRNLSETNSLKVNVVSGAIGSVGINMKKNNFEGVNE

SEQ ID NO: 704 - protein, 425 aa, Sphingobacterium paucimobilis
MTDLKKEQFADILETLSENLSITETQHNAAVRSYNAVGNWLSKDDSLLKPFNPEIKPQGSFIIGTTVQPVNPEDDLDLDIVCELHGKKLHWTQEDVKNVVGEQLRSHMTYESLLDKEGRRCWTLKYRSDSDRNDKYHMDILPSVISQGYQILLEKSFSNLQKDDYESLKLSITDKESSNYSSETDPSRWYQSNPFGYAKWFMSRVQMYKGAVLKAFSLNEAVKPTPRYQENRLPLQRAVQLLKRHRDIMFTAESNEDIRKQKPISCIITTLAARAYQGEVNLSDAIFGVISRMESEIEWKEDHYGNRYEWISNPVNKAENFADRWNDSGSVRRDNFYRWLRQIREDLDIARSQNGMHNIAESLKKSFGNKVVVDTFTQIGDRSRTSTADQSNYYSKKEGIIGTASAASALISKVPAHTFHGKSTD

SEQ ID NO: 705 - protein, 425 aa, Sphingobacterium paucimobilis; identical to SEQ ID NO: 704

SEQ ID NO: 706 - protein, 425 aa, Chryseobacterium vrystaatense
MLVEIQKTQFEDLLNKLSTNLSITRTQHEAAVQSYKAVGKYLSSESSPLADYEPYVKPQGSFIIGTTIQSIEEDGDIDLDVVCEFKRKKINWTQYHLKKAVGDHLKAHGTYANLLDKEGRRCWTLKYREEGLANQRYHMDILPAVVANGYSLLLESAFNNLTNENYQELQISITDKEKSNYFVSTFPEEWLQSNPYGYAKWFMKRALLVGNQFKNLYSLNESVKPTPDYQEERLPLQRVVQLLKRHRDVYFSKEQNDDIRKQKPISCIITTLAARAYRGESNLLDAMWGIINGMSDEIEFKYIPEYGKEVEWISNPVNIAENFADRWNDDNSYRRDNFYRWLEQLKIDLRDAENKTGLQNISESLSSSFGKRPVQDAFNQLGNEMRILTEENKNTISRSLGIIGMATKEVNDITKVKPHDFYGLD

SEQ ID NO: 707 - protein, 425 aa, Elizabethkingia anophelis
MLINSQNKQFEDLLMKLSTNLSITRSQHEAAVQSYKAVGKYLSSEYSPLSAYEPYIKPQGSFIIGTTIQSIEEDGDIDLDVVCEFKRKKITWTQYHLKKAVGDHLKAHGTYERLLDEEGRRCWTLKYREEGVVNQRYHMDILPAIVANGYSVLLESSFRNLMDEDYEKLQLSITDKEKSNYYVSTFPEEWLQSNPYGYAKWFMKRALLVGNQFKNLYSLNESVKPTPDYQEERLPLQRVVQLLKRHRDIYFSKEQNDDIRKQKPISCIITTLAARAYRGESNLIDAIWGVINRMSEEIEFKYIPEYGREVEWISNPVNVLENFADRWNDQDSYRRDNFYRWLDQLKIDLNDAESKTGLQNIFESLSSSFGRKPVQDAFSQQGNEMRMLTEDNKNNISRSLGIIGTATAGLNDVTKVKPHDFYGMD

SEQ ID NO: 708 - protein, 428 aa, Unknown
  Description of Unknown: Chryseobacterium sequence
MLIDSKKNQFEDLLKKLSTNLSITRSQHEAAVQSYKAVGKYLSSESSPLSEYEPYIKPQGSFIIGTTIQSIEEDGDIDLDVVCEFKRKKITWTQYHLKNAVGDHLKAHGTYERLLDEEGRRCWTLSYREEGVTNQRYHMDILPAIVANGYSLLLESSFKNLMDEDYEKLQLSITDKEKSNYYMSTFPEEWLQSNPYGYAKWFMKRAFLVGNQFNNLYSLNESVKPTPDYQEERLPLQRVVQLLKRHRDVYFSKEQNDEIRKQKPISCIITTLAARAYRGESNLIDAMWGVINRMRDEIEFRYIPEYGMEIEWISNPVNVLENFADRWNDQNSYRRDNFYRWLDQLSIDLNDAENKTGLQNISESLSASFGRKPVQAAFGQIADHMRDLTNSGNNNIDRNNGLVGLATAGLTSINPIKKHDFYGTNEEE

SEQ ID NO: 709 - protein, 427 aa, Chryseobacterium sp.
MINFTQKQEVDEILDILGENLSITETQHNAAVQSYKAVGNWLTNEESELARYSPVISPQGSFIIGTTIQSINPDDDIDLDVVCELNGKRPDWTQKDIKELVGDQLRNHKKYESILDDEGRRCWTLKYRENGNPNERYHMDILPAVNTTGYSIILEKAYSNLKDQSYEDLVLSITDNERIPEYSTSTEPEEWLQSNPFGYAKWFMNIADNIKGQRTKMFSLNESVNPTPKYQSERLPLQRAVQLLKRHRDIMFQDYSEDDKKQKPISCIITTLAAKSYDGEDNIYDALLNIINTMENHIEEKYDFDLMKSVKWISNPTNESENFADRWAIEGSKREQFFYDWLDKLKVDFGGLGDNFNRMNLNESLIKSFGEAPVTKTFSDLGNRRRVLTESGRNYIDRKQGVVGAAVAGLTNVAKVSGHNFHGNEQS

SEQ ID NO: 710 - protein, 426 aa, Flavobacterium sp.
MSITIEQKTELEEILDVLGENLSITEAQHDAAVRSYQAVGNWLTNPDSELANYNPVVSPQGSFIIGTTIQTIDPDGDIDLDVVCELNGKKQSWTQKDVKELVGEQLKNHKKYESLLDEEGRRCWTLKYRENGNMNERYHMDILPAVNTSGHSIIKERAYLNLSNQKIEDLVLSITDKEKTPDYYTSTNPLNWYLSNPFGYAIWFMKSAEDVKGVKTKMFSLNESVKPTPKYQKQRLPLQRAVQLLKRHRDITFKDYSEEDKKEKPISCIITTLATHAYNGEDNIMDALINIINKMESFIETRLDENTGRYIKWISNPVKTSENFADRWALPNSKREKFFKDWIEKLKLDFGIFNSPFNRISLSESLKKSFGDAPVTKTFSDIGNNMRILTESGNNNVHRNLGLVGTAVTGLTDVSKVQPHKFFGNE

SEQ ID NO: 711 - protein, 518 aa, Pontibacter roseus
MLFPSPFKKAVGTGQLLEQVAAALDITEAQYQTVVDRYTAVAKHLAKKDSPLSPYSPDIKPQGSFLIGTMIRPLIEDDELDVDLVCRLSGKSTAWAQYHLKHAIGGQLKADETYKRMLDEEGNRCWTLVYAESAKFHMDILPAIVGSGHFTLLERSFASLDQSQVDQLAIRITDKRLGNYTSDTNTTNWLKSNPFGYAAWFKERSRVSLLESRSIRASVEPLPVYEKRKEPLQRVVQLLKRHRDIMYGGDPCKPISIIITTLAARAYNREADVSLALSNVLQRMESYIEERYSPVHGRYIKWVGNPVNPEENFADRWLLESEREKNFYEWLEKAKEDFAHLMSCSLTEAYRYSKELFGTRSVNEAVEELGVKNLITERYQQPSYLPAVLNAAHRQQPQWPVAIRYKVEIHGHYKNSKGKRVTITGNTVVPKNCDIFFVASTNVPKPFDVYWQIVNTGEEAEKNKGLRGGIYHSRTLGKGGLNQKEYSSYKGTHWAECFIVKNGVCVARSYEFIVNIGE

SEQ ID NO: 712 - protein, 342 aa, Pontibacter roseus
MLFPSPFKKAVGTGQLLEQVAAALDITEAQYQTVVDRYTAVAKHLAKKDSPLSPYSPDIKPQGSFLIGTMIRPLIEDDELDVDLVCRLSGKSTAWAQYHLKHAIGGQLKADETYKRMLDEEGNRCWTLVYAESAKFHMDILPAIVGSGHFTLLERSFASLDQSQVDQLAIRITDKRLGNYTSDTNTTNWLKSNPFGYAAWFKERSRVSLLESRSIRASVEPLPVYEKRKEPLQRVVQLLKRHRDIMYGGDPCKPISIIITTLAARAYNREADVSLALSNVLQRMESYIEERYSPVHGRYIKWVGNPVNPEENFADRWLLESEREKNFYEWLEKAKEDFAHLM

SEQ ID NO: 713 - protein, 503 aa, Pontibacter sp.
MLEQIAAALDITEAQYQTVVDRYTAVAKHLSKEGSSLSPYNPDIKPQGSFLIGTMIRPLIEDDELDVDLVCRLSGKGAAWAQWHLKHAVGGQLKADEIYKRMLDEEGNRCWTLVYAESAKFHMDILPAIVGTGHYTLLESSFASLDQSQVDQLALRITDKRLGNYTSDTNTTNWLKSNPFGYAAWFKERSRVSLLESRSIRASVEPLPVYEKRKEPLQRVVQLLKRHRDIMYGGDPCKPISIIITTLAARAYNREADVALALSNVLQRMESFIEERYSPALDRYIKWVGNPVNPEENFADRWFLESEREKNFYEWLEKAKEDFALLLSCNLTEAYRYSKELFGTRSVNEAVEELGVKNLITERYQQPSYLLAVINAAHRQQPQWPVVIRYKVEIHGHYKNSKGKRVTLTGNNIVPKYCDIFFVASTNVPKPFDVYWQIVNTGEEAEKNKGLRGGIYHSRTLGKGGLNQKEYSSYKGTHWAECFIVKNGVCVARSYEFIVNIGE

SEQ ID NO: 714 - protein, 369 aa, Cytophagales bacterium
MPMFNTTTPSISYLLENVGIALDITEAQYKEVVNRYTAVSNHLSQEGSALSRYMPDIKPQGSFLLGTMIRSLIEDDELDVDVVCRLKGKNSWWTQYDFKHAVKDQLITNADYERMLDEEGNRCWTLVYHEAAKFHMDILPAVVNVGVVNLMEKSFNSLRPDQIEELAIRITDKRWKNYKTEINSSNWMKSNPFGYAAWFKERANTSFYKSVVLNEAVEPLPAYQTDKEILVRVVQILKRHRDIMFGSNETRPISCIITTLAAYAYNKETDLIQALINVLENFLNTQYIYKKYSADHGKEIWWISNPVNPEENFADRWLEDPEREKSFFNWYEKAKADFAQIRTMDLTTAYRYLKELLGTRVENPLILTT

SEQ ID NO: 715 - protein, 342 aa, Cytophagales bacterium
MFNTTTPSISYLLENVGIALDITEAQYKEVVNRYTAVSNHLSQEGSALSRYMPDIKPQGSFLLGTMIRSLIEDDELDVDVVCRLKGKNSWWTQYDFKHAVKDQLITNADYERMLDEEGNRCWTLVYHEAAKFHMDILPAVVNVGVVNLMEKSFNSLRPDQIEELAIRITDKRWKNYKTEINSSNWMKSNPFGYAAWFKERANTSFYKSVVLNEAVEPLPAYQTDKEILVRVVQILKRHRDIMFGSNETRPISCIITTLAAYAYNKETDLIQALINVLENFLNTQYIYKKYSADHGKEIWWISNPVNPEENFADRWLEDPEREKSFFNWYEKAKADFAQIRTM

SEQ ID NO: 716 - protein, 517 aa, Chryseobacterium sp.
MPMFNTTTPSISYLLENVGIALDITEAQYKEVVNRYTAVSNHLSQEGSALSRYMPDIKPQGSFLLGTMIRPLIEDDELDVDVVCRLRGKNSWWTQYDLKHAVKDQLITNADYERMLDEEGNRCWTLVYHEAAKFHMDILPAVVNVGVVNLMEKSFNSLRPDQIEELAIRITDKRWKNYKTETNSSNWMKSNPFGYAAWFKERANTSFYKSVVLNEAVEPLPAYQTDKETLVRVVQILKRHRDIMFGSNETRPISCIITTLAAYAYNKETDLIQALTNVLENFLNTQYIYKKYSAEHGKEIWWISNPVNPEENFADRWLEDPEREKSFFNWYEKAKADFAQIRTMDLTTAYRYLKELLGTRAVNEAIRKVGYSNLINESYQPVNYSPALLSVSHRQRPSWLQQLQYNVEVHGHYKNHYGKHVTITNRSQIPKNCNIYFVASTNVPKPFDVYWQVVNTGDEAARAGSLRGGIFHSQTAGKGGLNQKEYSSYSGLHWVECFIVKNGVCVARSAEFFVNID

SEQ ID NO: 717 - protein, 517 aa, Elizabethkingia meningoseptica
MPMFNTTTPSISYLLENVGIALDITEAQYKEVVNRYTAVSNHLSQEGSALSRYIPDIKPQGSFLLGTMIRPLIEDDELDVDVVCRLKGKNSWWTQYDLKHAVKDQLITNADYERMLDEEGNRCWTLVYHEAAKFHMDILPAVVNVGVVNLMEKSFNSLRPDQIEELAIRITDKRWKNYKTETNSSNWMKSNPFGYAAWFKERANTSFYKSVVLNEAVEPLPAYQTDKETLVRVVQILKRHRDIMFGSNETRPISCIITTLAAYAYNKETDLIQALTNVLENFLNTQYIYKKYSAEHGKEIWWISNPVNPEENFADRWLEDPEREKSFFNWYEKVKADFAQIRTMDLTTAYRYLKELLGTRAVNEAIRKVGYSNLINESYQPVNYSPALLSVSHRQRPSWLQQLQYNVEVHGHYKNHYGKHVTITNRSQIPKNCNIYFVASTNVPKPFDVYWQVVNTGDEAARAGSLRGGIFHSQTAGKGGLNQKEYSSYSGLHWVECFIVKNGVCVARSAEFFVNID

SEQ ID NO: 718 - protein, 517 aa, Chryseobacterium sp.
MPMFNTTTPSISYLLENVGIALDITEAQYKEVVNRYTAVSNHLSQEGSALSRYMPDIKPQGSFLLGTMIRPLIEDDELDVDVVCRLKGKNSWWTQYDLKYAVKDQLITNADYERMLDEEGNRCWTLVYHEVAKFHMDILPAVVNVGVVNLMEKSFNSLRPDQIEELAIRITDKRWKNYKTETNSSNWMKSNPFGYAAWFKERANTSFYKSVVLNEAVEPLPEYQTDKETLVRVVQILKRHRDIMFGSNETRPISCIITTLAAYAYNKETDLIQALTNVLENFLNTQYIYKKYSAEHGKEIWWISNPVNPKENFADRWLEDPEREKSFFNWYEKAKADFAQIRTMDLTTAYRYLKELLGTRAVNEAIRKVGYSNLINESYQPVNYSPALLSVSHRQRPSWLQQLQFNVEVHGHYKNHYGKHVTITNRSQIPKNCNIYFVASTNVPKPFDVYWQVVNTGDEAARAGSLRGGIFHSQTAGKGGLNQKEYSSYSGLHWVECFIVKNGVCVARSAEFFVNID

SEQ ID NO: 719 - protein, 520 aa, Flavobacterium sp.
MFELTNRPNKTNDLLENIGQVLDITQAQHELVEQRYTAVANQLSKEGSTLSRYKPEILPQGSFLLGTMIRPIMEDDELDVDLVCRLTGKGFDWAQMHLKNAVKKQLIDKNDNYNRMLDEEGNRCWTLTYAEDKFHLDILPALVGNNNHINLSERSFSKLDKTDLENISVRITDRREENYPSETNPNYWLKSNPFGYAAWFKERSNLNLLKSVLLSESVTPLPGYKKEKAPLLRVVQILKRHRDIMYGGDCDKPISIIITTLAAMAYQKETNVINALINILNTMHLHMKEVYSAKHNKNIWWISNPVNEVNENFADKWPNEKQKQDNFFSWLEKAKADFGALQNMDPSDAYRTLKNILGTRAVNEAVRNLGYDELITENLKPVNYSAQMLSVPHRVRPLWNLNLRYYCNISGVYTDATDGNKRKNITSSTLLPKGCFVTFNAMDTDVPKPYDVYWQVVNNGLEATNGNCLRGHIFKAQTAGRGGLIYKDATAFSGLHWAECFIVKNGVCVARSSEFFVNIR

SEQ ID NO: 720 - protein, 410 aa, Prevotella nigrescens
MGRIFSKEQKEEFKDILETLGESLDITQTQYDNLTRSYKAVGEFLQNDPVFEPYKPIVSPQGSLRLGTIIQPINPNDDLDVDLVYRLSEKNPMWTQKDIKDKVGSRLKGSDRYAPMVNKKEGRRCWTLLYRDNSDNPKEKYHMDILPSVADSKYVERMTRLFSENFSDQTVDQISIRITDKEAKDYATSTYKEDWLKSNPDGYALWFAHRCKADETVKLRAEAIVPVEKYNKKKTVLQRIVQILKRHRDMMFYNDTEDKPISIIITTLAARAYNGEQNLLEGLLNVVDNLEKSITKNEIGEDVVSNPVNPEENFADKWPTHPKRRKNFYKWLATVKKDMHEILDGANRIQIQIIMGRVFGKNMIEKASSLLVERRKSKLATGAALLTSAGKIAANTVGKVINTANTFYGE

SEQ ID NO: 721 - protein, 407 aa, Prevotella nigrescens
MFSKEQKEEFKDILETLGESLDITQTQYDNLTRSYKAVGEFLQNDPVFEPYKPIVSPQGSLRLGTIIQPINPNDDLDVDLVYRLSEKNPMWTQKDIKDKVGSRLKGSDRYAPMVNKKEGRRCWTLLYRDNSDNPKEKYHMDILPSVADSKYVERMTRLFSENFSDQTVDQISIRITDKEAKDYATSTYKEDWLKSNPDGYALWFAHRCKADETVKLRAEAIVPVEKYNKKKTVLQRIVQILKRHRDMMFYNDTEDKPISIIITTLAARAYNGEQNLLEGLLNVVDNLEKSITKNEIGEDVVSNPVNPEENFADKWPTHPKRRKNFYKWLATVKKDMHEILDGANRIQIQIIMGRVFGKNMIEKASSLLVERRKSKLATGAALLTSAGKIAANTVGKVINTANTFYGE

SEQ ID NO: 722 - protein, 410 aa, Prevotellaceae bacterium
MESILSKEQKEEFKDILETLGESLDITQTQYDNLTRSYKAVGEFLQNDPVFEPYKPIVSPQGSLRLGTIIQPINPNDDLDVDLVYRLSEKNPMWTQKDIKDKVGARLKESNRYAPMIDKKEGRRCWTLLYRDNSDNPKEKYHMDILPSVADSKYVERMTRLFSENFSAQTVDQISIRITDKEANDYAISTHKEDWLKSNPDGYALWFAYRCKADETVKLRAEAVVPVEKYNREKTVLQRIVQILKRHRDIMFYNDTEDKPISIIITTLAARAYNGEQNLFEGLLNVVDNLERNITKNERGEDVVSNPVNPEENFADKWPAHPKRRENFYKWLAAVKKDVHEILNGANRIQIQTIMGRVFGKDMIEKASSLLVERRKSKLTTGAALLTSAGKVAASTVGKVINTANTFYGE

SEQ ID NO: 723 - protein, 407 aa, Prevotellaceae bacterium
MLSKEQKEEFKDILETLGESLDITQTQYDNLTRSYKAVGEFLQNDPVFEPYKPIVSPQGSLRLGTIIQPINPNDDLDVDLVYRLSEKNPMWTQKDIKDKVGARLKESNRYAPMIDKKEGRRCWTLLYRDNSDNPKEKYHMDILPSVADSKYVERMTRLFSENFSAQTVDQISIRITDKEANDYAISTHKEDWLKSNPDGYALWFAYRCKADETVKLRAEAVVPVEKYNREKTVLQRIVQILKRHRDIMFYNDTEDKPISIIITTLAARAYNGEQNLFEGLLNVVDNLERNITKNERGEDVVSNPVNPEENFADKWPAHPKRRENFYKWLAAVKKDVHEILNGANRIQIQTIMGRVFGKDMIEKASSLLVERRKSKLTTGAALLTSAGKVAASTVGKVINTANTFYGE

SEQ ID NO: 724 - protein, 406 aa, Prevotella fusca
MLQTNDNLSRELNELFLMLSKSLDITKTQYDNLTRSYSAVGKYLEEDPELSSYHPVITPQGSLRLGTIIQPINEEDDLDVDLVYRLIEKGPTWTQFDLKTRVGNRLKSHSLYKEMLDKEGRRCWTLLYRQNSDNNKERYHMDILPCVAESTYLERFHILNASGFDAQAIDDISIRITDNKCDNYKTSICIREWMKSNPDGYAMWFASRCNITSQNNRALLENVIPVRKYVENKTILQRIVQILKRHRDVMFNGDKEKPISIIITTLAAKAYKGEDNLFIGLNNVIDGMESQIHKNQDGTYVIENPVNSEENFADKWTSHPNRRDNFFRWLGKLKSDKGAFLNCKGSVLRNVFASSFGKKVTNLIFEKRALEHKAEASNSKLKVSSTGIIGAIGTTLNAKNTFFGEK

SEQ ID NO: 725 - protein, 408 aa, Parabacteroides distasonis
MIETLSVEKQRELNKLFLNVAENLDITETQFNNLTRSYNAVGKYLEEDPNFKDYQPVVTPQGSLRLGTIIQPITEDGDIDVDLVFRLIGKHPYWTQKHIKQMVGQRLKAHGTYCEMLDKEEGRRCWTLLYRQKSDNAQERYHMDILPSVADTKFNANLEQVRNKAFSSIKLDDIAIRITDNKAKNYDTSTFVSDWLKSNPDGYAMWFADRCKYTAEKRENIVEAIMPIGKYIKDKSVLQRIVQILKRHRDIMFKDDEDKPISIIITTLSARAYNGETSLLEGLTNVICTMENHIAKDHNGNFVISNPVNPEENFADKWPTHPKRKENFFKWLMQVKLDVHNIINGTGVQLRENIGRSFGDEFSKKLFNLLTEQHRTSATNAGIKVAATGVLGSVGKTLNAGNTFYGKK

SEQ ID NO: 726 - protein, 404 aa, Rhodohalobacter halophilus
MITNEQKITQYGDILEELGRSLDLTDTQIEEAKDRYKAVGEYLQREGSSLADLNPSIEPQGSFLLGTMIKPINKDGQFDIDLICKLESLPPLDTQSDLKLKVGDELRKGRYKEHLDEEGQRCWTLNYAEGTKFHMDILPAIPDDFRELLFEGVVDKNLYQNALRMTDNEHSHYDSNNRSEWPKTNPKGYSEWFKEEMKPIRDRLLKEAAMKMERSIEDVPEWSVKTPLQRAIQILKRHRDLMFGEDEKKPISIIITTLAAKAYNQEDNVYEALVSILNGMKGHIKFKEDGTAWVENPVNPKEENFADKWEHFPERKKAFFDWLVKAKEEILSALEQPGLHNIQKAFEKPLGKQVVNEAFTNLADNSKSLRESGQKMMGVGTGVLGTAGRTKVKDHDNYGRLKDE

SEQ ID NO: 727 - protein, 384 aa, Eubacterium sp.
MAEEQKNYINKLYEYIVDEISISDTMLDKAIKSYGAVGKWLGDCDPSLDVKIMPQGSVNLGTVIKPISDEDDYDIDLVCLLKNGGEMKASEIKEIVGRRLKEHKTYNEMLEDEGKRCWTLRYDEFHMDILPSVPKNHLYIEPEKTEIRLTHKLDNGSYIDKFSNPAKYKLWFEDRMKTVLLESKRTFAMKNQVEIDDVPTYSVRTPLQKAIQLLKRHRDISFANDKEGVAPISIIITTLAARAYNNETNVYDALNGILSRMAYYIEKDESGKYKICNPVMEEENFADKWAIEPEKAKAFFDWLERAKEEIITKPMLLEGVVEQSKLVKSCFGDKVTNRAYNRIGEETRIARENQNLYTSNLKGGVSTVADEDSKPIPGHTFYGE

SEQ ID NO: 728 - protein, 384 aa, Eubacterium sp.; identical to SEQ ID NO: 727

SEQ ID NO: 729 - protein, 305 aa, Oscillibacter ruminantium
MTDKEKILGTLLSSIADEINITPTMQDKAVSSYTAVGKWIGDGVDYDVKIMPQGSMNLGTVIKPIDDRDDYDMDLVCLLKNGRYLPLKDIKNLVGDRLKENATYGQKLEKEGKRCWTMQYDVFHMDVLPCVPKDGYFIEPNSTAIKLTHKISDGMYEPRYSNPYAYHKWFDNRMKDILLLEKRAFAAQNKTEIDKVPTYKMRTPLQKAIQLLKRHRDICFQNASDYAPISIIITTLAAWSYNGETNVYEALCNILERMPQHIECRDGIYWVENPTMPEENFADKWNAVPNKRTAFMGWLGRARKE

SEQ ID NO: 730 - protein, 380 aa, Oscillibacter ruminantium
MTDKEKILGTLLSSIADEINITPTMQDKAVSSYTAVGKWIGDGVDYDVKIMPQGSMNLGTVIKPIDDRDDYDMDLVCLLKNGRYLPLKDIKNLVGDRLKENATYGQKLEKEGKRCWTMQYDVFHMDVLPCVPKDGYFIEPNSTAIKLTHKISDGMYEPRYSNPYAYHKWFDNRMKDILLLEKRAFAAQNKTEIDKVPTYKMRTPLQKAIQLLKRHRDICFQNASDYAPISIIITTLAAWSYNGETNVYEALCNILERMPQHIECRDGIYWVENPTMPEENFADKWNAVPNKRTAFMGWLGRARKELIDNPLACFGMDGIAEEYKKYLGERPVQRAFNAVGDKTRVARERGELTINGLTGGLSASTKHVGYPVKEHTFWGE

SEQ ID NO: 731 - protein, 381 aa, Ruminococcus flavefaciens
MEHKKQELGRILDLIADELNITPTMMDKAVSSYEAVGKWLGEGIDYKVTIKPQGSMNLGTVVRPIDEDDDYDMDLVCLLEGGQNLLPKSLKGLVGNRLKEHEIYKQKLEKEGKRCWTMSYDGFHMDILPSSPQYTKAQPFGSTSIRLTHKLENGEYINKYSDPEAYHDWFVDRMTNDHPINKSGVFSERATKIEKVPTYKRRTTLQKAIQLLKRHRDIMFLGNSDDAPISIIITTLAAYSYKGESNIYDALMSILDNMQNHIEYNNGEYKILNPVMQEENFADKWNEKPQKADNFFRWLTTVKKDILESPLKLSGIDEIGEALKQCLGEKPINRALNKYGEEMRTARENNRLYVDGGKNGLVNTTAASSLLKVKGHTFFGI

SEQ ID NO: 732 - protein, 381 aa, Ruminococcaceae bacterium
MKERQHALGDFLDKIADELNISDTMMEKAVKSYEAVGKWIGNGIDYDVCIKPQGSMNLGTVVRPIDDSDDYDMDLVCLLRTGQNLPLSDIKSIVGDRLKANDRYASMLEKEGKRCWTMRYDEFHMDILPCVPKEKVYIPKIATAIKLTHREGNNQYTEKYSNPEAYHDWFVRRMLAQKELIEKNSIYAKRKTEIDKVPTYRRRTVMQKTIQLLKRHRDIMFQKNDNNAPISIIITTLAALAYKGEDNVYDALSNILKTIPDYIQITSGKYKLLNPVMSDENFAEKWNENHAKADCFFNWLSTAHKDLLENPLKFTGLDLIADTLKSSLGEAPVKRAVNKCGDEMKSCRDDGRLYAAGLTGGLGVIQNASAIKVKGHTFFGK

SEQ ID NO: 733 - protein, 383 aa, Lactococcus lactis
MEKKELLNKIYCELADSLNISDTMTQEIISSYKSVGSYLGNLEENLNIHIYPQGSMALGTLVRPIAEDKEGDYDVDLVCLLKNGGNLPAKDIKQIIGKRLSEGERYKSKLDAEGKRCWTLKYSDFHMDILPSVPKISTLPKPSRNVTQIRLTHKENDSYFNRYSDPKAYRKWFTKQMEVSFSKQREIIARNKKVEIEEVKLFDVRTPLQMTIQILKRHRDIMFSGRDNKPISIIITTLAAKSYSGETNLYEAIEKVLQDMDKHIEFNNGKAVISNPTMDSENFADKWEEFPEKQQAFFEWLNKARKDIIQEPLEFAGGMGTMKNRMRELFGSKAVNQTFDTYEEKNIKEKNKGNLGVTKEGNIGSIASSNIIAPLSTHTFYGK

SEQ ID NO: 734 - protein, 385 aa, Lactococcus lactis
MNKKELLDKIYTELAESLNITDTMTVEIINSYEAVGKYLGNLEEELDIQIYPQGSMGLGTLVRPISSDEEGDYDVDLVCLLKNGSYLSAKDIKQIVGKRLSEGERYKSRLDEEGKRCWTLKYPDFHMDILPSVPQLNQSTIFDRKNTEIRLTNKEEEGVYSDKISNPKAYREWFIEQMEVTFLKRREIVAKKRNVEIEKVKLFDVRTPLQMAIQILKRHRDIMFSGKENKPISIIITTLAAKAYTGQTDLYDTIETILQNMHKYIEKDSSGKILICNPTVSSENFADKWEESPEKERAFFDWVRSAQTDILQNPMEFAGGFGSMKNQLREIFGSRAVNQAFEVYEKKNLNDKNIENLGVNSIGNLVNNTAENAVAPLKKHTFYGH

SEQ ID NO: 735 - protein, 381 aa, Lactococcus chungangensis
MLGTSNETLKQIFRALADSLNVSETTTKEIIASYEAVGTYLGNLEEDLDIKISPQGSMALGTMIKPLSSDNNGEYDVDLICQLTNGESLTPEQVKHIVGNRLHESPRYSKMLDPEGKRCWTLKYTDFHMDVLPCTPLSSENSNSIRITERLDNNTYKDGISNPKGYIEWFKAKMQLVYTEALQNYAEKRNVEIEKIHLYNLRTPLQMAIQILKRHRDIMFEGEDYKPTSIIINTLAARAYGNEGNVYDAICNILENMEQHFTIGPNGEYQVLNPTRREENFADRWIAEPKRKDAFFRWLQMAKKDIVEDPLNFIDGLDSLKSRLSESFGAQVTQDTFEAYGRTMLDNRVNNRIGVNSKGNLTNKKSSAIIPVTNHTFFGSV

SEQ ID NO: 736 - protein, 391 aa, Blautia wexlerae
MRKEEKLNMIFDNLADGLNITQTMMKKAETAYNALGEHIKNSNEEWDVIVYPQGSFQLGTVIKPVNDEEQYDVDLVVLVKTPYYDAEMLRNEVLQVLESHGRYEGKIENKKPCIRIQYADSSQFHMDIASAQEIGITNDTSINIARFDGDERYFYEISNPKGYIDWFKKTMQFEELQKSQRALFEKCQTEVEELELSKMRTPLQKAIQILKRHRDIFFADRENADDRPSSIIITTLCAMAYEDLRGKYEKDNIYLTVVNMLEKFPAYVKKNSEGDYYLENPSNPKENFLKKWCDNPALVVAFEQWIFKARTDIIYNPEAFIEDNPQELRKSLYESFGQRDADIALDNYGKQLGKYAQNGHLKYDTSSANVVLHENKGKSYNKHTYFGGMCE

SEQ ID NO: 737 - protein, 383 aa, Faecalibacterium sp.
MYSKDDINKLYREIAASIDISDDMFTAAVDEYESLGKWIDENTPQYQISIYPQGSFGLGTVVKPITDEDDYDLDIVCQFKEQYGLTAKQLKVDVVKPLLLGYKKTSRDIENKRRCWHVEYAEIPNFHMDVIPAYANAKLKRINITDHDEDHDTYDYIGSNPSGYITWFFERCARQQKRLLDSYMKEHGLVVASADAEEIKRRKIKTPLQRVVQLLKRHRDIMFADDDSGNKPISIIITTIAATLYQEEDNIVDAMTNILLEAPKWINRNKKNGLYYIENPSYPGENFADKWNTHPERATAFFNWVKQATADLTGNQLYQMSRIDMGENVKMCFGEKTGKTVFSKAAEECRAGVENGSLKVDRSSGNLSTKGTVSVPTTRHYGQ

SEQ ID NO: 738 - protein, 381 aa, Clostridium sp.
MYTKEAYNSLLKSTAQNIDISDEMFEAAEKTYKDLGKWIDQETPDYEISIYPQGSFALGTVVRPITNADDYDLDIVCQFKSQYGLTAKELKVDVVKPLLVRYKKTSREIEEKKRCWHVEYDDVPNFHMDVIPAHTYGSVIRITDHNEDDDTYDYLGSNPAGYVKWFFDACAKQRNRLYEQYIKDHRTVVAQADVEDVKRRKVKTPLQRVVQILKRHRDIKFADDNSGNKPISIIITTIAGRLYEEEDNIYDALFNILSKAPSWIMDNRKDQQFYIENPSYKGENFADKWNTHPERATAFLQWLYAARKDLVDGSLLQYNRIEMGNHLKECFGSETGKAVFNSEAETVRSAIAAGTLKVDTSTGNISKYGTVSVPPAHHFGA

SEQ ID NO: 739 - protein, 382 aa, Clostridium sp.
MMYTKEAYNSLLKSTAQNIDISDEMFEAAEKTYKDLGKWIDQETPDYEISIYPQGSFALGTVVRPITNADDYDLDIVCQFKSQYGLTAKELKVDVVKPLLVRYKKTSREIEEKKRCWHVEYDDVPNFHMDVIPAHTYGSVIRITDHNEDDDTYDYLGSNPAGYVKWFFDACAKQRNRLYEQYIKDHRTVVAQADVEDVKRRKVKTPLQRVVQILKRHRDIKFADDNSGNKPISIIITTIAGRLYEEEDNIYDALFNILSKAPSWIMDNRKDQQFYIENPSYKGENFADKWNTHPERATAFLQWLYAARKDLVDGSLLQYNRIEMGNHLKECFGSETGKAVFNSEAETVRSAIAAGTLKVDTSTGNISKYGTVSVPPAHHFGA

SEQ ID NO: 740 - protein, 381 aa, Unknown
  Description of Unknown: uncultured Clostridium sp. sequence
MYTKEAYNSLLKSTAQNIDISDEMFEAAEKTYKDLGKWIDQETPDYEISIYPQGSFALGTVVRPITNADDYDLDIVCQFKSQYGLTAKELKVDVVKPLLVRYKKTSREIEEKKRCWHVEYDDVPNFHMDVIPAHTYGSVIRITDHNEDYDTYDYLGSNPAGYVKWFFDACAKQRNRLYEQYIKDHRTVVAQAEVEDVKRRKVKTPLQRVVQILKRHRDIKFADDNSGNKPISIIITTIAGRLYEEEDNIYDALFNILSKAPSWIMDNRKGQQFYIENPSYKGENFADKWNTHPERATAFFKWLDTARKDLVDGRLLQYNKIEMGNHLKECFGSETGKAVFNSEAETVRSAIAAGTLKVDTSTGNISKNGTVSVPPAHHFGA

SEQ ID NO: 741 - protein, 498 aa, Desulfosporosinus sp.
MYSKEDINALYEKIAHSIDISEKLFDQAEEYYKKLGAWMDEETPNYRLTVYAQGSFALGTVIKPITEADDYDLDLVCEFADHYGLDARSLKVGVIKPLLDNFDEVTKIEEKRRCWQVIYKNASNFHMDIIPSVDEKTFISITDKNVEYSSYEFIGSNPKGYINWFNGRKAIRYKAIREAAKSEQIQKFMAEVEPLKEYKLKTPLQKAIQILKRHRDIMFKDDTEHLAPISIIITTIAAQLYNNEDNIYDSLKNILANAKDYIDRCKRNDEFYVENPSYTGDENENFADKWNEYPERAEAFIDWLEQAKTNLISSIEMFDDKAEIGSVLGVSLGENVVQRVFSEIDAKTAKSILEETQEKELAFVPRKTQSLLSVPHREKTPWTLPKGYRVLIKATVTDGYGRKYPYKNDGEPLDKAVSIDFTAIFTVSMPNKVKWQVVNTGEDARGKACLRGGFEDSNVGRNTRSEGTEYTGSHYVQCFIIKKGQCVGKSNIFVVNIK

SEQ ID NO: 742 - protein, 299 aa, Peptococcaceae bacterium
MNKIYTQVVNNLDISEELFQRAEKKYMDIASWFEENIQKYDFVIYQQGSFALGTVTKPISDADEYDLDLVCEINNASDLTAEQLKKRSYDWLNRYGKYERLKEKTRCWQVIYSDSLQFHIDFLPSLPLPLGDERILITDKDDNYKTYEYIGSNPKGYAAWFKERMAAQYALQEHKIAIEKYAADIKKVPRYAVKTPLQKAIQLLKRHRDILFKDDTYNVTPISIIITTLSAHTYNNEDNIYDALLSIIKGMPRYINKLADGSYSIENPSCPTENFAEKWNEHPERAVAFFEWIEQVKLD

SEQ ID NO: 743 - protein, 385 aa, Lachnospiraceae bacterium
MAYTRQGIEDLFGSILKDLDISAVMFDKARKEYEALGEWIDKKSDEYDVRIYPQGSFALGTVIKPISGKDDYDLDLVCELAEQYELSACELKKDVVRQWLVHYKRITGDIVEKRRCWHVEYEEIPNFHMDVIPSYDTNLSFIKITDHNEEQDTYQYIGSNPRGYTDWFYSRCQKRWDALFDQYSRDNHLRFDEAEVERLDRHKVITPLQKAIQLLKRHRDIMFKDHPDDKPISIIITTLAAQLYNNEDNIVDALASFLNGAERYIHEHKMHGDYHIDNPSYSGENFADKWNKHPERARIFFNWLTQAQEDFDLSTLMRSDTVEMGNRVKHIFGNETGKRVFAGIGATTTAGVISGAIKVSAATGGLSRIGTIPVQQNHHFHGKIS

SEQ ID NO: 744 - protein, 527 aa, Rhodopirellula maiorica
MNYKMIDNRTLIVNSILEQIAEELDIPPSKYQQAVDRYQAVGRWLEGGDYPGSTGTPKIYPQGSFRLGTVVRPIREGKECDYDIDLSCELIIPKERTTPQDIRHFIGNRLKEHGKYKKLLDDEGRRCWTLLYAEEDGTGFHLDVLPCVPDPSIFDNVDQQLSLQSAALTDRRESDNGYDWGFTNPAGYADWFAQRQRVVFSRTASLRKDQIFRENPTIYASVDDVPDQLVRTPLQRAIQVLKRHRDIRFADQKNSSDRPISIIINTLAALAYQQEPDAYTTLANFLDRVQRYQETELIRCEDDEWIIANPVNPNENFADRWNDPGSGRPDAFFQWINWLQEDIDEILNASTSFELERSLQGAFGDSVGKRVAGSFSSSLPGRQLPAVSAFGRVAKQLLRFDFAHRQAPKWHVQPTRYTAKVRAKYLRNGFRPTAFRSNAPALPKHVDLVFEAEVDVPKPYTVYWQVVNTGQEAIRANCLRGDFYDSNKAGKTREERTEYSGMHWVECFVVKNDVCVARSGEFVVNIL

SEQ ID NO: 745 - protein, 527 aa, Rhodopirellula maiorica; identical to SEQ ID NO: 744

SEQ ID NO: 746 - protein, 527 aa, Rubripirellula obstinata
MNSTMIDNRILIVNSILQDIAKELDIPPSKYKQAVERYTSVGNWLESGVYPGSTGAPAIYPQGSFRLGTVVRPIHDGVESDYDIDLACEIIIPKHQTSPELVRHHVGNRLKEHGTYSRLLDDEGRRCWTLLYAEQDGAGFHLDVLPCVPDPLTFAGVEPSMSLKSVALTDRSKSVTTYEWGFTNPAGYADWFAECQRPIFNRTASLRKSQIFREHSEVFASVDEVPDQLVRTPLQRMVQILKRHRDIRFAGQPNSGERPISVIITTLAAIAYQQEPDVYSALANFLDRVTRHQETGLIRCENDEWVIANPVNPNENFADRWNEPDSGRPDAFFQWVNWLQEDIDELLNAATPKELERSLQTSFGESIGKRVASELEGRVPAGQGMPVSAFGRVAKQLLRFDVAHREPPRWHMQPTTRQARIKARFTRNGFRPTAFRSNSPAIPKYADLVFEIETDVPKPYTVYWQVVNTGDEAANASNLRGEFYDGGQSGKIRREKTEYRGMHWVEAFVVKNNACVARSGEFVVNIQ

SEQ ID NO: 747 - protein, 413 aa, Octadecabacter antarcticus
MTDMNVGIGYGYNLAVEKLAEELAVPPDRFDQAERRYKDLGEFLHRDESKVRDFDPDVYIQGSFALGTPIKPASTDEDYDLDIVVAFKALSKRHMCQADLRRLLKDELKAYRKARGIQNAVGESRRCCTLIYADGAQFHMDVLPAVPNEANMRAVLSSYRADEALADGAIAITDSEEIATYHVITDDWPGSNPRGFAAWFKSRQLEQLNERRRAFLDARGKVTASVEDVPVFRVRTPLQSAIMILKRHRDEWFAEQDDPDLKVISIILTTLSTHAYAGEARVSDAIAKILRDLHVKIEELHGVYWIANPTDPSENFADRWETHPERGEAFFEWLEAARRHFGAVQGFSDASIVLNELSQSLGDPIVEAARLRVSTNTGSRAASVAPAAAAGASSPGLVFGDEQRRPTEPKGFG

SEQ ID NO: 748 - protein, 410 aa, Octadecabacter antarcticus
MNVGIGYGYNLAVEKLAEELAVPPDRFDQAERRYKDLGEFLHRDESKVRDFDPDVYIQGSFALGTPIKPASTDEDYDLDIVVAFKALSKRHMCQADLRRLLKDELKAYRKARGIQNAVGESRRCCTLIYADGAQFHMDVLPAVPNEANMRAVLSSYRADEALADGAIAITDSEEIATYHVITDDWPGSNPRGFAAWFKSRQLEQLNERRRAFLDARGKVTASVEDVPVFRVRTPLQSAIMILKRHRDEWFAEQDDPDLKVISIILTTLSTHAYAGEARVSDAIAKILRDLHVKIEELHGVYWIANPTDPSENFADRWETHPERGEAFFEWLEAARRHFGAVQGFSDASIVLNELSQSLGDPIVEAARLRVSTNTGSRAASVAPAAAAGASSPGLVFGDEQRRPTEPKGFG

SEQ ID NO: 749 - protein, 406 aa, Octadecabacter antarcticus
MGYGYNLAVEKLAEELAVPPDRFDQAERRYKDLGEFLHRDESKVRDFDPDVYIQGSFALGTPIKPASTDEDYDLDIVVAFKALSKRHMCQADLRRLLKDELKAYRKARGIQNAVGESRRCCTLIYADGAQFHMDVLPAVPNEANMRAVLSSYRADEALADGAIAITDSEEIATYHVITDDWPGSNPRGFAAWFKSRQLEQLNERRRAFLDARGKVTASVEDVPVFRVRTPLQSAIMILKRHRDEWFAEQDDPDLKVISIILTTLSTHAYAGEARVSDAIAKILRDLHVKIEELHGVYWIANPTDPSENFADRWETHPERGEAFFEWLEAARRHFGAVQGFSDASIVLNELSQSLGDPIVEAARLRVSTNTGSRAASVAPAAAAGASSPGLVFGDEQRRPTEPKGFG

SEQ ID NO: 750 - protein, 412 aa, Celeribacter indicus
MNVSAGVGYGYNVAIEKLAEELAVPQDRFDQAERRYKDLGEFLHRDDSKVRDYDPDVYIQGSFALGTPIKPTSKDEDYDLDIVVSFRSLTKAQISQADLRALLLAELKAYRDARGIKNEVSDEPRRCCTLIYADGAQFHMDVLPAVPNEANMRAVLSSYLADQALAEGAIAITDKDKTSTYRIITDDWPRSNPRGFAAWFKSRQIEQLNERRRAFLDAQGKVTASVEDVPVFRVRTPLQSAIMILKRHRDEWFAERDPELKVISVILTTLSAHAYAGEARVSDAIAKILKDMHLEVKERNGESWIANPTDPSENFADRWKDFPDRRKSFFEWLETARSDFGAVQKFSDTNIVLNELSRNLGSTLVEGVRSRVAASAGSRAASVAPAAAAGASAPGLVFGGEDRRPTEPKGFG

SEQ ID NO: 751 - protein, 412 aa, Unknown; identical to SEQ ID NO: 750
  Description of Unknown: Rhodobacteraceae sequence

SEQ ID NO: 752 - protein, 418 aa, Ruegeria sp.
MNKRFDMNVSAGIGYGYNVAIEKLAEELAVPQDRFDQAERRYKDLGEFLHRDDSKVRDYDPDVYIQGSFALGTPIKPTSKDEDYDLDIVVSFRSLTKAQISQADLRALLLAELKAYRDARGIKNEVSDEPRRCCTLIYADGAQFHMDVLPAVPNEANMRAVLSSYLADQALAEGAIAITDKDKTSTYRIITDDWPRSNPRGFAAWFKSRQIEQLNERRRAFLDAQGKVTASVEDVPVFRVRTPLQSAIMILKRHRDEWFAERDPQLKVISVILTTLSAHAYAGEARVSDAIAKILKDMHLEVKERNGESWIANPTDPSENFADRWKDFPDRRKSFFEWLETARSDFGAVQKFSDTNIVLNELSRNLGSTLVEGVRSRVAASAGSRAASVAPAAAAGASAPGLVFGGEDRRPTEPKGFG

SEQ ID NO: 753 - protein, 427 aa, Phaeobacter piscinae
MDIFEEGCIKVRDSRMNTGSSVGYGYNVAIEKLADELAVPQDRFDQAERRYKDLGEFLHRDESKVRDYDPDVYIQGSFALGTPIKPTSKDEDYDLDIVVSFRSLTKAQIFQADLRALLLAELKAYRDARGIKNEVSDEPRRCCTLIYADGAQFHMDVLPAVPNEANMRAVLSSYLADQALAEGAIAITDKDKTSTYRIITDDWPRSNPKGFAAWFKLRQIEQLNERRRAFLDAQGKVTASVEDVPVFRVRTPLQSSIMILKRHRDEWFAERDPDLKVISVILTTLSTHAYAGESRVSDAIAKILRDMHLAIKERNGVSWIANPTDPSENFADRWEKFPERQEAFFTWLEAARKDFGAVQSFSDTNIVLNELSRNLGSTLVEGARSRVAASAGSRAASVAPAAAAGASAPGLVFGGEDRRPTEPKGFG

SEQ ID NO: 754 - protein, 412 aa, Roseovarius sp.
MMNTSSNIGFGYNVAIEKLAEELAVPQDRFDQAERRYKDLGEFLHRDESKVRAYDPDVYIQGSFALGTPIKPTSKDEDYDLDIVVSFRSLTKAQISQADLRALLLAELQAYRDARGIKNEVGESRRCCTLIYADGAQFHMDVLPAVPDEAKMRAVLSTYLADQSLAEGAIAITDSDKAETYHVITDEWRTSNPRGFAAWFKSRQIEQLNERRRAFLDAQGKVTASVEDVPVFRVRTPLQSSIMILKRHRDEWFAEQDSDLKVISVILTTLSTHAYAGEARVSDAIAKILRDMHLAIKERNGVSWIANPTDPSENFADRWEKFPKRRESFFKWLEAARTDFGAVQRFSDTNMVLNELSRNLGSTLVEGARSRVAASAGSRAASVAPAAAAGASAPGLVFGGEDRRPTEPKGFG

SEQ ID NO: 755 - protein, 411 aa, Ruegeria atlantica
MNAGVGMGFGYNVAIEKLAEELAVPQDRFDQAEKRYKDLGEFLHRDESKVRDYDPDVYIQGSFALGTPIKPTSKDEDYDLDIVVSFRSLTKARISQAELRALLRAELKAYRDARGIKNEVGESRRCCTLIYADGAQFHMDVLPAVPNEANMRVVLSSYLADQALAEGAIAITDSDKTSTYRVITDDWPRSNPRGFAAWFKSKQIEQLNERRRAFLDAQGKVTASVEDVPVFRVRTPLQSAIMILKRHRDEWFAEQDPDLKVISVILTTLSTHAYAGEARVSDAIAKILRDMHLEIKERNGVSWIANPTDPSENFADRWEEFTERRESFFKWLEAARTDFGAVQRFSDTNIVLNELSRNLGSTLVEGARSRVAASAGSRAASAAPAAAAGASAPGLVFGGEDRRPTEPKGFG

SEQ ID NO: 756 - protein, 353 aa, Phaeobacter sp.
MNAGADIGYGYNVAIEKLAEELAVPQDRFDQAEKRYKDLGEFLHRDESKVRIYDPEVYIQGSFALGTPIKPASKDEDYDLDIVVSFRSLTKLQISQADLRALLLVELEAYRHARGIKNEVGESRRCCTLAYAEGAQFHMDILPAVPDEANMRTVLSSHLADQALAEGAIAITDRDKPRKYHVITDDWPRSNPRGFATWFKSRQIEQLNERRRAFLNAQGKVTASVEDVPVFRVRTPLQSAIMILKRHRDEWFAERDPDLKVISVILTTLSTHAYAGEARVSDAIAKILRDMHLAIEERNGVSWITNPTDPSENFADRWEKFPERRKSLFEWLEVARMDFGTVQRFSWNRLDVI

SEQ ID NO: 757 - protein, 383 aa, Gluconacetobacter diazotrophicus
MPPSRYEQADRSYMSLGDWLHRDASTVRQYGPKVYVQGSFRLGTTIRPLNDAEEYDVDSVCELQKLGKTSLTQQQLKTLLGAEIEAYRRAQNMNKPLREGRRCWVLDYADGAQFHMDIVPALPNGQAARLLLESRGYDARWTLTAIAITDKEGPTYTTVTDDWPRSNPKGYCEWFKSRMATALERRKRVLADSMRASVEDIPDYKVRTPLQAAIMILKRHRDHTFEHGGDERPISVIITTLAAHAYKGEETIGEALAVILAGMDQHILWHNNRYWIPNPTDPLENFADKWAEHPERATAFYEWLQKARTEFAAAARSSDRRVITEIVGRGVGGSMADRTARRRPPPPRSPLLKTASVAPVAEGLSFPDRSRVPTKPQGFGGAE

SEQ ID NO: 758 - protein, 384 aa, Acetobacter indonesiensis
MPPSRYEQADRSYMSLGDWLHRDASTVRQYGPKVYVQGSFRLGTTIRPLNDAEEYDVDSVCELQKLGKTSLTQQQLKTLLGAEIEAYRRAQNMNKPLREGRRCWVLDYADGAQFHMDIVPALPNGQASRLLLESRGYDARWTLTAIAITDKEGPTYTTVTDDWPRSNPKGYCEWFKSRMATALERRKRVLADSMRASVEDIPDYKIRTPLQAAIMILKRHRDHTFEHGGDERPISVIITTLAAHAYKGEETIGEALAVILAGMDQHILWHNNRYWIPNPTDPLENFADKWAEHPERATAFYEWLQKARTEFAAAARSSDRRVITEIVGRGVGGSMADRTARRRPPPPPRSPLLKTASVAPVAEGLSFPDRSRVPTKPQGFGGAE

SEQ ID NO: 759 - protein, 407 aa, Acetobacter indonesiensis
MVEKQTRTHESEEFLEDLAEELSVPPSRYEQADRSYMSLGDWLHRDASTVRQYGPKVYVQGSFRLGTTIRPLNDAEEYDVDSVCELQKLGKTSLTQQQLKTLLGAEIEAYRRAQNMNKPLREGRRCWVLDYADGAQFHMDIVPALPNGQASRLLLESRGYDARWTLTAIAITDKEGPTYTTVTDDWPRSNPKGYCEWFKSRMATALERRKRVLADSMRASVEDIPDYKIRTPLQAAIMILKRHRDHTFEHGGDERPISVIITTLAAHAYKGEETIGEALAVILAGMDQHILWHNNRYWIPNPTDPLENFADKWAEHPERATAFYEWLQKARTEFAAAARSSDRRVITEIVGRGVGGSMADRTARRRPPPPPRSPLLKTASVAPVAEGLSFPDRSRVPTKPQGFGGAE

SEQ ID NO: 760 - protein, 406 aa, Gluconacetobacter diazotrophicus
MVEKQTRTRESEEFLEDLAEELSVPPSRYEQADRSYMSLGDWLHRDASTVRQYGPKVYVQGSFRLGTTIRPLNDAEEYDVDSVCELQKLGKTSLTQQQLKTLLGAEIEAYRRAQNMNKPLREGRRCWVLDYADGAQFHMDIVPALPNGQAARLLLESRGYDARWTLTAIAITDKEGPTYTTVTDDWPRSNPKGYCEWFKSRMATALERRKRVLADSMRASVEDIPDYKVRTPLQAAIMILKRHRDHTFEHGGDERPISVIITTLAAHAYKGEETIGEALAVILAGMDQHILWHNNRYWIPNPTDPLENFADKWAEHPERATAFYEWLQKARTEFAAAARSSDRRVITEIVGRGVGGSMADRTARRRPPPPRSPLLKTASVAPVAEGLSFPDRSRVPTKPQGFGGAE

SEQ ID NO: 761 - protein, 405 aa, Agrobacterium sp.
MDKQTRTRESEEFLEDLAEELSVPPSRYEQAERSYKSLGDWLHRDASTVRQYGPKVYVQGSFRLGTTIRPANEAEEYDVDSVCELQKLGKSSLTQQQLKTLLGVEIEAYRNAQNMNKPLREGRRCWVLDYADDAQFHMDVVPAVPNGQGARILLESRGLDARWTTTAIAITDKEGATYAAVTDDWPRSNPKGYCEWFKSRMAAALERRKRMLAESVKASVEDIPDYKVRTPLQAAIMILKRHRDYTFAGRKEDRPISVIITTLAAHSYNGEETIGEALAVILAGMDKHILWHDNRYWIPNPTDPLENFADKWAEHPERATAFAEWLQKARTEFATAAHSSDRTVITETIGRGVGGSLADRAARRRQLPARSPLLKTASVAPATAGLSFPDKSRVPTKPQGFGGAE

SEQ ID NO: 762 - protein, 383 aa, Agrobacterium sp.
MPPSRYEQAERSYKSLGDWLHRDASTVRQYGPKVYVQGSFRLGTTIRPANEAEEYDVDSVCELQKLGKSSLTQQQLKTLLGVEIEAYRNAQNMNKPLREGRRCWVLDYADDAQFHMDVVPAVPNGQGARILLESRGLDARWTTTAIAITDKEGATYAAVTDDWPRSNPKGYCEWFKSRMAAALERRKRMLAESVKASVEDIPDYKVRTPLQAAIMILKRHRDYTFAGRKEDRPISVIITTLAAHSYNGEETIGEALAVILAGMDKHILWHDNRYWIPNPTDPLENFADKWAEHPERATAFAEWLQKARTEFATAAHSSDRTVITETIGRGVGGSLADRAARRRQLPARSPLLKTASVAPATAGLSFPDKSRVPTKPQGFGGAE

SEQ ID NO: 763 - protein, 411 aa, Paracoccus solventivorans
MFGKASVKKPDLSPQSEEYLEDLAEELSVPTSRYEQAERSYKSLGDWLHREDSTVREHDPQVYVQGSFRLGTTIRPSNEDEEYDIDSVCELRKLGKGELSQQRLKQLLGAEIEAYRRAKSMNKPLREGRRCWALDYADGAQFHMDVVPALPDAASVRSLLESRGVDARWASTAIAITDNQVWSYPYVTDEWPRSNPKGYGEWFRSRMAVALERRKRWLAEQVRASIEDIPDYRVRTPLQAAVMILKRHRDHVFADRPDVRPISVIVTTLSAHSYGGEDTVGQALASILAGMDKYIQQRAGQYWIPNPTDELENFADKWAEHPERAQAFFDWLDRARSDFLRAAGSTDRKVITETWERGVGSELADRAYRRRQPPARPTLLKVASVAPPGAALSFPNKERVPTKPQGFGGAA

SEQ ID NO: 764 - protein, 385 aa, Paracoccus solventivorans
MSVPTSRYEQAERSYKSLGDWLHREDSTVREHDPQVYVQGSFRLGTTIRPSNEDEEYDIDSVCELRKLGKGELSQQRLKQLLGAEIEAYRRAKSMNKPLREGRRCWALDYADGAQFHMDVVPALPDAASVRSLLESRGVDARWASTAIAITDNQVWSYPYVTDEWPRSNPKGYGEWFRSRMAVALERRKRWLAEQVRASIEDIPDYRVRTPLQAAVMILKRHRDHVFADRPDVRPISVIVTTLSAHSYGGEDTVGQALASILAGMDKYIQQRAGQYWIPNPTDELENFADKWAEHPERAQAFFDWLDRARSDFLRAAGSTDRKVITETWERGVGSELADRAYRRRQPPARPTLLKVASVAPPGAALSFPNKERVPTKPQGFGGAA

SEQ ID NO: 765 - protein, 402 aa, Methylobacterium sp.
MATLTRESEDFLEDLAEELSVPVSRYEQAERSYKSLGEWLHRDASTVREYGPQVYVQGSFRLGTTIRPLTEAENYDIDSVCELKKISKSHLSQKDLKELLGKEIKSYHDAQNMIKPVGEGRRCWVLEYADGAQFHMDIVPALPNAQSVRLFLEQSGHDARWTGTAIAITDNEVPTYPFVTDHWPHSNPKGYSDWFRSRTVVILERRKRKLAERIHASVEEIPDYKVRTPLQAAVMILKRHRDETFRDRPAVKPISVIITTLAAHAYNGEETTGRALVSILNGMDEHIAVVGGRHWIANPTDPLENFADKWEKHPERADAFFEWLARARHDFQQAARASDRIVIAEAVGQGVGKAVAERARQRRQSPVGSPLLKTASVAPAGIGFSFPDKERAPSKPQGFGEP

SEQ ID NO: 766 - protein, 382 aa, Methylobacterium sp.
MPVSRYEQAERSYKSLGEWLHRDASTVREYGPQVYVQGSFRLGTTIRPLTEAENYDIDSVCELKKISKSHLSQKDLKELLGKEIKSYHDAQNMIKPVGEGRRCWVLEYADGAQFHMDIVPALPNAQSVRLFLEQSGHDARWTGTAIAITDNEVPTYPFVTDHWPHSNPKGYSDWFRSRTVVILERRKRKLAERIHASVEEIPDYKVRTPLQAAVMILKRHRDETFRDRPAVKPISVIITTLAAHAYNGEETTGRALVSILNGMDEHIAVVGGRHWIANPTDPLENFADKWEKHPERADAFFEWLARARHDFQQAARASDRIVIAEAVGQGVGKAVAERARQRRQSPVGSPLLKTASVAPAGIGFSFPDKERAPSKPQGFGEP

SEQ ID NO: 767 - protein, 382 aa, Methylobacterium sp.
MPESRYEQAERSYKSLGEWLHRPASTVRQYDPQVYVQGSFRLGTTIRPLTEAEEYDIDSVCELRKLGKSQLSQQTLKAMLGREIEAYHDAQSMTKPVREGRRCWVLDYADGAQFHMDIVPALPNERSVRLLLEARGHDPKWSKTAIAITDREVPTYTVVTDEWPRSNPKAYADWFRGRMAIALERRKRKLAERVHASVEEIPDHKVRTPLQAAVMILKRHRDHMFEKRPDVRPISIIVTTLAAHAYGSEETTGQALIAILEGMDAHISETGGRYSIPNPTDPLENFADKWEKHPERAEAFFEWLGQARRDFGQAAQTTDRQVITASVGRGVGTSIAERARKRRQPSLGSPLLRTASVAPAGAGFSFPDKQRAPSKPQGFGAA

SEQ ID NO: 768 - protein, 404 aa, Pusillimonas sp.
MTGTDQQLEGFLQALVEELVIPESRYEQAERSYKSLGDWFHRHESRIRDFNPVVYVQGSFRLGTAIRPINDAEEYDIDSVCELKNLTKNDLTQSDLKQLLGREVQAYHDAKGMTKPVREGRRCWILSYADGAQFHMDILPALPNGMEQRLLLERAQFDPQWTDWAIAITDRDVSTYQERTSDWPRSNPKGYGKWFRSRMASILFQRKQILVESLKRRGITASIEQLPDYRVRTPLQAAVMLLKRHRDNMFASKIDVKPISVIITTLAGHSYGEQDTIAGALFSILRDMHLHIDNDGTKYIIANPTDPLENFADRWEKEPQKARAFFQWLEQARQDFGRAAQATTLQNMNEAVSIHMGTALTDRAVEKFRANSGGLLRAASIAPVAAVPTFGSAPRVPTTPKGFA

SEQ ID NO: 769 - protein, 406 aa, Unknown
  Description of Unknown: Rhizobiales sequence
MAGTDDQVERFLQAMAEELAIPESRYEQAERSYRSLGDWFHRPESTVRNFDPTVYVQGSFRLGTAIRPINDSEEYDVDSVCELKKLAKGDLTQFDLKQLLGFEIKAYHDAKGMTKPVEEGRRCWVLSYADGAQFHMDIVPALPNGMEQRLLLERAHFDVRWADTAIAITDREVPTYRQKTYDWPRSNPKGYGEWFKSRMAVVLARRKRELVESLRQRGVTASVEQLPDFRVRTPLQAAVMILKRHRDNMFAHEADLKPISVIITTLSGHAYGQEDTIAGALFSILNAMDRYIQHDGSKFIIPNPTDPFENFADKWEKNPRKAEAFFRWLNQAREDFGRAARAATLQGMNEAVSARMGAALSDRATRRIGGGSGLLRAASVAPIAPVAAIPSFGNAARVPTTPKGFA

SEQ ID NO: 770 - protein, 406 aa, Rhizobium sp.
MAGTDDQVERFLQAMAEELAIPESRYEQAERSYRSLGDWFHRPESTVRNFDPTVYVQGSFRLGTAIRPINDSEEYDVDSVCELKKLAKGDLTQFDLKQLLGFEIKAYHDAKGMTKPVEEGRRCWVLSYADGAQFHMDIVPALPNGMEQRLLLERAHFDVRWADTAIAITDREVPTYRQKTYDWPRSNPKGYGEWFKSRMAVVLARRKRELVESLRQRGVTASVEQLPDFRVRTPLQAAVMILKRHRDNMFAQEADLKPISVIITTLSGHAYGQEDTIAGALFSILNAMDRYIQHDGSKFIIPNPTDPFENFADKWEKNPRKAEAFFRWLNQAREDFGRAARAATLQGMNEAVSARMGAALSDRATRRIGGGSGLLRAASVAPIAPVAAIPSFGNAARVPTTPKGFA

SEQ ID NO: 771 - protein, 406 aa, Aminobacter sp.
MAGTDDQVERFLQAMAEELAIPESRYEQAERSYKSLGDWFHRPESTVRNFDPTVYVQGSFRLGTAIRPINDSEEYDVDSVCELKKLAKGDLTQFDLKQLLGYEIKAYHDAKGMTKPVEEGRRCWVLSYADGAQFHMDIVPALPNGMEQRLLLERAHFDVRWADTAIAITDREVPTYRQKTYDWPRSNPKGYGEWFKSRMAVVLARRKRELVESLRQRGVTASVEQLPDFRVRTPLQAAVMILKRHRDNMFAQEADLKPISVIITTLSGHAYGQEDTIAGALFSILNGMDRYIQHDGSKFIIPNPTDPFENFADKWEKNPRKAEAFFRWLNQAREDFGRAARAATLQGMNEAVSARMGAALSDRATRRIGGGSGLLRAASVAPIAPVAAIPSFGNAARVPTTPKGFA

SEQ ID NO: 772 - protein, 406 aa, Unknown
  Description of Unknown: Rhizobium/Agrobacterium group sequence
MAGTDDQVERFLQAMAEELAIPESRYEQAERSYKSLGDWFHRPESTVRNFDPTAYVQGSFRLGTAIRPINDSEEYDVDSVCELKKLAKGDLTQFDLKQLLGYEIKAYHDAKGMTKPVEEGRRCWVLSYADGAQFHMDIVPALPNGMEQRLLLERAHFDVRWADTAIAITDREVPTYRQKTYDWPRSNPKGYGEWFKSRMAVVLARRKRELVESLRQRGVTASVEQLPDFRVRTPLQAAVMILKRHRDNMFAQEADLKPISVIITTLSGHAYVQEDTIAGALFSILNGMDRYIQHDGSKFIIPNPTDPFENFADKWEKNPRKAEAFFRWLNQAREDFGRAARAATLQGMNEAVSARMGAALSDRATRRIGGGGGLLRAASVAPIAPVAAIPSFGNAARVPTTPKGFA

SEQ ID NO: 773 - protein, 400 aa, Sinorhizobium meliloti
MTVIPHVEPFLEALVEELAIPESRYRQAETSYKTLGDWFHREESTVREFGPNVYSQGSFRLGTAIRPRTEAEEYDVDSVCELNFLGKVDITQAKLKAMIGEEIKAHHKAQSMIKPVREGRRCWILDYADGAQFHMDVVPALPNGVDQRLLLEARSLDTRWASTAIAITDVEDPAYLVPTMDWPRSNPKGYSEWFKWRMEAVLQRRKHALAENLRQKGIAASVEELPDYRVRTPLQSSVMLLKRHRDNMFAHNTDVRPISVIITTLAAHAYDNQDTIADALSVILSRMHQFIGHDGQKYVVPNPTDPLENFADKWETEPGKADAFFQWLEQARSDFGRASEATTFQKMNEAVAQRMGPVLTAKAVNRAGGGLLRSATVAPAAATPSFANTPRTPTTPKGFA

SEQ ID NO: 774 - protein, 402 aa, Rhizobium nepotum
MHVNSIEAFLDALRQELEVPDHRYEQAERSYTSLANWLHRDGSTVSRYDPQVYCQGSFRLGTAIRPHTEAEEYDVDSVVELRLLTKREKTQYQLKLMLGAEIHAYHDAMDMLKPVREGNRCWILDYADGAQFHMDIVPAVPNHNQHYMLLNSLSLDTRWASTAISITDRREPNYKLLTDTWPRSNPKGYASWFASRQAIVFERRHRVALDNMRKQGLITASVEHLPTFKVKTPLQSAIMILKRHRDNMFARDLDMRPISVIITTLAAHAYNNQDTISGALFAILNDMDKFIVHDGIRWIVANPTDPLENFADKWNREPQKKAAFDAWLRQARIDFHAAAQASTLKDMADALNPRMGYALSMRAMDRLTGGSRLLRSATTAGAATAPSFANAERRPSKPQGYA

SEQ ID NO: 775 - protein, 402 aa, Rhizobium nepotum; identical to SEQ ID NO: 774

SEQ ID NO: 776 - protein, 407 aa, Rhizobium sp.
MHVNSIETFLEALRQELEVPDHRYEQAERSYTSLANWLHRDDSSVRQYDPQVYCQGSFRLGTAIRPHTDAEEYDVDSVVELRLLTKREKTQYQLKLMLGAEIRAYHDAMGMLKPVREGNRCWILDYADGAQFHMDIVPAVPNHNQQYMLLSSLSLDTRWASTAISITDRREQNYKILSDAWPRSNPKGFASWFVSRQAIVFERRHRAALDAMRRHGLITASVERLPTFKVKTPLQSAIMILKRHRDNMFARELEMRPISVIITTLAAHAYNNQDTIAGALFAILNDMDKFIGHDGVNWIVANPTDPFENFADKWNRQPQKKVAFDNWLRQARVDFSAAAQAGTFKDMADALNPRMGYALSMRAMDRLTGGSRLLRSSTGVSVGAGGSLAAPSFSHAERRPSEPRGYA

SEQ ID NO: 777 - protein, 202 aa, Shinella sp.
MNMHVNIIEAFLEALVKELDVPDHRYEQAETSYSSLGEWLHRPASTVRQYDPQVYCQGSFRLGTAIRPHTEAEEYDVDSVVELRLLTKSDKTQQELKAMLGAEIKAYHDAMAMVKPVREGNRCWILDYADGAQFHMDVVPAVPNHEQQLRLLNARMLNTKWGDVTLLGNDGKKRVGGNSDQFGCHSIPLRRCADTVNVSGES

SEQ ID NO: 778 - protein, 407 aa, Rhizobium mesoamericanum
MNVHVNTIEAFLEAVIAELEIPEHRYEQADRSFKSFGEWLHREESSVRLFDPQVYCQGSFRLGTAIRPLTEDEEYDVDSVCEFRLLTKEHLSQFALKQMLGAEVRSYHDAKGMTKPVREGNRCWILDYADGAQFHMDIVPALPNAAEQKRLLNAIMHDARWSETAISITDRRLPNYKEKTDFWPRSNPKGYSNWFASRQAEVLVRRKRAKAEALNRQGFRASVEDIPDFKVKTPLQSAIMILKRHRDNMFAREPDIRPISVIITTLAAHAYEGQETISGALFAILQRMDQFIRHDGQKYVITNPTDPYENFADKWQAEPEKAEAFFRWLRTARANFNAAAQAVSFQEMADALTPRMGYRLSTKAVDRLTGGNRLLRAASGASAGAAGTTAPSFANAARQPTKPQGYA

SEQ ID NO: 779 - protein, 407 aa, Sinorhizobium saheli
MNVHVNTIEAFLEAVIAELEIPEHRYEQADRSFKSFGEWLHREESSVRLFDPQVYCQGSFRLGTAIRPLTEDEEYDVDSVCEFRLLTKEHLSQFALKQMLDAEVRSYHDAKGMTKPVREGNRCWILDYADGAQFHMDIVPALPNAAEQKRLLNAIMHDARWSETAISITDRRLPNYKERTDFWPRSNPKGYSNWFASRQAEVLVRRKRAKAEALNRQGFRASVEDIPDFKVKTPLQSAIMILKRHRDNMFAREPDTRPISVIITTLAAHAYEGQETISGALFAILQRMDQFIRHDGQKYVIANPTDPYENFADKWQAEPEKAEAFFRWLHTARADFNAAAQAVSFQEMADALTPRMGYRLSTKAVDRLTGGNRLLRAASGASAGAAGTTAPSFANAARQPTKPQGYA

SEQ ID NO: 780 - protein, 407 aa, Rhizobium sp.
MNVHVNTIEAFLEALIAELEIPEHRYEQADRSFKSFGEWLHREESSVRLFDPQVYCQGSFRLGTAIRPLTEEEEYDVDSVCEFRLLTKQHLSQFALKQMLGAEVRSYHDAKAMTKPVREGNRCWILDYADGAQFHMDIVPALPNSAEQKRLLDAIMHDGRWSETAISITDRRLPNYKEKTDFWPRSNPKGYSNWFASRQAEVLVRRKRAKAEALNRQGFRASVEDIPDFKVKTPLQSAVMILKRHRDNMFAREPDIRPISVIITTLAAHAYEGQETISGALFAILQRMDQFIQHDGQKYVIANPTDPYENFADKWQAEPEKADAFFRWLRTARADFNAAAQAVSFQEMADALTPRMGYRLSTKAVDRLTGGNRLLRAASGASAGAAAATAPSFANAARQPTKPQGYA

SEQ ID NO: 781 - protein, 407 aa, Rhizobium phaseoli
MNVHVNTIEAFLEALIAELEIPEHRYDQADRSFKSFGEWLHREGSSVRHLDPQVYCQGSFRLGTAIRPLTEDEEYDVDSVCEFRLLTKQHLSQNQLKLLLGAEVKAYHDAQAMTKPVREGNRCWILDYADGAQFHMDIVPALPNAAEQKRLLDTIMHDARWSETAISITDRRLPNYMEKTDFWPRSNPKGYSNWFASRQAEVLVRHKRAKAEALNRQGFRASVEDIPDFKVKTPLQSAIMILKRHRDNMFAREPDIRPISVIITTLAAHAYEGQETISGALFAILQRMDQFIQHDGQKYVIANPTDPYENFADKWQAAPENAEAFFRWLCTARADFNAAAQAVSVQEMADALTPRMGYRLSTKAVDRLTGGNRLLRAASGASAGAAAATAPSFANAARQPTKPQGYA

SEQ ID NO: 782 - protein, 407 aa, Rhizobium vignae
MNVHVNTIEAFLEALIAELEIPEHRYDQADRSFKSFGDWLHREGSSVRHFDPQVYCQGSFRLGTAIRPLTEDEEYDVDSVCEFRLLTKQHLSPFALKQLLGAEVKAYHDAQNMTKPVREGNRCWILDYADGAQFHMDIVPAIPNGVEQKRRLDAILHDARWSETAISITDRRLPNYMEKTEYWPRSNPKGFSSWFASRQSEVLIRRKRAKVEALNRQGFRASVEDMPDFKVKTPLQSAIMILKRHRDNMFAREPDVRPISVIITTLAAHAYEGQETISGALFAILQGMDQFIQHDGQKYVIANPTDPYENFADKWQAEPEKAEAFFRWLRTARADFNAAAQAVSFQEMADALTPRMGYRLSTKAVDRLTGGNRLLRAASGASAGAAATTAPSFANAARQPTKPQGYA

SEQ ID NO: 783 - protein, 401 aa, Novosphingobium sp.
MTTKSADEYLAALADALAISETRYDQACRSYASLGAWLHRPESTVLRYDPQIYVQGSFRLGTAIRPLNDEEEYDVDSVCELRLLGTGDLSQKALKKLVGDEIKAYRVAQSMVKPVTEGKRCWVLSYSDGAQFHMDIVPAVPNNSRQKLLLEARGLDTRWSETAIVITDVRSPTYEHISDDWQRSNPKGYAKWFQLRMGPIFERKRRAIAESVRASVEDIPEYRVRTPLQSAIMILKRHRDGMFVDRYDERPISVIITTLAAHAYNGEDKISDALYAILANMDRFIERDGRTLIIRNPSDPLENFADKWPTHPERQDAFFEWLAQARHDFGQLAQQVERRRLVESVVPRMGAIAEKAAARMDPPSGSMLRPAASAAIIGTGAASAPAFPNTRREPTSPKGFA

SEQ ID NO: 784 - protein, 401 aa, Novosphingobium sp.
MTTKSADEYLAALADALAISETRYDQACRSYASLGSWLHRPESTVLRYDPQIYVQGSFRLGTAIRPLNDEEEYDVDSVCELRLLGTGDLSQKALKKLVGDEIKAYRVAQSMVKPVTEGKRCWVLSYSDGAQFHMDIVPAVPNNSRQKLLLEARGLDTRWSETAIVITDVRSQTYEHIADDWQRSNPKGYAKWFQLRMGPIFERKRRAIAESVRASVEDIPEYRVRTPLQSAIMILKRHRDGMFIDRYDERPISVIITTLAAHAYNGEEKISDALYAILANMDRFIERDGRTLIIRNPSDPLENFADKWPTHPERQDAFFEWLAQARHDFGQLAQQVERRRLVESVAPRMGAIAEKAAARMDPASGSMLRPAVSAAIIGTGAASAPVFPNTRREPTSPKGFA

SEQ ID NO: 785 - protein, 401 aa, Acetobacter pasteurianus
MTTKSADEYLAALADALAISETRYDQACRSYASLGDWLHRPESTVLRYSPQIYVQGSFRLGTAIRPLNDEEEYDVDLVCELRLLGTGDISQKALKKLVGDEIKAYRVAQSMVKPVSEGKRCWVLSYSDGAQFHMDIVPAVPNNSRQKLLLEAYGLDTCWSETAIVITDVRSSTYEFISDDWQRSNPKGYAKWFQLRMGPIFERKRRAMAESVRASVEDIPEYRVRTPLQSAIMILKRHRDGMFVDRYNERPISVIITTLAAHAYNGEEKISDALYAILANMDRFIEHDGRTLIIRNPSDPLENFADKWPTHPERQAAFFEWLAQARNDFGQLSQQVERRRLVESVAPRMGAIAEKAAARLDPPSSSMLRPAASAAIIGTGAASAPAFPNTRREPTSPKGFA

SEQ ID NO: 786 - protein, 401 aa, Pseudomonas stutzeri
MPTKAAEDFLTALAEELAISESRYEQASRSYGSLGVWLHRADSTVAQYDPQIYVQGSFRLGTAIRPLNDEEEYDVDSVCLLRNLGTTDLTQSQLKTLVGKEIEAYRVAQNMVKPVREGRRCWILEYADGAQFHMDIVPSVPNATRQRLLLEARGLDLKWSETAMVITDIESPVYEQLSDDWPRSNPKGYAEWFKLRMGDLFERRRRMVAESIRASVEDIPDYKVKTPLQSAIMILKRHRDGMFEDRYEERPISIIITTLAAHAYNGEETIAAALYSILSRMDQFIEPDGQHFIIRNPSDPLENFADKWPAHPERQAAFFEWLMQARLDFKTLADQVERRRLIESIQPRMGAVADRAAVRLGPSPGSMLQPASAAAATVAATTSAPAFPNTPREPTTPRGFA

SEQ ID NO: 787 - protein, 401 aa, Pseudomonas stutzeri
MPTKAAEDFLTALAEELAISESRYEQASRSYGSLGVWLHRADSTVAQYDPQVYVQGSFRLGTAIRPLNDEEEYDVDSVCLLRNLGTTDLTQSQLKALVGKEIEAYRVAQNMVKPVREGRRCWILEYADGAQFHMDIVPSVPNATRQRLLLEARGLDLKWSETAMVITDIESPVYEQLSDDWPRSNPKGYAEWFKLRMGDLFERRRRMVAESIRASVEDIPDYKVKTPLQSAIMILKRHRDGMFEDRYEERPISIIITTLAAHAYNGEETIAAALYSILSRMDQFIEPDGQHFIIRNPSDPLENFADKWPAHPERQAAFFEWLMQARLDFKTLADQVERRRLIESIQPRMGAVADRAAVRLGPSPGSMLQPASAAAATVAATTSAPAFPNTPREPTTPRGFA

SEQ ID NO: 788 - protein, 401 aa, Pseudomonas yangmingensis
MPTKAAEDFLAALAEELAISESRYEQASRSYGALGVWLHRADSTVAQYDPQVYVQGSFLLGTAIRPLNDEEEYDVDSVCLLRNLGTTDLTQSQLKALVGKEIKAYRVAQNMVKPVREGRRCWILDYADGAQFHMDIVPSVPNATRQRLLLEARGLDLKWSETAMVITDIESPVYEQLSDDWPRSNPKGYAEWFKQRMGELFERRRQMVAESIKASVEDIPDYKVKTPLQSAIMILKRHRDGMFEDRYEERPISIIITTLAAHAYNGEETIAAALYSILSRMDQFIEPDGQHFIIRNPSDPLENFADKWPAHPERQAAFFEWLKQARQDFKTLADQVERRRLIESIQPHMGAVADRAAVRLGPPPGSMLQPATAAAAAAVATTSAPAFPNTPREPTTPRGFA

SEQ ID NO: 789 - protein, 401 aa, Pseudomonas sp.
MPTKTAEDFLAALADELAISESRYEQARRSYASLGDWLHRPESTVVKYDPQVYVQGSFRLGTAIRPLNDEEEYDVDSVCLLRTLGTKDLTQSELKTLVGDEIKAYRSAQSMIKPVREGRRCWVLDYADGAQFHMDIVPSVPNAARQRRLLEIRGLDLKWSETAMVITDIESPVYGVLSDDWQRSNPKGYAEWFRQRMGELFERRRRVLAESIKARVEDIPDYRIRTPLQSAIMILKRHRDGMFEGRYDERPISIIITTLSAHAYNGEEKIADALYSILSRMDQFIEHDGYHCIIRNPSDPLENFADKWPEHPEREAAFFEWLRQARQDFETLAGQVERRRLIESIQPRMGAVADRAAIRLGPPPGTMLNPATTAAAVGAAAASSPVFPNTRREPTSPKGFA

SEQ ID NO: 790 - protein, 401 aa, Pseudomonas sp.
MPTKTAEDFLAALADELAISESRYEQARRSYASLGDWLHRPESTVVKYDPQVYVQGSFRLGTAIRPLNDEEEYDVDSVCLLRTLGTKDLTQSELKTLVGDEIKAYRNAQSMIKPVREGRRCWVLDYADGAQFHMDIVPSVPNAARQRLLLETRGLDLKWSETAMVITDIESPVYKVLSDDWQRSNPKGYAEWFRQRMGELFERRRRELAESIKASVEDIPDYRIRTPLQSAIMILKRHRDGMFEGRYDERPISIIITTLAAHAYNGEEKIADALYSILSRMDQFIEHDGNHCIIRNPSDPLENFADKWPEHPERELAFFEWLQQARQDFETLAGQVERRRLIESIQPRMGAVADRAALRLGPPPGTMLHPATAAAAVGSAAASTPVFPNTRREPTSPRGFA

SEQ ID NO: 791 - protein, 401 aa, Pseudomonas fulva
MPTKTAEDFLAALADELAISESRYEQARRSYASLGDWLHRSESTVVEYDPQVYVQGSFRLGTAIRPLNDEEEYDVDSVCLLRTLGTKDLSQSKLKALVGDEIKAYRNAQSMVKPVREGRRCWVLDYADGAQFHMDIVPSIPNAARQRLLLEAQGLDLKWSETAMVITDIESPVYEVLSDDWQRSNPKGYAEWFRQRMGEQFERRRRALAESIKASVEDIPDYRIRTPLQSAIMILKRHRDGMFEGRYDERPISIIITTLAAHAYNGEEKIADALYSILSRMDQFVEHDGHHCIIRNPSDPLENFADKWPEHPEREAAFFEWLRQARQDFETLAGQVERRRLIESIQPRMGAVAERAAMRLEPPPGTMLHPATAAALVGAAAASAPVFPNTRREPTSPRGFA

SEQ ID NO: 792 - protein, 401 aa, Pseudomonas sp.
MPTKTAEDFLAALADELAISESRYEQARRSYASLGDWLHRSESTVVKYDPQVYVQGSFRLGTAIRPLNDEEEYDVDSVCLLRTLGTKDLTQSELKALVGDEIKAYRNAQSMIKPVREGRRCWVLDYADGAQFHMDIVPSVPNAARQRLLLEARGLDLKWSETAMVITDIESSVYEVLSDDWQRSNPKGYAEWFRQRMGEQFERRRRALAESIKASVEDIPDYRIRTPLQSAIMILKRHRDGMFEGRYDERPISIIITTLAAHAYNGEEKIADALYSILSRMDQFVEHDGHHCIIRNPSDPLENFADKWPQHPEREAAFFEWLRQARQDFETLAGQVERRRLIESIQPRMGAVAERAAMRLEPPPGTMLHPATAAAVVGAAAASAPVFPNTRREPTSPRGFA

SEQ ID NO: 793 - protein, 401 aa, Pseudomonas syringae
MSTKTAEDFLAALADELAISESRYEQARRSYASLGDWLHRSESTVVKYDPQVYVQGSFRLGTAIRPLNDEEEYDVDSVCLLRTLGTKDLTQSELKALVGDEIKAYRNAQSMIKPVREGRRCWVLDYADGAQFHMDIVPSVPNAARQRLLLEASGLDLKWSETAMVITDIESSVYEVLSDDWQRSNPKGYAEWFRQRMGEQFERRRRALAESIKVSVEDIPDYRVRTPLLSAIMILKRHRDGMFEGRYDERPISIIITTLAAHAYNGEEKIADALYSILSRMDQFVEHDGHHCIIRNPSDPLENFADKWPEHPEREAAFFEWLRQARQDFETLAGQVERRRLIESIQPRMGAVAERAAMRLEPPPGTMLHPATAAAVVGAAAASAPVFPNTRREPTSPRGFA

SEQ ID NO: 794 - protein, 400 aa, Pseudomonas lundensis
MPTQTAEDYLAALADELAISEARYDQACRSYESLGAWLHRAESTVVGHDPQIYVQGSFRLGTAIRPLSDEEEYDVDSVCLLRLGTGDLTQKQLKSLVGDEVKAYRNSQNMVKPVTEGRRCWVLAYADGAQFHMDIVPAIPNATRQRLQLEARGLDLKWSETALVITDIRSPVYEMISNDWQRSNPKGYAEWFRQRMGSVFEKRRRVLAESIKASVEDIPDYKIRTPLQSAIMILKRHRDGMFVGRYDERPISIIITTLAAHAYNGEEKIADALFSILSRMDQFIEYDGHNRIIRNPSDPLENFADKWPQHPEREAAYFEWLGQARHDFGELAEQVERRRLIESIQPRMGAVAERAAARLGPPPGSMLRPATAAAALGAVASSAPVFPNTRREPTSPKGFA

SEQ ID NO: 795 - protein, 400 aa, Pseudomonas chlororaphis
MPTKTAEDFLAALADELAISESRYDQARRSYASLGDWLHRPESTVLAYDPQVYVQGSFRLGTAIRPLNDEEEYDVDSVCLLRFLGTRDLTQAQLKELVGNEIKAYRRAQNMVKPVREGRRCWVLDYADGAQFHMDIVPAVPNAERQRLLLEARNLDLKWSETAMVITDLESPVYHVVSDDWQRSNPKGYTEWFKGRMGEVFERRKRALAESIRASVEDIPDYKVRTPLQSAIMILKRHRDGMFEGRYDERPISIIITTLAAHAYNGEEKIADALYAILSRMHDFIEHDGSHCIIRNPSDPLENFADKWPVHPEREVAFFEWLHQARQDFEKLAGQVERRGLIESVQPRMGAAVERAATRLGPLPGSMLSPASAAVAIASAASAPAFPNTRREPTSPRGFA

SEQ ID NO: 796 - protein, 400 aa, Unknown
  Description of Unknown: Pseudomonas sequence
MPTKTAEDFLAALADELAISESRYDQARRSYASLGDWLHRPESTVLAYDPQVYVQGSFRLGTAIRPLNDEEEYDVDSVCLLRFLGTRDLTQAQLKELVGNEIKAYRRAQNMVKPVREGRRCWVLDYADGAQFHMDIVPAVPNAERQRLLLEARNLDLKWSETAMVITDLESPVYHVVSDDWQRSNPKGYAEWFKGRMGEVFERRKRALAESIRASVEDIPDYKVRTPLQSAIMILKRHRDGMFEGRYDERPISIIITTLAAHAYNGEEKIADALYAILSRMHDFIEHDGSHCIIRNPSDPLENFADKWPVHPEREVAFFEWLHQARQDFEKLAGQVERRRLIESVQPRMGAAVERAATRLGPLPGSMLSPASAAAAIASTASAPAFPNTRREPTSPRGFA

SEQ ID NO: 797 - protein, 400 aa, Pseudomonas syringae
MPTKTAEDFLVALADELAISESRYDQARRSYASLGDWLHRPESTVLAYDPQVYVQGSFRLGTAIRPLNDEEEYDVDSVCLLRFLGTRDLTQAQLKELVGNEIKAYRRAQNMVKPVREGRRCWVLDYADGAQFHMDIVPAVPNAERQRLLLEARNLDLKWSETAMVITDLESPVYHVVSDDWQRSNPKGYAEWFKGRMGEVFERRKRALAESIRASVEDIPDYKVRTPLQSAIMILKRHRDGMFEGRYDERPISIIITTLAAHAYNGEEMIADALYAILSRMHDFIEHDGSHCIIRNPSDPLENFADKWPVHPEREVAFFEWLHQARQDFEKLAGQVERRRLIESVQPRMGAAVERAATRLGPLPGSMLSPASAAAAIASAASAPAFPNTRREPTSPRGFA

SEQ ID NO: 798 - protein, 400 aa, Pseudomonas syringae
MPTKTAEDFLAALADELAISESRYDQARRSYASLGDWLHRPESTVLAYDPQVYVQGSFRLGTAIRPLNDEEEYDVDSVCLLRFLGTRDLTQAQLKELVGNEIKAYRRAQNMVKPVREGRRCWVLDYADGAQFHMDIVPAVPNAERQRLLLEARNLDLKWSETAMVITDLESPVYHVVSDDWQRSNPKGYAEWFKGRMGEVFERRKRALAESIRASVEDIPDYKVRTPLQSAIMILKRHRDGMFEGRYDERPISIIITTLAAHAYNGEEMIADALYAILSRMHDFIEHDGSHCIIRNPSDPLENFADKWPVHPEREVAFFEWLHQARQDFEKLAGQVERRRLIESVQPRMGAAVERAATRLGPLPGSMLSPASAAAAIASAASAPAFPNTRREPTSPRGFA

SEQ ID NO: 799 - protein, 400 aa, Pseudomonas sp.
MPTKTAEDFLAALADELAISESRYDQARRSYASLGDWLHRPESTVLAYDPQVYVQGSFRLGTAIRPLNDEEEYDVDSVCLLRFLGARDLTQAQLKELVGNEIKAYRRAQNMVKPVREGRRCWVLDYADGAQFHMDIVPAVPNAERQRLLLEARNLDLKWSETAMVITDLESPVYHVVSDDWQRSNPKGYAEWFKGRMGEVFERRKRALAESIRASVEDIPDYKVRTPLQSAIMILKRHRDGMFEGRYDERPISIIITTLAAHAYNGEEKIADALYAILSRMHDFIEHDGSHCIIRNPSDPLENFADKWPVHPEREVAFFEWLHQARQDFEKLAGQVERRRLIESVQPRMGAAVERAATRLGPLPGSMLSPASAAAAIASTASAPAFPNTRREPTSPRGFA

SEQ ID NO: 800 - protein, 400 aa, Pseudomonas aeruginosa
MPTKTAEDFLAALADELAISESRYDQARRSYASLGDWLHRPESTVLAYDPQVYVQGSFRLGTAIRPLNDEEEYDVDSVCLLRFLGTRDLTQAQLKELVGNEIKAYHRAQNMVKPVREGRRCWVLDYADGAQFHMDIIPAVPNAERQRLLLEARNLDLKWSETAMVITDLESPVYHVVSDDWQRSNPKGYAEWFKGRMGEVFERRKRALAESIKASVEDIPDYKVRTPLQSAIMILKRHRDGMFEGRYDERPISIIITTLAAHAYNGEEKIADALYAVLSRMHDFIEHDGSHCIIRNPSDPLENFADKWPVHPEREVAFFEWLHQARRDFEKLAGQVERRRLIESVQPRMGAAVERAATRLGPLPGSMLSPASAAAAIASAASVPAFPNTRREPTSPRGFA

SEQ ID NO: 801 - protein, 399 aa, Pseudomonas geniculata
MPTKTAEDFLAALADELAISESRYEQARRSYASLGDWLHRPESSVLEYDPQVYVQGSFRLGTAIRPLNDDEEYDVDSVCVLRFLGTRSLTQAQLKELVGNEVKAYRKAQNMVKPVREGRRCWVLDYADGAQFHMDIVPAVPNAERQRILLEARSLDLKWSETAMVITDLESPVYHVLSDDWQRSNPKGYAEWFKGRMGEVFERRKRALAESIKASVEDIPDYKVRTPLQSAIMILKRHRDGMFEGRYDERPISVIITTLAAHAYNGEEKIADALYAILSRMHEFIEHDGSHCIIRNPSDPLENFADKWPIHPEREAAFFEWLRQARQDFGKLAEQVERRRLIESVQPRMGAAVERAATRLGPLPGSMLSPASAAAAIAAASAPAFPNTRREPTSPRGFA

SEQ ID NO: 802 - protein, 401 aa, Unknown
  Description of Unknown: Enterobacteriaceae sequence
MPTKNAEDFLTALAEELAISDSRYEQACRSYTSLGEWLHRPESAVAKYDPQVYVQGSFRLGTAIRPLNDAEEYDVDSVCLLQSLGTKDLTQCNLKTLVGDEIKAYRKAQNMVKPVREGRRCWVLDYADGAQFHMDVVPSLPNATQQRILLETFGYDLKWSETAMVITDIESPVYQVLSDNWQRSNPKGYAEWFKMRMRDVFEQRRKMLAESIKASVEEIPDYKVRTPLQSAIMILKRHRDGMFEKRYDERPISIIITTLAAHAYNGEVKIADALYSILSRMDSFIERDGDRYIIRNPSDPLENFADKWPNHPERKDAFYEWLDQARQDFGNLAHQIEKRRLVESVRPHMGAVADRAATRLSPTPGSMLQPATGVAALGVAAASTPAFPNTRREPTSPKGFA

SEQ ID NO: 803 - protein, 401 aa, Pectobacterium polaris
MPTKNAEDFLTALAEELAISDSRYEQACRSYTSLGEWLHRPESAVAKYDPQVYVQGSFRLGTAIRPLNDAEEYDVDSVCLLQSLGTKDLTQSNLKTLVGDEIKAYRKAQNMVKPVREGRRCWVLDYADGAQFHMDVVPSLPNATQQRILLETYGYDLKWSETAMVITDLESPVYQVLSDDWQRSNPKGYAEWFKLRMRDVFEQRRKMLAESIKASVEEIPDYKVRTPLQSAIMILKRHRDGMFEKRYDERPISIIITTLAAHAYNGEVKIADALYSILSRMDSFIERDGNRYIIRNPSDPLENFADKWPNHPERKDAFYEWLNRARQDFGNLAHQIEKRRLVESVQPHMGAVADRAATRLSPTPGSMLQPATGVAALGVAAASTPAFPNTRREPTSPKGFA

SEQ ID NO: 804 - protein, 401 aa, Enterobacter cloacae
MPTKNAEEFLTALADELTISESRYEQACRSYTSLGEWLHRPESAVAQYEPQVYVQGSFRLGTAIRPLNDAEEYDVDSVCLLQNLSTKDLTQSDLKTLVGNEIKAYHKAQNMVKPVREGRRCWVLDYADGAQFHMDVVPSLPNAARQRMLLETYGFDLKWSETAMVITDIESPVYHALSDDWQRSNPKGYAEWFKLRMRDVFERRRKVLAESMKASVEDIPDYKVRTPLQSAIMILKRHRDGMFEKRYDERPISIIITTLAAHAYNGEDKIADALYSILARMDSFIEHDGYRCIISNPSDPFENFADKWPLHPEREAAFFEWLRQARQDFGNLASQIEKRSLVESVRRNMGAVADRAAIRLGPPPGSMLQPVSTIAALGTATVSTPAFPNTRREPTSPKGFA

SEQ ID NO: 805 - protein, 401 aa, Serratia sp.
MPTKNAEDFLTALADELAISESRYEQACRSYTSLGEWLHRPESTVVQYDPQVYVQGSFRLGTAIRPLNDAEEYDVDSVCLLQSLSTKDLTQSDLKTLVGDEIKAYRTAQNMVKPVREGRRCWVLDYADGAQFHMDVVPSLPNAARQRMLLETYGFDLKWSETAMVITDIESPVYHAFSDDWQRSNPKGYAEWFKLRMRDVFERRRKVLAESMKASVEDIPDYKVRTPLQSAIMILKRHRDGMFEKRYDERPISVIITTLAAHSYNGEDNIADALYSILARMDSFIERNGYRCIIRNPSDPLENFADKWPQHPEREAAFFEWLQQARQDFGNLANQIEKRSLVESVRPHMGVVADRAAIRLGPPPGSMLQPASTIAALGTAAVSTPAFPNTRREPTSPKGFA

SEQ ID NO: 806 - protein, 401 aa, Variovorax sp.
MPTKAAEEYLAALADELAISETRYEQASRSYASLGEWLHRPESTVLRYNPQVYVQGSFRLGTAIRPLSDDEEYDVDSVCVLEYLSTSDLTQQQLKTLVGEEIKAYRQSQNMVKPVREGRRCWVLSYADGAQFHMDIVPSVPNAARQRLLLEARGLDLRWSESAIVITDIHSPVYEYMSDDWPRSNPKGYAEWFKLRMGALFEQRRRQLAESIRASVEDIPVYRVRTPLQSAIMILKRHRDGMFLGRYDERPISIIITTLAAHAYSGEEKIADALYSILARMDQFIEWDGRQHIIRNPSDPLENFADKWPFHPERQEAFFQWLAQARYDFGELAGHVERRRLIESVQPRIGAAADRAAARLGPPPTSMLNPAVAAAAAGTAASSALAFPNTRREPTSPKGFA

SEQ ID NO: 807 - protein, 403 aa, Mesorhizobium sp.
MVTITKEAEGFLEALADELTISPTRHEQAVARYESLGKWLHRDASKVKQYDPQVYSQGSFRLGTVVKPEDESGHYDIDSVCELTALTKGQLTQYTLKELLRVEIEAYRTAQAMVKPLGEGRRCWTLEYADGAQFHMDIVPALPNGAATRLLLESRGLDAQWAGTAIAITDNKHPLFYQPTTDWPRSNPKGYANWFRSRMAVAFSRKRRKLAEAAQASVESIPEYRVVTPLQQAIMILKRHRDQMFAERKDVKPISVILTTLSAHAYEGEETIGQALVSILTNMHSFIGFDGVRSYIPNPSDPLENFADKWAEHPERRAAFFEWLEAAKRDFFYAAQVTSRQVITDSVAPRIGRRLAERARDRATPKPAPTLLRPATAASAAAAVPTFPAEARVPGKPAGFGGG

SEQ ID NO: 808 - protein, 403 aa, Kaistia adipata
MVTITKEAEGYLEALADELTISPARYEQAVARYESLGKWLHRDASKVKQYDPQVYSQGSFRLGTVIKPEDENGQYDIDSVCELTALKKEQLTQYALKELLRVEIEAYRTAQAMVKPLGEGRRCWTLEYADGAQFHMDIVPALPNGASTRLLLESRGLDAQWAGTAIAITDNKHPLFYQPTTEWPRSNPKGYANWFRSRMAVAFARKRRKLAEAAQASVESIPEYRVVTPLQQAIMILKRHRDQMFAERKDVKPISVILTTLSAHAYEGEETIGQALVSILANMHRFIDFDGVRSYIPNPSDPLENFADKWADHPERRAAFFEWLEAARRDFFYAAQVTSRQMITDSVAPRIGRGLAERARDRAAPKPASSLLRPATAASAAAAAPTFPAAARVPGKPAGFGGR

SEQ ID NO: 809 - protein, 403 aa, Rhodobacter sp.
MITITKEAEGYLEALADELTISPTRYDQAVARYESLGKWLHRDASKVKQYDPQVYSQGSFRLGTVIKPEDENGQYDIDSVCELAALKKDQLTQYALKELLRVEIEAYRTAQAMVKPLGEGRRCWTLEYADGAQFHMDIVPALPNGTSTRLLLESRGLDARWASTAIAITDNKHALFYQPATDWPRSNPKGYANWFRSRMAVAFSRRRRKLAEAAQASVESIPEYRVVTPLQQAIMILKRHRDQMFSDRKDVKPISVILTTLSAHAYESEETIGQALVSILTKMDRFIGVDGIRYYIPNPSDPLENFADKWAEHPERRAAFYEWLEAARRDFFYAAQVTSRQVITDSVAPRIGRDLAERARDRAAPKSASSLLRPATAASAAAAAPTFPAEARVPGKPAGFGSR

SEQ ID NO: 810 - protein, 404 aa, Rhizobium sp.
MVTITKEAEGYLEALADELTISPTRYEQAVARYESLGKWLHRDASTVKQYDPQVYSQGSFRLGTVIKPEDENGQYDIDSVCELAALKKDQLTQYTLKELLRVEIEAYRIAQAMVKPLGEGRRCWTLEYADGAQFHMDIVPALPNGTSMRLLLESRGLDAQWAGTAIAITDNKHPIFYQPTTDWPRSNPKGYAAWFRSRMAVAFSRKRRKLAEAAQASIESIPEYRVVTPLQQAIMILKRHRDQMFAERKGVKPISVILTTLSAHAYVGEETIGQALVSILTKMDRFIDFDGVRSYIPNPSDPLENFADKWAEHPERRAAFYEWLEAARRDFFYAAQVSSRQMITDSVAPRIGRGLAERARDRAEPKSASSLLRTATAASATAAATPTFPTERRVPGKPAGFGGI

SEQ ID NO: 811 - protein, 404 aa, Devosia soli
MVTITKEAEGYLEALADELTISPTRYEQAVARYESLGNWLHREASTVKQYDPQVYSQGSFRLGTVIKPDDENGQYDIDSVCELAALEKNQLTQYTLKELLRVEIEAYRTAQAMVKPVGEGRRCWTLEYADGAQFHMDIVPAIPNGTSTRLLLEARGLDAQWAGTAIAITDNKHPLFYQTTTDWPRSNPKGYADWFRSRMAVVFSRKRRKLAEAAQASVESIPEYRVVTPLQQAIMILKRHRDQMFADRKDVKPISVILTTLSAHAYDGEETIGQALVSILTKMDQFIGFDGIKYHIPNPSDPLENFADKWAEHPERRAAFYEWLQAARGDFFYAAQVSSRQMITDSVAPRIGRSLAERARDRVAPRPATSLLRPATAVSATAAATPTFPSEPRVPGKPAGFGGI

SEQ ID NO: 812 - protein, 400 aa, Sphingopyxis sp.
MAASTSSRRFIDALVEELSISDTRYEQANDSYQSLGRWLNRTDSTIAQYDPAVYVQGSFGLGTVIKPLNLDEEYDIDAVCELKRLGKASLSQERLKILLGREIEAYRKSNSMVKPLREGRRCWTLNYADGAQFHMDVVPALPNGTEVRKMLEARSLNAHWASTAIAITDNERPDYRLITDQWPRSNPKGYLEWFKSRMIVVLNERKEKLAKSISASVDDIPDYRVQTPLQASIMILKRHRDMMFENDEINCCPISIIITTLAAHAYSGEEDIAEALLAILSGMDRYVERDQQNMAIIRNPSDPLENFADKWAEFPERERSFFDWLQQARDDFAEVAGLNDPQVITETLSPHVGVELAKRAKDRALGGSGSLLRGAVVASGAAAPSFGATPRVPSKPKGFA

SEQ ID NO: 813 - protein, 402 aa, Sphingomonas jaspsi
MLATASSRRFIDALVNELSISDTRYEQANESYQSLGRWLNRPESAITQFAPAVYVQGSFGLGTVIKPLNLDEEYDIDAVCELKGLTKADLTQERLKILLGREIDAYRRSKGMVKPLREGRRCWTLNYADGAQFHMDIVPALPNDQYVRKMLEARSLDAQWSGTAIAITDNERLDYQTLTEDWPRSNPKGYLEWFKSRMIVMLNERKKRLAKSISASVEDIPDYRVQTPLQAAIMILKRHRDIMFQKDEINCSPISIIITTLAAHAYAGEEEIADALLSILSGMDRYIDRDRDNTAIIRNPSDPVENFADKWAEFPERERSFYQWLRQARDDFAKVAGMDSAQMIMETLSPHVGVELAKRAKDRSSGGLRSSMLRGAVAASAGAAAPSFAATPRVPSKPKGFA

SEQ ID NO: 814 - protein, 402 aa, Unknown
  Description of Unknown: Sphingomonas sequence
MPNSLTASSRRYIEALADELDISDTRYRQAEQSYMSLGQWLNRPDSTISRYDPVVYVQGSFGLGTVIRPLNEAEEYDVDSVCELKLLSKNQKTQQQLKMLLGLEIEAYRKSKTMVKPLHEGRRCWTLNYADEAQFHMDIVPALPNGAAVRKLLETYRMDAKWTGTAIAITDNERSDYRQITDDWPRSNPKGYLEWFKSRIIVVLNERKRVLAKSLNASVEKIPDYKVRTPLQASIMILKRHRDIMFEKDAINCCPISIIITTLAAHAYGGQEDVGDALLAILTGMETYILRDRNGRALIPNPTDPMENFADKWEKHPERERAFFKWLRQAQADYLKVAGLESGALITETLSPQMGTALAKRAETRFRGGSSPLLRGVTAAAASSSPSFGSVPRVPSKPKGFA

SEQ ID NO: 815 - protein, 404 aa, Sphingomonas sp.
MTAKATSIAKTYLDALADELEISDTRYEQAQESYRSLGRWFNRPASTLRGYDPAVYVQGSFGLGTVIKPLHAEEEYDVDAVCELKALNKSQLSQETLKAMVGAEMEGYRRSQAMTKPLREGRRCWTLNYADGAQFHMDVVPALPNARDVRILLDSKGLDASRAATAIAITDNERLGYQQISDDWPRSNPKGYLDWFKGRMRVVLEKRRRAMADAVKASVEAIPDYKVRTPLQSSIMILKRHRDIMYVKDELNCCPISIIITTLAAHAYQGEEEIADALLSILSGMEAYIARDTRGRAVIANPSDPLENFADKWAEFPERERAFYAWLRQAQRDFAHAASLADRHSITDSLSPHLGQELAKRAADRSASKPAGLLRGATAAAAGALSTPSFSNTARTPTKPQGFA

SEQ ID NO: 816 - protein, 404 aa, Sphingobium baderi
MATRATSIAKTYLDALADELEISDTRYEQAEESYQSLGRWFNRPASTLRDYDPAVYVQGSFGLGTVIKPLHADEEYDVDAVCELKALSKPQLSQETLKALVGAEMEGYRRSQAMAKPLREGRRCWTLNYADGAQFHMDVVPALPNAQDVRILLDSKGLDASRAATAIAITDNERLDYQQITHDWPRSNPKGYLDWFKSRMRVVLEKRRRAMADAVKASVEAIPDYKVRTPLQSSIMILKRHRDIMYVKDELNCCPISIIITTLAAHAYQGEEEIADALLSILSGMEAYIARDTRGRAVIANPSDPLENFADKWAEFPERERAFYAWLRQAQRDFAHAASLADRHSITDSLSPHLGQELAKRAADRSASKPAGLLRGATAAAAGALSTPSFSNTARTPTKPQGFA

SEQ ID NO: 817 - protein, 404 aa, Sandarakinorhabdus sp.
MATTATSIAKTYLDALAEELEISDTRYEQAEESYQSLGRWFNRSASMLRDYDPAVYVQGSFGLGTVIKPLHADEEYDIDAVCELKALSKPQLSQETLKALVGMEMEGYRRSQAMAKPLREGRRCWTLNYADGAQFHMDLVPALPNAQDVRVLLDSKGLDASRAATAIAITDNERLDYQQITHDWPRSNPKGYLDWFKGRMRVVLEKRRRAMADAVKASVEAIPDYKVRTPLQSSIMILKRHRDIMYAKDELNCSPISIIITTLAAHAYQGEEEIADALLSILSGMEAYIARDTRGRAVIANPSDPLENFADKWAEFPERERAFYAWLRQAQRDFAHAASLADRHSITDSLSPQLGHELAKRAADRSASKPAGLLRGATAAAAGALSTPSFSNTARTPTKPQGFA

SEQ ID NO: 818 - protein, 405 aa, Novosphingobium barchaimii
MVTKATATAQEYLEALADELAVSEARYEQAERSYHSLGDWLNRDASTIAQYSPAVYVQGSFGLGTVIKPIKADAEYDIDAVCELKDLTKAQLTQRELKILVGREIEAYRVSKGMHQPLEERRRCWTLRYADGAQFHMDVVPALPDGAAMRAVLEARFLDAQWADPAIGITDNEHHLYDLVTQDWPHSNPKGYLRWFKSRMEVIQRRRKQILADSIRASVESIPDYKVRTPLQSAIMILKRHRDIMYVNDEINCCPISIIITTLAGHAYDGEEQIADALLSILSRMDQFIERVNGQAYIQNPSDPLENFADKWATFPERERAFYEWLAQARHDFATAAQQVTRTRITDTLSPHLGAELAKRAEERTTTTSGLLRPATAAVAAAAAANAPHSFGNTARKPTKPAGFA

SEQ ID NO: 819 - protein, 398 aa, Kaistia sp.
MNLAIPVITPQAERYLQALAEELEIPPSRYEQAERSYLSFGEWLHREKSTVLRYDPQVYVQGSFRLGTAIKPLNDAEEYDVDSVCEFRLLQKTSLSQFGLKQLLGDEVKAYAREHGMTKPVQEGRRCWVLEYADGAQFHMDIVPAIPNATEQRVLLRRHGLDTTWASTAIAITDKGDSAYKIISEEWPRSNPKGYSEWFRSKVVDVERRRVSDGFRAQVESMPTYRIRTPLQSAIMILKRHRDHMFEHRYEERPISVILTTLATHAYQGDLTIGKALVSILSGMDSFIERVNGQDVIRNPTDPLENFADKWPKHPERRAAFYEWLGQARADFLQAALLAERQQISDTVARGIGRSLADKAAVRTLGLAAPAVLTAGLVRSEASARRSAVRLEGGGRNA

SEQ ID NO: 820 - protein, 398 aa, Aquamicrobium aerolatum
MNLAIPVITHEAERYLQALAEELEIPPSRYEQADRSYLSFGEWLHREKSTVLRYDPQVYVQGSFRLGTAIKPLNDAEEYDVDSVCEFRLLQKASLSQFDLKQRLGIEVKAYAREHGMTKPVEEGRRCWILEYADGAQFHMDIVPAIPNGAEQRMLLSRHGLDTTWASTAIAITDKDHTAYEVISDEWPRSNPKGYSEWFRSKVVDVEKRRVVDGVRAQVESMPTYRIRTPLQSAIMILKRHRDHMFEHRREERPISVILTTLAAHAYQGDLTIGRALLSILTGMDRFIERVNGQDFIRNPTDPLENFADKWPKHPERRAAFYEWLGQARADFLQAARLAERQQISDAVARGVGRSLADKAKVRSLGLAAPAVLTAGLVRSEASARSSAVRLEGGGRNA

SEQ ID NO: 821 - protein, 406 aa, Mesorhizobium sp.
MNMHLSPTITPEADDVLEDVAKELEIPEHRYEQAETSYKSLGDWLNRPESTIRKYGPQVHVQGSFGLGTVTPPLTADEHYDIDAVCEFHRLTKNDTTQANLKRLLEIEMRLYARSKKMIKPLEEHRRCWRQPYADEAQFHMDVTPGIPSGGELTQLLKTRGFDVSLAETAISITDNRHPHYQIIAADWQRSNPRGYLKWFLTRMAKAYEKRKNELLQKGVRAGTEPIPDYRIRTPLQYAIMILKRHRDIMYTDRSDDDKPISIILTTLAAHSYDGEEKIAEALFVILTKMDSFIGTAADGSRLIANPSDPLENFADKWKEHPKREKEFHNWLRKARADFTALAQLSNKELITEQLAKGVGVGIADQTRRRSAARLSTPALLTAGLVRSEAQARNSAVRIEGDRRNA

SEQ ID NO: 822 - protein, 406 aa, Mesorhizobium sp.; identical to SEQ ID NO: 821

SEQ ID NO: 823 - protein, 405 aa, Mesorhizobium sp.
MNMHLSPTITPEADEVLEDLAKELEIPEHRYEQAETSYKSLGDWLNRPESTIRRYGPQVHVQGSFGLGTVTPPLTADEHYDIDAVCEFQRLTKNETTQANLKRLLEIEMRLYARSKNMIKPLEEHRRYWRQPYADEAQFHMDVTPGIPSGGELTQLLKTRGLDASLAETAISITDNRHPHYQIIAADWQRSNPRGYLKWFLTRMAKAYDKRKKELLQKGVRAGTEPIPDYRIRTPLQYAIMILKRHRDIMYIGRGDEKPISIILTTLAAHSYEGEEKIAEALFVTLTKMDSFIGTAADGSRLIANPSDPLENFADKWKEHPEREKEFHNWLRKARADFAAVAQLPNKQLITEQLAKGVGADIADQTRRRSAARLSTPALLTSCLVRSEAQAQTSAVRIEGDRRNA

SEQ ID NO: 824 - protein, 405 aa, Mesorhizobium sp.
MNVHMSQTITQEAHEVLEDLGKELEIPERRYEQAATSYKSLGDWLNRPESTIRQYGPKVHVQGSFGLGTVTPPLTADEHYDIDAVCEFHRLTKNETTQANLKRLLETEMRLYARSKNMIKPLEEHRRCWRQPYADEAQFHMDVTPGIPSGGELTQLLKTRGFDASLAETAISITDNRHPHYQIIAADWQRSNPRGYLKWFLTRMAKAYDKRKQELLQKGVRAGTEPIPDYRIRTPLQYAIMILKRHRDIMYTDRSDDKPISIILTTLAAHSYDGEEKIAEALFVILTKMDSFIGTAADGSRLIANPSDPLENFADKWKEHPEREKEFHNWLRKARADFTALAQLSNKELITEQLAKGVGAGIADQTRRRSAARLSTPALLTAGLVRSEAQARNSAVRIEGDRRNA

SEQ ID NO: 825 - protein, 405 aa, Mesorhizobium sp.; identical to SEQ ID NO: 824

SEQ ID NO: 826 - protein, 405 aa, Bradyrhizobium lablabi
MNVHMRPTITPQAEEALEDLAESLEISDHRYEQAERRYKSLGEWLNRPESTIRQYDPQVHVQGSFGLGTVTPPLTNSDEYDVDAVCEFRRLTKTERTQAELKEMLRIEMAEYARRHAMNKPLEEHRRCWRQPYAEEAQFHIDATPAVLSGSELVQILKSQGRDARFAETAISITDNRHPHYRIISTLWQRSNPRGYLKWFLTRMGPVYEKRRNALLKKGVRAGTEPIPDYRIRTPLQQAIMILKRHRDIMFVDRNDDKPISIILTTLAAHAYQGEETIAQALFAILSKMDDFIDRTADGRYLIVNPSDPLENFADKWSEHPERAAAFFSWLDQARTDFAAIAALSNKQLITDYLAKRVGRDIADRVRKRSAARLGAPAVLTEGLVRSEAEARRTPPRLEGDRRNA

SEQ ID NO: 827 - protein, 424 aa, Afipia birgiae
MASPSPTLSNTPANITEIGMNVYMRPTVTPEAEETLEDLADSLAIPESRYEQAERSYKSLGDWLNRPNSSIRQFDPQVHVQGSFGLGTVIPPISDEEHYDIDAVSEFRKLTKSQTTQQQLKHLLGEEMKLYAHAQNMNKPLEEHRRCWRLEYADGVQFHMDVTPGLLNAAEQRALLLSRGLNATFADTAVAITDIDHPAYRTLSSDWPRSNPRGYLKWFRSRMEVIFEERKRELIRKGVRAGTEPIPFYAVRTPLQSAIMILKRHRDIMFIARSDERPISIILTTLAAHAYNGEAKISDALFAILNGMDRFIARAPDGSYVVANPSDPTENFADKWRKHPERAAAFFEWLEQARRDFAQAAELSNKQLITENLAKSIGRGLADRVRKRSAARLGTPTVLTAGLVRSEAEARSSAVRIEGDRRNA

SEQ ID NO: 828 - protein, 401 aa, Afipia birgiae
MRPTVTPEAEETLEDLADSLAIPESRYEQAERSYKSLGDWLNRPNSSIRQFDPQVHVQGSFGLGTVIPPISDEEHYDIDAVSEFRKLTKSQTTQQQLKHLLGEEMKLYAHAQNMNKPLEEHRRCWRLEYADGVQFHMDVTPGLLNAAEQRALLLSRGLNATFADTAVAITDIDHPAYRTLSSDWPRSNPRGYLKWFRSRMEVIFEERKRELIRKGVRAGTEPIPFYAVRTPLQSAIMILKRHRDIMFIARSDERPISIILTTLAAHAYNGEAKISDALFAILNGMDRFIARAPDGSYVVANPSDPTENFADKWRKHPERAAAFFEWLEQARRDFAQAAELSNKQLITENLAKSIGRGLADRVRKRSAARLGTPTVLTAGLVRSEAEARSSAVRIEGDRRNA

SEQ ID NO: 829 - protein, 405 aa, Tardiphaga sp.
MNVHTRPTVTLEAEEILEDLADSLAIPESRYEQAERSYKSLGEWLNRLASSMRPFDPQVHIQGSFGLGTVIPPISDEEHYDIDAVSELRKLTKADVTQQQVKHLLGTEMKLYARAQSMINPVEEHRRCWRLEYADGAQFHMDVTPGILNAAEQRALLLSRGFDARFADTAIAITDIDHPHYAFLSSEWPRSNPRGYLKWFHSRMEVIFEERKRALIRKGIRAGTEAIPLYAVRTPLQSAIMILKRHRDIMFIARSDERPISIILTTLAAHAYNGETKISDSLFAILSGMDAHIRHAPDGSYVVANPSDPSENFADKWRKHPERAAAFFEWLDRAREDFTHAAALSNKQLMTETLAKSVGCGMAEKVRTRSAKRLGAPTILTAGLVSSEAQVRRAPPRIEGDRRNA

SEQ ID NO: 830 - protein, 400 aa, Bradyrhizobium sp.
MNVQTRFPTTDEAAKTLEALAEELEIPQYRYEQAETSYRSLGDWLNRSVSSIRQFDPQVHVQGSFGLGTAIPPISDDEHYDVDAVCEFRNLTKGQISQAELKRRLGQEIRSYAASQSMKNPVEERRRCWTLVYADGAQFHMDVTPGIPNAADQRSRLERIGLDAAFAGTAIAITDVDHPTYRMISQDWPRSNPRGYLDWFRSCMAKGREQGRSVALDSTEPMPDYKLRTPLQRAVMILKRHRDIAFADRFDERPISVILTTLAAHAYGGERKIADALFSILRGMDRYIVQRGGGEVLIANPSDRSENFADKWSKCPERKAAFYQWLAQARKDFEYVAVLSNEQLIAEHLAKGVGLGMADRAKKRATRGPGAPTILTGGLVRNEAQARSSAVQLHGDRRNA

SEQ ID NO: 831 - protein, 406 aa, Thalassospira sp.
MSRLTKQAEEYLKALIGELEIPKTRYEQAERSYKALGEWFHRPESSISDYDPEVFVQGSFRLGTVIKPNSSNEQYDIDCTCVLSGLSKSDLSQAQLKALLGTEIKAYRIAKNMTKEVQSKQRCWRLEYSDEAQFHMDIVPSLPNGQDQRVLLEARSLDASFADTAIAITDDQTRNFGDITDDWPRSNPKGYAEWFKARMGQAFTRRREQVLAEMRAKNAAASIEDVPTYRVRTPLQSAIMILKRHRDMMFSENSTDAPISIIISTLAAHAYNDEETNGSALIAILDRMESAIKYDGEKIIIPNPTDATENFADKWERHPERAEAFQFWLKQARSDFSSTMILTEKRRIARVLSDRMGNELTSKAFEKSDAERPALLRSATTASSTGAPSVAFGEGPRNPKKPDGFA

SEQ ID NO: 832 - protein, 411 aa, Roseobacter denitrificans
MTVTITKQAEKYLEALAKALEIPHSRYEQAEKSYKSLGDWLHRDDSGVKNFDPDVFVQGSFRLGTVIKPQSDEEEYDVDCACALNALGKSNISQFALKELLGEEIKLYRKNKGIKKEVHEGRRCWRLEYADGAQFHMDIVPCIPNAADQRLLLEARNLDARFADTAIAITDNEVPQYYEITEDWPRSNPRGYAEWFKSRMGDVFIRRREQVFNEMRSEGVTASVEDIPTYRVRTPLQSAIMILKRHRDTVFADDPTDKPISIIISSLAAHTYEGEKTIGYALLSILSRMEQAIEHDGVRYIIKNPTDALENFADKWEEYPERAQAFFGWLEQAREDFSSAGRLVEYRRMSSVLANRMGRDITDQASDAALQPSHPGGSSLLGAAAAASSSSAPSVSFADTPRTPKKPDGFA

SEQ ID NO: 833 - protein, 411 aa, Thioclava sp.
MAVTITKQAEAYLEALAAGLEIPSSRYEQAEKSYKSLGEWLQRDASIVRDHDPDIFVQGSFRLGTVIRPMSDDEEYDVDCACSLTRLSKSDLSQHDLKNMLGQEIKLYRESKGIKKPVHEGRRCWRLEYADGAQFHMDIVPCIPNAEDQRLLLEARELDAQFADTAIAITDNEELAYDAITDDWPRSNPRGYAEWFKSRMGDVFVRRRQQILNEMRAEGVTASVEDIPTYRVRTPLQSAIMILKRHRDSMFADDPTDKPISIIISSLAAHAYQGEETIGYALLSILSRMEDAIEHDGTKYIIKNPTDALENFADKWEDNPERADAFFEWLKQAREDFSAAGRLVEHRRIATILANRMGRDLTDRVDDGVLHASRPSSSSLVKAAGVASATSVPSVSFGDAPRTPKKPDGFA

SEQ ID NO: 834 - protein, 411 aa, Thioclava sp.
MAVTITKQAEAYLEALAAGLEIPSSRYDQAEKSYKSLGEWLQRDASIVRDHDPDIFVQGSFRLGTVIRPMSDDEEYDVDCACSLTRLSKSDLSQHDLKNMLGQEIKLYRESKGIKKPVHEGRRCWRLEYADGAQFHMDIVPCIPNAEDQRLLLEARELDAQFADTAIAITDNEELAYDAITDDWPRSNPRGYAEWFKSRMGDVFVRRRQQLLNEMRAEGVTASVEDIPTYRVRTPLQSAIMILKRHRDSMFADDPTDKPISIIISSLAAHAYQGEETIGYALLSILSRMEDAIEHDGTKYIIKNPTDALENFADKWEDNPERADAFFEWLKQAREDFSAAGRLVEHRRIATVLANRMGRDLTDRVDDGVLHASRPSSSSLVKAAGVASATSVPSVSFGDAPRTPKKPDGFA

SEQ ID NO: 835 - protein, 411 aa, Yangia sp.
MSVAITKQAEAYLEALAEALEIPLARYEQAETSYKSLGDWLHREASSVRDHDPDIFIQGSFRLGTVIRPMSDDEEYDVDCACSLTSLSKSDLSQYDLKDMLGKEIKLYRESKGIKKPVHEGRRCWRLEYADGAQFHMDIVPCIPNAEDQRLLLETRNLDAQFSDTAIAITDNEEPAYYAITDEWPRSNPRGYAEWFKSRMGDVFLRRRQKILNEMRAEGVAASVEDIPTYRVRTPLQSTIMILKRHRDSMFADDPTDKPISIIISSLAAHAYQSEETIGYALLSILSRMEDAIEHDGTKYIIKNPTDALENFADKWEDHPERADAFFEWLKQAREDFSTAGRLVEHRRMANVLASRMGQGLTDRASNRVLQPSRPGSPSLVKAAGVASATSAPSVSFGDTPRTPKKPDGFA

SEQ ID NO: 836 - protein, 411 aa, Rhodospira trueperi
MAVTITKQAEAYLEALAKALEIPAARYEQAEKSYKALGDWLHRDSSSVRDHNPDIFVQGSFRLGTVIRPMSNDEEYDVDCVCSLTSLSKSDLSQHDLKDLLGKEIKLYRHSKGIKKPVHEGRRCWRLEYADGAQFHMDIVPCIPNAEDQRLLLEARSLDATYAETAIAITDNEEAAYDFITEDWPRSNPRGYAEWFKSRMGDVFLRRRKQILQEMRAEGVTASVEDVPTYRVRTPLQSAIMILKRHRDTMFADDPTDKPISIIISSLAAHAYQGEETIGYALLSILSRMEEAIEHDGTKYVIKNPTDALENFADKWEEHPKRAKAFFEWLNQARDDFSAASRLVEHRRMSTVLADRMGQDLTDQASDAALQPTRSGSPGLVKVAGVPSAASAPSVSFADARRTPKKPDGFA

SEQ ID NO: 837 - protein, 412 aa, Vibrio parahaemolyticus
MSVSVTKQADTYLEALAKALEIPQSRYEQAEKSYKSVGEWLHREESTVKDYSPDVYVQGSFRLGLVIKPLSAQEEYDIDCACSLTYLDKSSLSQQDLKVLMGDELELYRKSKGIKKPVAEQRRCWRLEYADGAQFHMDVVPCIPNAEQQRLLLEQKNFDTKFAETAIAITDNEVLPQYYQITSDWPRSNPRGYAEWFKFRMGENFERKRREILKEMETKGIQASIEDIPSYRVRTPLQSAIMILKRHRDMMFEDNSKDKPISIILTTLSAHAYQGEDSIGSALLSILFRMEEGIHYDGHKYVINNPTDAMENFADKWETHPERAEAFFSWLSQAREDFYSVGQQAEHRRMSGILESRIGQNVTNQVYQDLSSLTKSGASSLLSAATAASTVATPSIAFGDVARKPKKPDGFA

SEQ ID NO: 838 - protein, 412 aa, Unknown
  Description of Unknown: Vibrio sequence
MSVSVTKQADTYLEALAKALEIPQSRYEQAEKSYKSVGEWLHREESTVKDYSPDVYVQGSFRLGLVIKPLSAQEEYDIDCACSLTYLDKLSLSQQDLKVLMGNELELYRKSKGIKKPVAEQRRCWRLEYADGAQFHMDVVPCIPNAEQQRLLLEQKNFDTKFAETAIAITDNEVLPQYYQITSDWPRSNPRGYAEWFKFRMGENFERKRREILKEMETKGIQASIEDIPSYRVRTPLQSAIMILKRHRDMMFEDNSEDKPISIILTTLSAHAYQGEDNIGSALLSILFKMEEGIHYDGQKYVINNPTDAMENFADKWETHPERAEAFFSWLSQAREDFYSVAQQAEHRRMSGILESRIGQNVTNLVHQDLFSLTKSGASSLLSAATAASTLAAPNIAFGDVARKPKKPDGFA

SEQ ID NO: 839 - protein, 412 aa, Vibrio sp.
MSVSVTKQADTYLEALAKALEIPQSRYEQAEKSYKSVGEWLHRDESTVKDYSPDVYVQGSFRLGLVIKPLSAQEEYDIDCACSLTYLDKSSLSQQDLKVLMGDELELYRKSKGIKKPVAEQRRCWRLEYADGAQFHMDVVPCIPNAEQQRLLLEQKNFDTKFAETAIAITDNEVLPQYYQITSDWPRSNPRGYAEWFKFRMGENFERKRREILKEMETKGIQASIEDIPSYRVRTSLQSAIMILKRHRDMMFEGNSKDKPISIILTTLSAHAYQGEDNIGSALLSILFKMEEGIHYDGQKYVINNPTDAMENFADKWETHPERAEAFFSWLSQAREDFYSAAQQAEHRRMSGILESRIGQNVTNLVHQDLLSLTKSGASSLLSAATAASTLATPNIAFGDVARKPKKPDGFA

SEQ ID NO: 840 - protein, 416 aa, Marinobacter sp.
MAGDITEQAAQYLDKLVKALEIPPSRYEQAERSYKSLGEWLHREESKVSDHDPEVFIQGSFKLGTAVRPNSSDEEYDIDCACSLRGLTKSDLSQAELKELVGNEIKLYRKSKGITKEVHSGQRCWRLEYSDGAQFHMDIVPCLPNGTSQRQLLEAKGLDTTFADTAIAITDNEVPKYRLITDEWPRSNPKGYALWFQSRMGDVFERRRRQILTEMREKEVNASVEDIPIYLVRTPLQAAIMILKHHRDKMFADDPKANPKDKPISIIISTLAAHAYQGEETVGDALISILDRMEEAIQHDGKNYIIQNPTDPLENFADKWEKHPERVKAFKYWLDQARKDFSSAAAHAEYGEISAILEHRFGPDLIEAVNKQLGNMPNPQRRTLLRSATAASTTAPPSVSFADSEARIPKKPDGFA

SEQ ID NO: 841 - protein, 508 aa, Acidovorax temperans
MTPEGMEFLERLVKELDVPVSRYEEAERRYQSVGDWLCRDESTLKDLDPDVYVQGSFRLGTPIRPVNEHEDYDIDLVCELSAGKSNLTQQQLKELLGVEMKAYAKAHGMSEAGESRRCWTLDYADGAQFHLDALPAIPDGGEKRRILREAQLDTPWADTAIAITDIDHPNFRNLHGEWPHSNPRGYTEWFRSRMRENFEQMREAVAIAMEANVEDIPSYSIKTPLQQAVQVFKRHRDHMFADDPEDKPISVILTTLAGLSYQGERTVAEAVVGILDRMESHITVDQHGNAVIANPTDPQENFADRWVLVPKKRANFYKWLQEARRDLNSILQERTSHRLTEAAMESFGEREARAAAAGGGVRGAMTKFLQRAASVLSAPHKKTAAWPVKQAGDWVQIHKVTWTARGFSRPQRIRSGDHSLMKGASIMFEASSNVDYPYDVHWQITNTGKEASDANTLRGGFYSGGTLTRGHAKRAEPIGFSGTHSAQCFIVKDGHLVAKSDIFIVKVR

SEQ ID NO: 842 - protein, 538 aa, Acidovorax temperans
MNTVLRAVVETTNQEGKRMNLNELFGSGDEMTPEGMEFLERLVKELDVPVSRYEEAERRYQSVGDWLCRDESTLKDLDPDVYVQGSFRLGTPIRPVNEHEDYDIDLVCELSAGKSNLTQQQLKELLGVEMKAYAKAHGMSEAGESRRCWTLDYADGAQFHLDALPAIPDGGEKRRILREAQLDTPWADTAIAITDIDHPNFRNLHGEWPHSNPRGYTEWFRSRMRENFEQMREAVAIAMEANVEDIPSYSIKTPLQQAVQVFKRHRDHMFADDPEDKPISVILTTLAGLSYQGERTVAEAVVGILDRMESHITVDQHGNAVIANPTDPQENFADRWVLVPKKRANFYKWLQEARRDLNSILQERTSHRLTEAAMESFGEREARAAAAGGGVRGAMTKFLQRAASVLSAPHKKTAAWPVKQAGDWVQIHKVTWTARGFSRPQRIRSGDHSLMKGASIMFEASSNVDYPYDVHWQITNTGKEASDANTLRGGFYSGGTLTRGHAKRAEPIGFSGTHSAQCFIVKDGHLVAKSDIFIVKVR

SEQ ID NO: 843 - protein, 508 aa, Acidovorax temperans; identical to SEQ ID NO: 841

SEQ ID NO: 844 - protein, 510 aa, Acidovorax sp.
MTFATTAASAAYLERVATELDVPPGRYEEATRRYKSVGEWLGREESTLKDLSPEVYVQGSFRLGTPIRPVNEDEHYDLDLVCELDASKSNVTQQELKRLLGREMQLYAKHQGMKDVTESRRCWTLDYAEGAQFHLDALPAIPDAGRKRAQLEARSLSTTWVETAIAITDVDHPLYEVHCDDWPHSNPKGYTNWFRSRMKEAFERQRAAMALEAKANVEDVPSYRVKTPLQQAVQILKRHRDIRFAKDPDNKPISIIITTLAGLSYGGESNVAYALQAILAGMDSHIETRGGVTWIPNPTDPEENFADRWATHPQRKQGFFEWLKAARDDFLRIGTLANRELLVEQAAPVIGDRVARAASSAPSRPARTSASLFQRAALVFLATHKKPAPWQHVRGGTVTIVEAIVSRSGFRTRRFYHDGTPLTKGASLLFKAVTDVPWPYDVYWQVVNTGPEAAAVRGGLRGGFDAGNVDRGSIMRQESTSYSGTHTIECFIVKNGYLVARSGAFVVNIA

SEQ ID NO: 845 - protein, 517 aa, Burkholderia cepacia
MTTDIEPPHVTTASAISYLERLAEELDVPPSRYEEARRRYKSVGEWLGREESTLKDFDPEVYVQGSFRLGIPIRPVNDDEHYDVDLVCEMKAAGKHLSQRQLKEMLGYEMMLYSRAHGMKEVGESRRCWTLEYADGAQFHLDALPAIPDGEGMRRVLAARGLSNSWTESAIAITDNEHPLYDVVCDGWPHSNPKGYTNWFRSRMKVAFETRRGAMALEAKAAVEDIPSYRVKTPLQQAVQLLKRHRDLMFAEDSENKPISIILTTLAGQAYQNEPTVAQALGSILQRMDMFIGEDAQGFAIILNPTDPAENFADRWRQYPERRRNFYAWLKKAREDFAELTSQWQSPQMVEAAKRFTGQRIAAQASIARSSSTRSLAALSPSRAALISAPHKQQAPWPVVRHGQVRIGNATWRANGFSRPMRFYSDSEPLRKGADLTFEASTDVPAPFDVYWQVVNSGAEAAHANQLRGGFDQGAVERGSVVRHESTAYAGSHTIECFIVKQGHLVARSGVFVVNIA

SEQ ID NO: 846 - protein, 513 aa, Roseovarius halotolerans
MAFTLPNTRPLDDLLEDLVEELQVPPGRYEQAERSYKSLGEWLHRPESTVRESDPDVYVQGSFRLGTAIKPASDEEDYDIDMVCRLGYEKSSLSQAELKRRVGVEIRAYAKRHGMSKPDDGRRCWTLVYADGAQFHMDVLPAVPDSEKRRYLREAGPVLARLGATALAITDNEHPDFQRIAGDWPRSNPKGYALWFRDRMGQAFRTRALNEAHKMRASVEEVPTYRVRTPLQGTIQILKRHRDMMFSDRTDEKPISILITTLSAHAYNQEDDLSGALFSILRNMDRYIMQREGVDWVENPADPAENFADKWEKNPERRDAFHEWLAQARADFASAHRAATADVAGTILSEHMGTALVNRALGRRNPVQKSGYVAPLVRAANLILAPAYMRKPRWPHKPEGRVSIDTATFTQKGFRPQPFISGGAALPKHSSLNFKAETTLTGRFKVYWQVVNTGREAEVADCLRGGFNLDSAVRGGLTHTESTLYRGQHSIECFIVKNGKLAARSGQFIVNIA

SEQ ID NO: 847 - protein, 513 aa, Phaeobacter piscinae
MEFPLPNTRPIDQLLEDLVEELQVPPGRYEQAERSYKSLGEWLHRPDSTVRNDSPDVYVQGSFRLGTAIRPASDEEDYDIDMVCRLDYEKSALTQAELKRRVGVEVKAYARRYGMSKPEDGRRCWTLAYADGAQFHMDVLPAVSDFEKRRYLSEAGPALARMGATALAITDKEHDGFRQAGGRWPRSNPKGYALWFRDRMGQAFRSRALNEARRMQASVEDVPAWRVHTPLQGVIQILKRHRDLMFSDRPDDKPISILITTLAAHAYNQEERLSDALFSILQGMDRYITRRNGVDWVENPADPEENFADKWEEHSERRDAFHEWLQKARSDFASAHQALTADGVGAVLSERMGQGLVERALGRRNPARRPGVPARAVRAMNLVLAPAYMRKPRWPQAAEGHVKIRTASFTQNGFRPQSFVSNGAPLPRNCSLRFEADTTVTGRFKVYWQVVNTGREAEDADCLRGGFSPDVAVRGGLSHSENTLYRGQHSIECFIVKNGKLAARSGQFIVNIG

SEQ ID NO: 848 - protein, 512 aa, Oceanibaculum pacificum
MRVPKHIEELLEDLAESLQIPPSRYEAAERSYKSVGDWLHREASSLRQADPQVYIQGSFRLGTAIRPVSDAEDYDVDLVCELSASKARVTQAQLKAALGRELKAYAAAHGMDDPEEGRRCWTLPYADSAQFHLDTLPAVPDGARKRLLLEQRGLSTEWSDTAIAITDRDHPNYRLVSDDWPHSNPKGYWEWFRSRMKVVFEARRLKLAMEARASVEDIPEYKVRTPLQSAVQILKRHRDMMYVERSDEKPISIIITTLAAHAYNQEPTIAEALYSILDRMEEYIEYRQGVAWIANPTDPAENFADKWQEHPERQAAFFEWLEEARADFAAAAAGVTRDQALSGLETHLGKRLVEAARAKRPAGGNNALARVLAGAGARARIVLNPAHRQRPPWDPATQGDVEIERATVARNGFRPEDFGSDGRSLPKHASLTFQADTNVPRPYKVYWQVVNTGLEAERVNGLRGGFDEGVITAGKLTRRESTLYRGSHSIECFVVKDGLLAARSGQFIVNIQ

SEQ ID NO: 849 - protein, 416 aa, Proteobacteria bacterium
MTVHDKRLARSHDDILEAIAAALDIPPGKFEEARQRYEALGGWLDRPESTLADLDPAISPHGSFLLGTVTRPLTDADEYDVDLVCRVNGSKAALTQKQLKDAVGHEVALYARARNMAHPEERRRCWTLNYAEGAQFHMDVLPALPDAQRYQAQLRAKGFGTLADDGDLSGHAIAITDNQRRDYAVISDDWLQSNPYGYAAWFRGRMRVRLTEAKRSFAARERITASVDEIPDYKVRTPLQQAIQLLKRHRDCMFAEDGEHKPISIIITTLAAHAYNEEASLSAALQSILMNMDRYIEERDGIAWVSNPVNPAENFADKWPEEPCKRDNFFRWLAQARQDFAQYLRASPYDTIPDELERRLGPSLVKRALNSVMPGDGVIGAPALLLGRGHDAELERARHAVDAIQSSGSQSRPWVR

SEQ ID NO: 850 - protein, 416 aa, Sphingomonas hankookensis
MTVYDKRLARSHDDILEAIAAALDIPPGKFEEARQRYEALGGWLDRPESTLADLDPAISPHGSFLLGTVTRPLTDADEYDVDLVCRVNGSKAALTQKQLKDAVGHEVALYARARNMMHPEERRRCWTLNYAEGAQFHMDVLPALPDAQRYQAQLRAKGFGILAADGDLSGHAIAITDNQRSDYAVISDDWLQSNPYGYAAWFRSRMRVRLTEAKRSFAERERISASVDEIPDYKVRTPLQQAIQLLKRHRDCMFAEDGEHKPISIIITTLAAHAYNEEASLSAALQSILMNMDRYIEERDGIAWVSNPVNPAENFADKWPEEPCKRDNFFRWLAQARQDFAQYLRASPYDTIPDELERRLGPALVKRALNSVMPDDGAIGAPALLLGGGHDAELERARHAVDAIQSSGSQSRPWVR

SEQ ID NO: 851 - protein, 416 aa, Porphyrobacter colymbi
MTVHDKRLAGSHDDILEAIAAALDIPPGKFEEARQRYEALGGWLDRPESTLADLDPAISPHGSFLLGTVTRPLTDADEYDVDLVCRVNGSKAALTQKQLKDAVGHEVALYARARNMAHPEERRRCWTLNYAEGAQFHMDVLPALPDAQRYQAQLRAKGFGILAADGDLSGHAIAITDNQRSDYAVISDDWLQSNPYGYAAWFRSRMRVRLTEAKRSFAERERISASVGEIPDYKVRTPLQQAIQLLKRHRDCMFAEDGEHKPISIIITTLAAHAYNEEASLSAALQSILMNMDRYIEERDGIAWVSNPVNPAENFADKWPEEPCKRDNFFRWLAQARQDFAQYLRASPYDTIPDELERRLGPALVKRALNSVMPDDGAIGAPALLLGGGHDAELERARHAVDAIQSSGSQSRPWVR

SEQ ID NO: 852 - protein, 416 aa, Sphingobium xenophagum
MTVHDKRLARSHDDILEAIAAALDIPPGKFEEAKQRYEALGGWLDRPESTLADLDPAISPHGSFLLGTVTRPLTDADEYDVDLVCRVNGSKAALTQKQLKDAVGYEVALYARARNMAQPEERRRCWTLNYAEGAQFHMDVLPALPDAQRYQAQLRAKGFGILAADGDLSGHAIAITDNQRRDYAVISDDWLQSNPYGYAAWFRGRMRVRLTEAKRSFAARERITASVDEIPDYKVRTPLQQAIQLLKRHRDCMFAEDGEHKPISIIITTLAAHAYNEEASLSAALQTILMNMDRYIEEREGIAWVSNPVNPTENFADKWPEEPRKRDNFYRWLAQARQDFAQYLRASPYDTIPAELEQRLGPSLVKRALNSVMPGDGAIGAPALLLGVGHDAELERARHAVDAIQSSGSQSRPWVR

SEQ ID NO: 853 - protein, 416 aa, Porphyrobacter donghaensis
MTVHDKRLARSHDDILEAIAAALDIPPAKFEEAKERYEALGGWLDRPESTLADLDPAISPHGSFLLGTVTRPLTDADEYDVDLVCRVNGSKAALTQKQLKDAVGHEVALYARARNMAHPDERRRCWTLNYAEGAQFHMDVLPALPDAQRYQMQLRAKGFGTLASDGDLSGHAIAITDNQRSDYAVISDDWLQSNPYGYAAWFRSRMRVRLSEAKRSFAARERITASVDEIPDYKVRTPLQQAIQLLKRHRDCMFAEDGEHKPISIIITTLAAHAYNEETSLSAALQTILTNMHLYIEERDGIAWVPNPVNPVENFADKWPEEPIKRDNFLRWLAQARQDFAQYLRASPFDTVPAELQRRLGPTLVKRAVASVMSDEAAIGAPALLLGAGHDADLERARRAVDDVQRSGSQSRPWVR

SEQ ID NO: 854 - protein, 340 aa, Sphingobium xenophagum
MTVHDKRLARSHDDILEAIAAALDIPPGKFEEAKQRYEALGGWLDRPESTLADLDPAISPHGSFLLGTVTRPLTDADEYDVDLVCRVNGSKAALTQKQLKDAVGYEVALYARARNMAQPEERRRCWTLNYAEGAQFHMDVLPALPDAQRYQAQLRAKGFGILAADGDLSGHAIAITDNQRRDYAVISDDWLQSNPYGYAAWFRGRMRVRLTEAKRSFAARERITASVDEIPDYKVRTPLQQAIQLLKRHRDCMFAEDGEHKPISIIITTLAAHAYNEEASLSAALQTILMNMDRYIEEREGIAWVSNPVNPTENFADKWPEEPRKRDNFYRWLAQARQDF

SEQ ID NO: 855 - protein, 367 aa, Rhizobium leguminosarum
MTVHDKRLANTHDDILEAMAEALDIPPSKFEEAKSRYEAIGNWLDRPESTIAEYDPAISPQGSFLLGTVTRPFTDAEEYDVDLVCRLEASKAQFTQKSLKEAVGHEVALYAQAHSMTDPEEHRRCWRLNYAAGAQFHMDILPALPDAQRYQTKLFEQGYRELAHDSALSGHAVAITDKTLPHYNRPTEDWPQSNPTGFAAWFRGRMRVRLTEAKRALAQRERITASVDEIPDYKVKTPLQRSIQLLKRHRDCMFADDCEHKPISIIITTLAAHAYNEEATISTALQSILTGMDRYIEDRGGVAWVVNPVNPAENFADKWAEESKKRNNFYRWLDQARRDFALYLRASTFNKMPELLREHLGAKLVDR

SEQ ID NO: 856 - protein, 418 aa, Rhizobium leguminosarum
MTVHDKRLANTHDDILEAMAEALDIPPSKFEEAKSRYEAIGNWLDRPESTIAEYDPAISPQGSFLLGTVTRPFTDAEEYDVDLVCRLEASKAQFTQKSLKEAVGHEVALYAQAHSMTDPEEHRRCWRLNYAAGAQFHMDILPALPDAQRYQTKLFEQGYRELAHDSALSGHAVAITDKTLPHYNRPTEDWPQSNPTGFAAWFRGRMRVRLTEAKRALAQRERITASVDEIPDYKVKTPLQRSIQLLKRHRDCMFADDCEHKPISIIITTLAAHAYNEEATISTALQSILTGMDRYIEDRGGVAWVVNPVNPAENFADKWAEESKKRNNFYRWLDQARRDFALYLRASTFNKMPELLREHLGAKLVDRTVAAMLPVAAVDLAAPAIATGISNATDMARAERAVEQINRAGPQSKPWAKS

SEQ ID NO: 857 - protein, 416 aa, Novosphingobium fuchskuhlense
MTIYDKNLATSHDDILEKIAEALDIPPSKFEEARNRYHAIGNWLDRPESEIAQFNPAISPQGSFLLGTVTRPFTDAEEYDVDLICRLEATKADFTQKGLKEAVGREVALYAEAHGMADPDEGRRCWTLNYAAGAQFHMDILPALPDAQRYQGVLLEKGFRALASDTGLTGQAIAITDNTHPHYELASTNWPLSNPSGYAAWFRNRMKVRLDEAKLAFAKRAHISASVDQIPDHKVKTPLQRAIQLLKRHRDCMFVGDCEFRPISIIITTLAAHAYNEEPTIAGALQSILTSMDHHFEYHDGIAWVANPVNPSENFADKWVGVPKKRENFVKWLEQARRDFGLYLRASKFDEMPTELRKNLGEDFVDRMMKAATPASALGMPAVSASAASADDLRRAERAIHQIHQTGSQSKPWAKA

SEQ ID NO: 858 - protein, 407 aa, Sulfitobacter sp.
MNIPKDRQITSKEEALRAIVREISIPQSYDKKARDRYHSIGDWLDRPESKVRALKPKISAQGSFALGTVIRPIGDNDAYDVDVVCELENGDHNQMSQAELKSLVGFEIRAYATKYHMNQKPQDGRRCWTMEYADEADFHMDILPSIPGTNSYVASLVSAGYNLDGVRSYTDTAISITDKKHDGYHTRGSEWLVSNPKGYLRWFRLRQRQILEQKRMQMMASGQVIASVEHFPNHKVQTPLQDAIKLLKRHRDVMFDGDDHKPISIIIATLAATSYNGELTISDTLRNILPKMQRTVEELGPVPVISNPSYPAENFADKWQEKPIKRQNFERWIGKARQDILAYLAGSRFDAIPPAFRDSMTNETISKVAPMMALTAAAVATSAAVAAEEAAAVHSSGNQTKPWYPGE

SEQ ID NO: 859 - protein, 407 aa, Roseovarius halotolerans
MNVPKDRQITSKEGTLRAIVREITIPQTYDEKARGRYRSIGEWLDRPDSKVHHLKPKISAQGSFAQGTVIRPVGDGDAYDVDVVCELEKSDHTRMSQAELKSLVGLEIKAYATRHQMKQAPQDCRRCWTMEYADEADFHMDILPSIPGTGGYVASLVAAGYDLEGVRSYTSTAIGITDKKHEGYHERGVTWLVSNPKGYLRWFRGRQRQVLEEKRAQMNAAGRVIASVEDFPNHEVQTPLQDAIKLLKRHRDVMFDGDEHKPISIIISTLAAASYNGEATISETLRNILPKMQRAIEDLGPVAVIPNPSYPAENFADKWEDKPVKRRNFERWIARARQDVLAYLAGSRFDAIPPAFRDSMTAETIRKVAPLMSLTTAAVAASAAVAAEEAAAVKASGATTKPWFPGE

SEQ ID NO: 860 - protein, 407 aa, Thalassobius mediterraneus
MNAPAGKKITTKEEALRALVDEISIPLSYDEKARTRYRSIGEWLDRPASTIHGLGPVISSQGSFALGTVIRPVGDGDAYDVDVVCSLKHGSKSKMSQEELKQAVGVEIHAYAKAQNMSNEPDDARRCWTLEYQDSANFHMDILPGIPARDDFTTQMRGYSPDVGLVQRLSETAIGITDKKHPGYHFRGAEWLISNPKGYAGWFRLRQETVLEEARLRMNAKGRAYASVEDIPSYEVRTPLQDAIKLLKRHRDVMFDGDKHKPISIIITTIAAEAYQGERTISDTLKNILPKMERRIAALGDPAVISNPSYPRENFADKWGEVSEKRRNFEKWVSRARQDFLSYLTVSRFNEFPEPFKAAMTEATIRKVSPKLGLAAAMIAAGTTAAVAEAQKVEAEGNATKPWLDIE

SEQ ID NO: 861 - protein, 498 aa, Dyella jiangningensis
MQQLAEGLDLPTSRYEAADRSYRSVSAWLERDASEFAECHVQVYTQGSFRLGTAIAPIQVDADYDLDIVCEFDWSKHQRTQAELHASLGRELIAYARRHNMQAPSPWNRCWTINYADGARFHMDVLPCVPDGQRQRYLREVASVTLDYVDKSVSITDKEHPHFQTISPDWPVSNPNGYADWFHDQMRPVFDARRLQMMLVEAKADVADIPAFRVRTPLQLAIQILKRHRDLRFLDQDTSFRPTSVVLTTLAALAYRQEATVLEAVAGIIQRMDAFIESRGDISWIPNPADPRENLAEAWSADVRYREAFQQWLEDVRSDVRLALESGSQEEFIDAWSPRLGRDLVEAAVGQSQAGSLITRAFSNTIRKLRDAPHRAPVSWPLAQSGSVAIERAQFIRNGFRPQQLNNEGHVPAGSQLVFTAGTNVPPPYEVYWQIINTGVEAIRARDLRGRFENAKASHGHLVRRETAVYRGIHSVECFIVKQGYCVARSGLFVVNID

SEQ ID NO: 862 - protein, 511 aa, Dyella jiangningensis
MTVQLVNHRHSSWMQQLAEGLDLPTSRYEAADRSYRSVSAWLERDASEFAECHVQVYTQGSFRLGTAIAPIQVDADYDLDIVCEFDWSKHQRTQAELHASLGRELIAYARRHNMQAPSPWNRCWTINYADGARFHMDVLPCVPDGQRQRYLREVASVTLDYVDKSVSITDKEHPHFQTISPDWPVSNPNGYADWFHDQMRPVFDARRLQMMLVEAKADVADIPAFRVRTPLQLAIQILKRHRDLRFLDQDTSFRPTSVVLTTLAALAYRQEATVLEAVAGIIQRMDAFIESRGDISWIPNPADPRENLAEAWSADVRYREAFQQWLEDVRSDVRLALESGSQEEFIDAWSPRLGRDLVEAAVGQSQAGSLITRAFSNTIRKLRDAPHRAPVSWPLAQSGSVAIERAQFIRNGFRPQQLNNEGHVPAGSQLVFTAGTNVPPPYEVYWQIINTGVEAIRARDLRGRFENAKASHGHLVRRETAVYRGIHSVECFIVKQGYCVARSGLFVVNID

SEQ ID NO: 863 - protein, 503 aa, Thalassospira sp.
MIEQLASELDVPDSRYESAERSYKSVGSWLERQESRFSTVDFNVYTQGSFRLGTAIKPYEANEHYDLDVVCEFSISKAHITQKALADDFGEELKLYALRHNMEAPSSWDRCWTLNYADGAQFHMDVLPSVQDGQNQRRLRLEEALTLDYVDQSISITDKNHINYPFIDNEWPASNPNGYAKWFYGRMEQVFASQRHKMMLDEAKAEISEIPVFRVKTPLQSAIKLLKRHRDMRFADEPEKRPTSIVITTLAAQAYQQEDTITGALLSILERMDQFIERRGEDYWIANPSDPRENFADAWKKESSKHEHFYDWLETARADFAEAARQNNLTGFVDALAPRMGRKLVEDAVSRKYPLTRTQISVFDRATTAIKRLLDAPHRRPINWPMTSGGTVTIVSATTKLKHSHPKTLISDDTPVAINSELRFEAITDVQMPYRVYWQIVNTGAEAKADKKLRGGFDESKQGQDALVHIEVASYRGTHSIECFIVKNEYLVARSSPFIVNIA

SEQ ID NO: 864 - protein, 510 aa, Unknown
  Description of Unknown: Thalassospira sequence
MRPTGEALIEQLASELDVPDSRYESAERSYKSVGSWLERQESRFSTVDFNVYTQGSFRLGTAIKPYEANEHYDLDVVCEFSISKAHITQKALADDFGEELKLYALRHNMEAPSSWDRCWTLNYADGAQFHMDVLPSVQDGQNQRRLRLEEALTLDYVDQSISITDKNHINYPFIDNEWPASNPNGYAKWFYGRMEQVFASQRHKMMLDEAKAEISEIPVFRVKTPLQSAIKLLKRHRDMRFADEPEKRPTSIVITTLAAQAYQQEDTITGALLSILERMDQFIERRGEDYWIANPSDPRENFADAWKKESSKHEHFYDWLETARADFAEAARQNNLTGFVDALAPRMGRKLVEDAVSRKYPLTRTQISVFDRATTAIKRLLDAPHRRPINWPMTSGGTVTIVSATTKLKHSHPKTLISDDTPVAINSELRFEAITDVQMPYRVYWQIVNTGAEAKADKKLRGGFDESKQGQDALVHIEVASYRGTHSIECFIVKNEYLVARSSPFIVNIA

SEQ ID NO: 865 - protein, 513 aa, Sphingomonas sp.
MAQPSRTGEGLIQDLAEVLEIPVSRYESADRSYRSVSRWLDRPESRFAHVDLDVYTQGSFRLGTAIRPLNGEEHYDLDIVCEFRISKAHTTQKQLHDDLGHELELYAAKHGMQEPSPWQRCWTLNYADEAQFHMDVLPSVPDAQRQRVLREARSLPLDYVDQSVSITDTEHANFRRLSDEWPASNPNGYADWFQSRMKPAFESRRKAIMLAEAKADVADIPVYRVKTPLQSAIQILKRHRDMRFADEPERRPTSIVITTLAAHAYQQETTISGALLSILQRMDSYIVQQDNGYWIANPSDPRENFADAWNEDADRRDAFYDWLETARADFSLAASQQDPSAFVDALAPRIGRSLVEAAVARRSRPSTGGMSFVSRASRALQRVIDAPHRKPATWPTVRSGTVEIIVATAMRDGFRPRIFTSDDAPVPPGAKLRFDARTDVPRPFRVYWQVVNTGAAATAARNLRGGFDEVTVVPGVLSRTEDAKYPGSHSIECFVVKDGYLAARSGPFLVNIG

SEQ ID NO: 866 - protein, 512 aa, Methylobacterium sp.
MSNRRHTGEELIEDLAKALDIPAERYASADRSYKSVCAWLERPGSRFEHVHIDAYTQGSFRLGTAIRPLSGEEDYDLDIVCEFSVAKTSLTQKQLHDHLGHELRLYAERHGMKPPEGWRRCWTLNYADTAQFHMDVLPAVPDAQRQRLLREARSLSLAFVEKSVGITDSEHDNYRVRSDDWPVSNPNGYAEWFYERMRPVFETRRRAMMLAEAKADVAQIPAFRVKTPLQSAIQILKRHRDVRFSEDSGGRPTSIVVSTLAAHAYQQETTISGALLSILTRMDQFVIRRGDDYWIANPSDPRENFADMWRDEPERKDAFYDWLETARTDFRQAAEQDSVDGFIERLAPRMGRRLVEAAASSRRPPAPRTALAGFVGRTMQRILDAPHRKPVTWPTLTRGNARIASATYQRRGFRPSAFSNDDAALPKGADLRFVAQTDVPRPYRVFWQIVNTGTEATRARGLRGGFEEATVSSGTLTRQEGTSYSGNHSIECFIVKDGYCVARSGPFIVNIA

SEQ ID NO: 867 - protein, 511 aa, Pseudomonas sp.
MSPTLASDRFISALAATLDIPAERYESADKSYRSICTWLERPESRFSRVDIDAYIQGSFRLGTVIPPISGEEHYDLDVVFEFNLSKATKTQQGLYEDLGYELKLYAARYGMQAPSDWDRCWTLNYADTAQFHMDLLPSVPDGQRQRLIREQRAMTLDFVDRSISITDKNHGNYAHLSEDWPSSNPHGYADWFYECMKPAFDQKRRAMMLAEAKADIADIPVFRVKTPLQSAIQILKRHRDMRFSDDPDGRPTSVVISTLAAHSYGQESSVTGALISILQSMDRYIVDREGVSWIENPSNPRENFADSWEQEPARKDAFYDWLDTARTDFVRAAEQGDLNAIIDALAPRMGRELVEKAASHPGQKSLTETSVIKRAKSAFQKLIDAPHRKPVAWPTVPVGYVQVEGTMTRNGFREAVFHNDGAPLPRGSSLSFVANTDVPRPFKIYWQIVNTGEAAAKAKKLRGGFEQATVTTGTLIRRENASYAGSHTIECFVVKDGYCAARSGLFVVNIQ

SEQ ID NO: 868 - protein, 514 aa, Pseudomonas syringae
MPNSEPTLASDRFISALAETLDVPAERYESADKSYRSICTWLERPESRFSRVDIDAYIQGSFRLGTVIPPISGEEHYDLDVVFEFDLSKATKTQQGLYEDLGYELKLYAARYGMQAPSEWDRCWTLNYADTAQFHMDLLPSVPDGQRQRLIREQRAMTLDFVDRSISITDKNHGNYAHLSEDWPSSNPHGYADWFYECMKPAFDQKRRAMMLAEAKADIADIPVFRVKTPLQSAIQILKRHRDMRFSDDPDGRPTSVVISTLAAHSYGQESSVTGALISILQSMDRHIVDREGVSWIENPSNPRENFADSWEQEPARKDAFYDWLDTARTDFVRAAEQGDLNTIIDALAPRMGRELVEKAASHPGQKLLSEASVIKRAKSAFQKLVDAPHRKPVAWPTVPVGYVQVEGTMGRNGFREAVFHNDGVPLPRGSSLSFVANTDVPRPFKIYWQIVNTGEAAAKAKKLRGGFEQATVTTGTLIRRENASYAGSHTIECFVVKDGYCAARSGLFVVNIQ

SEQ ID NO: 869 - protein, 511 aa, Pseudomonas sp.
MSPTLTSDRFISALAATLDIPAERYESADKSYRSICTWLERPESRFSRVDIDAYIQGSFRLGTVIPPISGEEHYDLDVVFEFDLSKSTKTQQGLYEDLGYELKLYAARYGMQAPSDWDRCWTLNYADTAQFHMDLLPSVPDGQRQRLIREQRAMTLDFVDRSISITDKNHGNYARLSEDWPSSNPHGYADWFYECMKPAFDQRRRAMMLAEAKADIADIPVFRVKTPLQSAIQILKRHRDMRFSDDPDGRPTSVVISTLAAHSYGQESSVTGALISILQSMDRYIVDREGVSWIENPSNPRENFADSWEQEPARKDAFYDWLDTARTDFVRAAEQGDLSTIIDALAPRMGRELVEKAASHPGQKSLAEASVIKRAKSAFQKLVDAPHRKPVAWPTVPVGYVRVEGAMARNGFREVVLHNDGALLPRGSSLSFVANTDVPRPFKIYWQIVNTGEAAAKAKKLRGGFEQATVTTGTLIRRENASYAGSHTIECFVVKDGYCAARSGLFVVNIQ

SEQ ID NO: 870 - protein, 509 aa, Pseudomonas putida
MNRATAGEHFIGDLATALDIPPERYEAADRSYRSVCTWLERADSQFNGVDIQAYAQGSFRLGTVIRPLSGEEEYDLDVVFEFDLSKGRNTQEDVYEALGAELMAYARRYGMEPPQGWDRCWTLNYSDSAQFHMDLLPSVPDGQRQRVLREQRMLSLAHVQTSISITDRTHVNYRLRSDDWPSSNPKGYADWFYARMKPAFDQRRRAMMLAEAKADVEDIPSFRVKTPLQAAIQLLKRHRDMRFSEVEDGRPSSIIISTLAAHAYNQEGSVTGALLSILASMDQFIHERNGVTWIENPSNPRENFADGWEHEPVLKEGFYEWLEVARSDFALAAQQDDMESVIDILAPRMGRPLVESAVLPTSFQALARSREKRRSPNQRLADAPHRKPMTWPKVPGGNVHLLARSSQNGFRTGYVSSGVPVRRGCSLNFMATTDVAPPFKVYWQIVNTGKEAAKDKGLRGGFEMSTSELGSLWKDETALYIGTHTIECFIVKDNYCAARSGQFVVDIKA

SEQ ID NO: 871 - protein, 450 aa, Pseudomonas putida
MNRATAGEHFIGDLATALDIPPERYEAADRSYRSVCTWLERADSQFNGVDIQAYAQGSFRLGTVIRPLSGEEEYDLDVVFEFDLSKGRNTQEDVYEALGAELMAYARRYGMEPPQGWDRCWTLNYSDSAQFHMDLLPSVPDGQRQRVLREQRMLSLAHVQTSISITDRTHVNYRLRSDDWPSSNPKGYADWFYARMKPAFDQRRRAMMLAEAKADVEDIPSFRVKTPLQAAIQLLKRHRDMRFSEVEDGRPSSIIISTLAAHAYNQEGSVTGALLSILASMDQFIHERNGVTWIENPSNPRENFADGWEHEPVLKEGFYEWLEVARSDFALAAQQDDMESVIDILAPRMGRPLVESAVLPTSFQALARSREKRRSPNQRLADAPHRKPMTWPKVPGGNVHLLARSSQNGFRTGYVSSGVPVRRGCSLNFMATTDVAPPFKVYWQIVNTGK

SEQ ID NO: 872 - protein, 509 aa, Pseudomonas sp.
MNRATAGEHFIGDLATALDIPPERYEAADRSYRSVCTWLERADSQFNGVDIQAYAQGSFRLGTVIRPLSGEEDYDLDVVFEFDLSKGRNTQEDVYEALGAELMAYARRYGMEPPQGWDRCWTLNYSDSAQFHMDLLPSVPDGHRQRVLREQRMLSLAHVQTSISITDRTHVNYRLRSDDWPSSNPKGYADWFYARMKPAFDQRRRAMMLAEAKADVEDIPSFRVKTPLQAAIQLLKRHRDMRFSEVEDGRPSSIIISTLAAHAYNQEGAVTGALLSILASMDRFIHERNGVTWIENPSNPRENFADGWEHEPVLKEGFYEWLEVARSDFALAAQQDDMESVIDILAPRMGRPLVESAVLPTSFQALARSREKRRSPNQRLADAPHRKPMTWPKVPGGNVHLLARSSQNGFRTGYVSSGVPVRKGCSLNFMATTDVAPPFKVYWQIVNTGKEAAKDKGLRGGFEMSTSELGSLWKDETALYIGTHTIECFIMKDNYCAARSGQFVVDIKA

SEQ ID NO: 873 - protein, 509 aa, Pseudomonas putida
MNRATAGEHFIGDLATALDIPPERYEAADRSYRSVCTWLERADSQFNGVDIQAYAQGSFRLGTVIRPLSGEEDYDLDVVFEFDLSKGRNTQEDVYEALGAELMAYARRYGMEPPQGWDRCWTLNYSDSAQFHMDLLPSVPDGQRQRVLREQRMLSLAHVQTSISITDRTHVNYRLRSDDWPSSNPKGYADWFYARMKPAFDQRRRAMMLAEAKADVEDIPSFRVKTPLQAAIQLLKRHRDMRFSEVEDGRPSSIIISTLAAHAYNQEGSVTGALLSILASMDQFIHERNGVTWIENPSNPRENFADGWEHEPVLKEGFYEWLEVARSDFALAAQQDDMESVIDILAPRMGRPLVESVVLPTSFQALARSREKRRSPNQRLADAPHRKPMTWPKVPGGNVHLLARSSQNGFRTGYVSSGVPVRRGCSLNFMATTDVAPPFKVYWQIVNTGKEAAKDKGLRGGFEMSTSELGSLWKDETALYIGTHTIECFIVKDNYCAARSGQFVVDIKA

SEQ ID NO: 874 - protein, 512 aa, Pseudomonas tremae
MTQVTSVADRFIAQLASTLEIPGERYEAADRSYRSICRWLERPDSRFSRTNINAYIQGSFRLGTVIRPLNGEEHYDLDVVCEFGLDKGEHTQKQLFDDLGHELRLYAARHLMEEPSGWDRCWTLNYADSAQFHMDVLPSVPDGQRQRRLREASRLALAFVDKSISITDCNHPYYRHYTDDWPSSNPHGYADWFMSRMEVAFKERRQAMALNEAKADVADIPAFRVKTPLQSAIQILKRHRDLRFSEEPEGRPSSIIISTLAAHAYRQEATVTGALFSILSSMHQFIEMRGEVYWIANPSNPKENFADAWEAEPERRLAFEDWLDTARNDFARAGETADLQQLIDVLSPRIGRELLEKAATKISPSAVAKSASGRRLLGSMQRLFDAPHRKPVAWPTVPSGSVVLSCTVSKSGFRTTAVDDNGNPVPVGSSLRFEAISGLPRPYKVFWQVVNTGSAAQKAKDLRGGFVEGTVSAGNLVRMERASYRGSHTIECFIVKDGYCAARSGPFIVNIG

SEQ ID NO: 875 - protein, 512 aa, Pseudomonas mendocina
MKQVTSSADRFISQLASTLDIPDERYASADRSYRSICDWLERPESRFARVNINAYTQGSFRLGTVIRPLNGEEHYDLDVVCEFGVSKTSSTQKQLFDDLGHELKLYAARYSMEAPSGWDRCWTLNYADAAQFHMDLLPSIPDGQRQRTLREARKLSLEYVDKSISITDRNHPRYQQHTDDWPTSNPNGYADWFMSRMEVAFKERRRAMALYEAKADVADIPAFRVKTPLQSAIQILKRHRDLCFSERPDGRPSSIVISTLAAHAYQQEATVTGALFSILASMDRYIEVRGQTYWIANPSDPRENFADAWEAEPERKLAFDDWLDTARKDFERAGETEDLAQIIDLLSPRLGRELLEKAATRHSPGAVAKSVATRRLHGVIQRVFDAPHRKPVAWPTVPQGSVNLSGTMSRAGFRPTAVSSNGAAVPIGSSLRFEATTNLVWPYKVFWQVVNTGPAALRANDLRGGFVEGTVSAGNLVRNERASYKGSHTIECFIVKDGYCAARSGPFVVNIG

SEQ ID NO: 876 - protein, 508 aa, Brevundimonas sp.
MAITSQAEALLEALSKSLEVPESRYEAADRSYQAIAEWMRRPNSEFFDFDVSVYTQGSFRLGTAIRPASDAEDYDLDIVCEVSERKGQTTQKALHDAMGRETRSYARSKGMEPPEEWDRVWTLNYADGAQFHIDLLPSLPDGAQQRILLESGGFQYDRALTAIAITDRTHPFYTLTTESWPTSNPNGYASWFYERMAPVFRARREAIRVAEAKVDVADIPTYRVKTPLQVAVQILKRHRDLRFRDEPENRPSSIILTTLAAHAYNQETTISGALFSILERMDNHIEKRGEVHWIANPSDPRENFADSWNGEPHKSRAFFDWLETARSDFTAAARSSDYWEIVEALAPRMGRRLVEDALDQVSPRTGITASAASIFRRFLDAPHRKNPSWPTLQLGNVRIASVTADPKGFRAQEYPSDGPALPKETTLRFHAQTDLAKPYRVYWQIVNTGRQAAEARQLRGGFDEDSVERGKLTREETTRYNGSHSVEAFIVKDGYLVARSGLFIVNVM

SEQ ID NO: 877 - protein, 522 aa, Gammaproteobacteria bacterium
MKLETFTSVAPTTQAEQMLNDLADALEIPASRYDAAERSYKSVGSWLDRPGSRLADYETTIYPQGSFRLGTVIKPLSDEEDYDLDIVCEIQASKREYTQKQLKELLGLELKDYARSKHMEVPAEARRCWTLNYADDAQFHMDVLPALPDGARQKLLIEAMNRRSDLADLAMAITDRDHDAYELYSEDWPGSNPKGYSEWFRSRMKVVFDARRRAMALNERASVEEIPEHSVRTPLQAAIKILKRHRDMRFSEEPDIRPISIILTTLAAHAYNQEVSISGALQGILERMDRFIEVRDEVYWIENPTDPRENFADKWEETPNKKDAFYDWLAMARADVDMAVRMTDADAFVDALAPRMGRSLVESAVVHQKRLESLLDKKGQAKNFVSNKIRKILDAPHRKPVVWRELASGTVSIDEMTVTRHGFRPYAAGNDSDPLPKRADLVFHAKTSVSFPYKVYWQIVNTGLDASQQRGLRGGFEEGIVQAGRLEKRESTLYAGSHSMECFIVKDGYCVARSGPFIVNIL

SEQ ID NO: 878 - protein, 503 aa, Pseudomonas putida
MLTQLVDALEIPANRYEAAERSYKSVGRWLDRPASRLAGHTTTIFPQGSFRLGTVIKPLNDAEDYDLDIVCEIQASKLDYTQEELKALLGLELEDYASSQSMAPPAEARRCWTLNYADGAQFHMDVLPALPDGARQRQLIESLGHQNEWADHAMAITDHEHGEYRRHSTNWPGSNPKGYSEWFRFRMQEVFNARRHGMALKEHASVEEIPEHRVRTPLQAAVKLLKRHRDIRFSEEPDIRPISIILTTLSAHAYQQEVTIGGALQGILARMPEHIEIRDGAYWIENPTDPRENFADKWEASPEKKDAFFDWLSMARTDLEIAMRMTDADDFIDALSPRMGRQLVEQAVTPSKAASGLNLSLARGRVSSKLRKILDAPHRKPLAWPDLARGSVHIAEMTVTRNGYQPYSVGSDAAALPKNSSLVFHAQTSVVYPYKVYWQVVNTGEDASRRRALRGGFDEGVVQGGRLEKRENTLYSGSHSMECLIVKDGYCVARSGPFIVNIL

SEQ ID NO: 879 - protein, 520 aa, Pseudomonas sp.
MKLETFTPVGPTDQSEQMLTQLVDALEIPASRYEAAERSYKSVGRWLDRPASRLAGHTTTIFPQGSFRLGTVIKPLNDAEDYDLDIVCEIQASKLDYTQEGLKGLLGLELEDYALSQSMAPPVEARRCWTLNYADGAQFHMDVLPALPDGVRQRQLIESLGHQNEWADHAMAITDREHVEYRRPSANWPGSNPKGYSEWFRSRMEEVFNAKRHGMALKEHASVEEIPEHRVRTPLQAAVKLLKRHRDIRFSEEPDIRPISIILTTLSAHAYQQEVTIGGALQGILTRMSEHIEIRNGVYWIENPTDPRENFADKWEASPEKKDAFFDWLSMARTDFEIAMRMDDTDDFIDALSPRMGRQLVEDAVTPSKASSGLNLSLARGRVSSKIRKILDAPHRKPLAWPDLARGSVHISEMTVTRNGYQPYSLGSDAAALPKNSSLVFHAKTSVVYPYKVYWQVVNTGEDASRRRALRGGFDEGVVQAGRLEKRESTLYSGSHSMECLIVKDGYCVARSGPFIVNIL

SEQ ID NO: 880 - protein, 536 aa, Janthinobacterium sp.
MRSSANFASTANMNQLTAPLTTVTPTKKAESLLEALAASLEISPSKYQAAERSYKSVGKWLDRPESIFAGRNVTVYPQGSFRLGTVIPPHNEDGHYDLDVVCEIEMDKLELTQKQLKEKLGYEVAAYAEAHCMDEPTEARRCWTLNYADGAQFHMDILPALPDGQRQKLLAEAAGLHAESLYKALAITCRLGENYNRRTNDWPGSNPKGYSDWFRERMKVVFNARRESMRLYEARASVEEIPEYRVTTPMQSAIKILKRHRDMRFTGDEELRPISIILTTLGALAYNQETTISGALFGILSRMEFHIKLRNGVHWIENPADPRENFADKWEETPGKKEAFYDWLQTAKEDFALAANAKYEEEFIDVLAPRMGRSLVEAAARSVRPTTGQYLVEAVGKLPKRLLAFRDAPHRKPMTFPSLTGVNASVSLTMDVSRSGFRPETRTEDGLPVWPGSSLTFNAHTTIPKPFKVFWQVVNTGEEAIKVRDLRGGFDEGIVQAGGISRTETARYKGSHSIECFIVKDGYCLAKSGPFIVNIN

SEQ ID NO: 881 - protein, 524 aa, Janthinobacterium sp.
MNQLTAPLTTVTPTKKAESLLEALAASLEISPSKYQAAERSYKSVGKWLDRPESIFAGRNVTVYPQGSFRLGTVIPPHNEDGHYDLDVVCEIEMDKLELTQKQLKEKLGYEVAAYAEAHCMDEPTEARRCWTLNYADGAQFHMDILPALPDGQRQKLLAEAAGLHAESLYKALAITCRLGENYNRRTNDWPGSNPKGYSDWFRERMKVVFNARRESMRLYEARASVEEIPEYRVTTPMQSAIKILKRHRDMRFTGDEELRPISIILTTLGALAYNQETTISGALFGILSRMEFHIKLRNGVHWIENPADPRENFADKWEETPGKKEAFYDWLQTAKEDFALAANAKYEEEFIDVLAPRMGRSLVEAAARSVRPTTGQYLVEAVGKLPKRLLAFRDAPHRKPMTFPSLTGVNASVSLTMDVSRSGFRPETRTEDGLPVWPGSSLTFNAHTTIPKPFKVFWQVVNTGEEAIKVRDLRGGFDEGIVQAGGISRTETARYKGSHSIECFIVKDGYCLAKSGPFIVNIN

SEQ ID NO: 882 - protein, 501 aa, Unknown
  Description of Unknown: Duganella sequence
MADSLEIPDGKYVAAERSYKSVGSWLDRKESVFAGNNVSVYPQGSFRLGTVIPPHDRDGQYDLDVVCEISMDKLELTQKQLKAKLGEEVKAYARAHGMAEPTEARRCWTLNYADGEQFHMDILPALPDGLRQKLRAMAAGLKESSLDQSLAITCIYDENYDRRTNDWPGSNPKGYSDWFREQMKIVFNARRERMRLYEMRASVEEIPEYRVTTPMQSAIKILKRHRDMRFTGDEELSPISIILTTLSALAYNQETTITGALFGILERMASHIEQRNGVYWIENPADPRENFADKWQETPAKKDAFYEWLELAKEDFALAASANAEGDFIEAMAPRMGRSLVEGAVKRGSPTIGHSLAASATNFSKKILKFRDAPHRKPMTLPLLTGANGNVSLSLTVSRNGYRPDARSSDGEFVTRGSTLTFNARTTIQKPFKVFWQVVNTGDEARVARDLRGGFDEGIVQSGDLSRNETARYSGSHSLECFIVKDGYCVAKSGQFIVNIK

SEQ ID NO: 883 - protein, 511 aa, Hyphomicrobium denitrificans
MTQIFRYKILDDLLEDLAEELDVPASRYEAAERAYKSVGAWLERPESALRVLKPRTYVQGSFALGTATKPVTDEDDYDVDAVCELQHSKASVTQQQLKDSLGEELRLYARAQSMNEEPERRNRCWMLPYADEAQFHLDVLPSLPDAATAQILYEQRGLTNPWGGSALAITDERHPEFRVISPRWLRSNPKGYAAWFRSRMAVVFDQRRRMLAERARAKVEDIPEYKVKTPLQAAIQILKRHRDIWALDQADRKPISIILTTLGARAYQQETSVAAALFRLLQDMDKYIERRGAATWIANPSDPLENFADRWILEPDREVAFHEWLERAKSDFRTAASYSDRAQLIAVLSGGLGERAVRVAAGKRVATPGLLVTISRSLKQLFNAPHREKPAWPEALANKVSIADARVEQKGFRPKKFTSDGGPLPKNCSLTFIAQTDVQHPYRVYWQIVNTGADATRANGLRGQFEEGIIERGTLTRKEGTEYAGTHSIECFIVKDGLLVARSQPFIVNIK

SEQ ID NO: 884 - protein, 512 aa, Pseudoxanthomonas sp.
MKLSQIAPNSDDWFEKLGEAINLPDSMYQAAERSYKSVSSWLERDDSFFSSVDFHVYTQGSFRLGTAIAPLDPEEEYDLDIVCQFSLSKLEYTQRAIHEALGRELNAYAARYGMEQPSAWDRCWTLNYAESAQFHMDVLPCVPDAARQRYLRESLGVDTAFVESAVSITDRTHQNFSLVSEEWPSSNPNGYANWFRERMKLAYDRRLEKIKLVEAKVDVDEIPEFSIRTPLQLAIQILKRHRDVYFSTRHGDLKPSSIVITTLAAHSYQQQSTVATALEGLLQGMANFVERKGKTYFIPNPSDPRENFADAWNVEGAKAESFYAWLEVAREDFWRARDRVNLSDFMKELAPNLGEALLENAFADEPRRRAGSRWKISRIMAAKHKCPPEWPVSDRGKVSLDVEVHRDGFRPSSIQSDDSEVARWARVHFRANTDVPAPFEVFWQVVNTGRAATDDENLRGNFDRQVEAHGHLRRTETAQYPGSHSIECFIVKNGFVAARSGIFIVNVASSSL

SEQ ID NO: 885 - protein, 345 aa, Streptococcus dysgalactiae
MKKFEMSKEIKELINEIDVSESNYEKASNRYKAIANYIKESDLAKYSPDIYLQGSIKLGTAIKPLTEDGAYDIDIVCNMTKKRRHHQTQRELKDELGKVVKNYSLKHSMENFPKESNRCWTLNYVDESNFHIDILPAVPWNDTDDGNIAISDKRSDNYDDITFNWEVSSPKVYSDWFKKQSDFQMIKESYAKRFYAKIEEIPDYKIKTPLQRIVQLLKRHAEVMFEDDMEQKPSSIIITTLVAKIYPESMIISDDFKTLLLNVVKNLLSGIEYENENPCIYNPVNRKEKLSLKWDKDGKYFENFLKWYDQLKVDFSIDNKAMSLNESLFYMQRSLRKILMKLESR

SEQ ID NO: 886 - protein, 493 aa, Staphylococcus sp.
MKKFEMSKEIKELINEIDVSESNYEKASNRYKAIANYIKESDLAEYSPDIYLQGSIKLGTAIKPLTEDGAYDIDIVCNMTKKRRNHQTQRELKDELGKVVKNYSLKHSMENFPKESNRCWTLNYVDESNFHIDILPAVPWNDTDDGNIAISDKRSDNYDDITFDWEVSSPKVYSDWFKKQSDFQIIKESYAKRFYANIEEIPDYKIKTPLQRIVQLLKRHAEVMFEDDMEQKPSSIIITTLVAKIYPESMIISDDFKTLLLNVVKNLLSGVEYENENPCIYNPVNRKEKLSLKWDKDGKYFENFLKWYDQLKVDFSIDNKAMSLNESLFYMQRSLRKNTNEIGISLNSLSYHQKPKWKLSSIAKTNVEIKAYYSWRGFRFKQIKSGEALNKKGKLRFEVNALTLNIKDYDIYWQITNTGYEAINANCLRGDFYNSKLEQGKRIRTEETCYVGRHYVEAYLVKNGICYGKSKPFEVNIIDGITFEWFNTKKLGG

SEQ ID NO: 887 - protein, 493 aa, Veillonella parvula; identical to SEQ ID NO: 886

SEQ ID NO: 888 - protein, 493 aa, Streptococcus dysgalactiae
MKKFEMSKEIKELINEIDVSESNYEKASNRYKAIANYIKESDLAKYSPDIYLQGSIKLGTAIKPLTEDGAYDIDIVCNMTKKRRHHQTQRELKDELGKVVKNYSLKHSMENFPKESNRCWTLNYVDESNFHIDILPAVPWNDTDDGNIAISDKRSDNYDDITFNWEVSSPKVYSDWFKKQSDFQMIKESYAKRFYAKIEEIPDYKIKTPLQRIVQLLKRHAEVMFEDDMEQKPSSIIITTLVAKIYPESMIISDDFKTLLLNVVKNLLSGIEYENENPCIYNPVNRKEKLSLKWDKDGKYFENFLKWYDQLKVDFSIDNKAMSLNESLFYMQRSLRKNTNEIGISLNSLSYHQKPKWKLSSIAKTNVEIKAYYSWRGFRFKQIKSGEALNKKGKLRFEVNALTLNIKDYDIYWQITNTGYEAINANCLRGDFYNSKLEQGKRIRTEETCYVGRHYVEAYLVKNGICYGKSKPFEVNIIDGITFEWFNTKKLGG

SEQ ID NO: 889 - protein, 493 aa, Gemella asaccharolytica
MKKFEMAKEIKELINEIDVSESNYEKASNRYKAIANYIKESDLAEYSPDIYLQGSIKLGTAIKPLTEDGAYDIDIVCNMTKKRRHHQTQRELKDELGKVVKNYSLKHSMENFPKESNRCWTLNYVDESNFHIDILPAVPWNDTDDGNIAISDKRSDNYDDITLDWEVSNPKGYSDWFKKQSDFQTIKESYAKRFYAKIEEIPDYKIKTPLQRIVQLLKRHAEVMFEDDMEQKPSSVIITTLIAKIYPKCTIISDDFKTLLLNVVKNLLSGIEYENENPCIYNPVNRKEKLSLKWDKDKKYFENFLKWYDQLKVDFSVDNKVLPLNESMFYIQRSLRKNTNEIGISLNSLSHHQKPKWKISSIAKTDLEIKAYYSWHGFRFKQIKSGEALNKKGKLRFEVNALTLNIKDYDIYWQITNTGYEAINANCLRGDFYNSKLEQGKRIRTEETCYAGRHYVEAYLVKNGIFYGKSKPFEVNIIDGLTFEWFNTKKLRG

SEQ ID NO: 890 - protein, 497 aa, Peptoniphilus senegalensis
MKKFEMSKEIKELINEIDVSESNYEKASNRYKAIANYIKESDLAEYSPDIYLQGSIKLGTAIKPLTEEGAYDIDIVCNLTKKRRHYQTQRELKDELGKVVKNYSLKHSMENFPKESNRCWTLNYVDESNFHIDILPAVPWNDTDDGNIAISDKRSGNYDNITFDWEVSNPKRYSDWFKKQSDFQMIKESYAKRFYAKIEEIPDYKIKTPLQRIVQLLKRHAEVMFEDDMEQKPSSVIITTLVAKIYPKCTIISEDFKTLLLNVVKNLLSGIEYENENPCIYNPVNGKEKLSLKWDKDRKYFESFLKWYDQLKVDFSVDNKALSLNESLFYIQRSLRKNINEIGISLNSLSHHQKPKWKISSIAKTDVEIKAYYSWHGFRFKKIKSGEALNKKGKLKFEVNALTLNIKDYDIYWQITNTGYEAINANCLRGDFYNSKLEQGKRIRTEETCYAGRHYVEAYLVKNGICYEKSKPFEVNIIDGLTFEWFNTKKIKRVVYA

SEQ ID NO: 891 - protein, 487 aa, Gemella cuniculi
MRAFYMSKEIKELIDEIDISESNYEKASNRYKAIATYIKETDLAKYSPDIYLQGSIKLGTAIKPLTEDGAYDIDIVCNMTKKRRNHQTQRELKDELGKVVKNYSIKHSMEKVPKESNRCWTLNYLDESNFHIDILPAVPWNDMEDGNVAISDKRSDNYDDITFDWEVSNPKGYSKWFKKQSDFKTIKESYAEQFHAKIEEIPDYKIKTPLQRIVQLLKRHAEVMFADDMEYKPSSIIITTLAAKIYPEYTTVSNDFETLLLNVIRKLLNGVEYENENPCIYNPVNRKEKLSLKWDRNRQYFENFLKWYDQLKVDFSVDNEALPLNESLFYIQRSLHKNSNEIGISLNSLSHHQKPKWKLSSIAKTDVEIKAYYSWRSFRFKRIKSGEALNKKGKLRFEVKALNIKGYDIYWQITNTGYEAINANCLRGDFYNSELEQGKRIRTEETCYTGRHYVEAYLVKNDICYGKSKPFEVNIIDGIFNAKQLGK

SEQ ID NO: 892 - protein, 207 aa, Campylobacter rectus
MSLTKYSPDIYLQGSIKLGTAIKPLTEDGAYDIDIVCNMTKKRRHHQTQRELKDELGKAVKNYSLKHGMENFPKESNRCWTLNYVDESNFHIDILPAVPWNDIDDGNIAISDKRSDNYDDITFDWEVSNPKGYSEWFKKQSDFKTIKESYAKQFYAKIEEIPDYKIKTPLQRIIQLLKRHAEVMFADDMEYKPSSIIITTLAAKNLS

SEQ ID NO: 893 - protein, 216 aa, Streptococcus sp.
MVDIVIPKEIKSLIEELDVSDSKYEKATQRYNSIADYIKNSELSSYRPDIYLQGSFKLGTAIKPLTEDGAYDIDIVCNFTGLRREGQSQFSLKYDLGKIVKSYAKSQSMSNAPEESKRCWTLKYVDENNFHIDILPSVPLNEKDDGYIAITDKSNNNYYEVSTDWETSNPKGYAKWFRDISKFSIYQEEVAKRFYASIEKFPNIRLKHHCKGLYRF

SEQ ID NO: 894 - protein, 216 aa, Streptococcus oralis
MVDIVIPKEIKSLIEELDVSDSKYEKATQRYNSIADYIKNSELSSYRPDIYLQGSFKLGTAIKPLTEDGAYDIDIVCNFTGLRREGQSQFSLKYDLGKIVKSYAKSQSMSNDPEESKRCWTLKYVDENNFHIDILPSVPLNEKDDGYIAITDKSNNNYYEVSTDWETSNPKGYAKWFRDVSKFSIYQEEVAKRFYASIEKIPDIRLKHHCKGLYRF

SEQ ID NO: 895 - protein, 485 aa, Streptococcus oralis
MVDIVIPKEIKSLIEELDVSDSKYEKATQRYNSIADYIKNSELSSYRPDIYLQGSFKLGTAIKPLTEDGVYDIDIVCNFTGLRREGQSQFSLKYNLGKIVKSYAKSQSMSNDPEESKRCWTLKYVDENNFHIDILPSVPLNEKDDGYIAITDKSNNNYYEVSTDWETSNPKGYAKWFRDVSKFSIYQEEVAKRFYASIEKIPEYKVKTPLQRIVQILKRHAEVCFADDIEHKPSSIIITTLAAKQYQSASSYNSDFLDIMNYVIEHLKDGIEIRNGKPCVHNPVNEEEVLSSKWDKDSSYFEFFKIWLQQLESDFNVRNHNLSYSDKIQYLRRSLFRDCENQLPITSVSLIPHHQKSKWLNLSKEEVSIKAKYLHSGFRWKEIKSGTILNKHGELRFEVQAKRLKDYEIWWQVTNTGKEAENANCLRGDFYSSELIEGKKVRKESTRYAGRHYVEAYLVKNGICYGKSSPFEVNIADDFSLDFLR

SEQ ID NO: 896 - protein, 485 aa, Unknown
  Description of Unknown: Streptococcus sequence
MTDITISKEIKSIMEELDVSYSKYEIATNRYNSIANYIKNSELSKNSPDIYLQGSFKLGTAIKPLTEDGAFDIDIVCNFTKLRRNDQSQYSLKNNLGEIVKSYAKAQSMSSGPEESKRCWTLKYVDESNFHIDILPSVPLNEKNDGFIAITDKTHENYFEITSNWETSNPKEYAKWFRDLSKFAIYHKEVAKRFSASIEKVPEYRVRTPLQRIVQILKRHAEVCFEKDIEYKPSSIIITTLAAKQYQAASTIYSDFLDIINYVIEHLKDAIDFRDGKPCVYNPVNKDEVLSNKWDKDSSYFEAFEKWLEQLKLDFNVGNYNLSYLDKIKFIRTSLFKNSGEQFPIVNVNSISHHQNSKWKEFLIEDVSIKASYLYKGFRWKKIESGTKLNKHGSLKFEVQANSILGYEIWWQVTNTGREAELANSLRGGFYNSELVEGKRVRKESTLYTGRHYVEAYLVKNGICYGKSIPFEIIITDKFSMDFAH

SEQ ID NO: 897 - protein, 485 aa, Streptococcus parasanguinis
MTDITISREIKSIIEELDVSYSKYEIATNRYNSIANYIKNSELSKNSPDIYLQGSFKLGTAIKPLTEDGAFDIDIVCNFTKLRRNDQSQYSLKNNLGEIVKSYAKAQSMSSEPEESKRCWTLKYVDESNFHIDILPSVPLNEKNDGFIAITDKTHENYFKITSNWETSNPKEYAKWFRDLSKFSIYQKEVAKRFYASIEKVPEYRVRTPLQRIVQILKRHAEVCFEKDIEYKPSSIIITTLAAKQYQSASTIYSDFLDIINYVIEHLKDAIEFRNGKPCVYNPVNKDEVLSNKWDKDSSYFEAFEKWLEQLKLDFNVANYNLSYLDKIKFIRTSLFKNSGEQFPIVNVNSISHHQNSKWKEFLIEDVSIKASYLYKGFRWKKIESGTKLNKHGSLKFEVQANSILGYEIWWQVTNTGREAELANSLRGGFYNSELVEGKRVRKESTLYTGRHYVEAYLVKNGICYGKSIPFEIIITDKFSIDFAH

SEQ ID NO: 898 - protein, 485 aa, Streptococcus intermedius
MADITISKEIKSLIEELDVSDSKYEAATNRYNSIANYIKNSGLNKNNPDIYLQGSFKLGTAIKPLTDDGAYDIDIVCNFTRLRRNNQSQFSLKYDLGEIVKSYAKAQSMSNEPEESKRCWTLKYVDENNFHIDILPSVPLNEKNDGFIAITDKTHDNYFKITSNWETSNPKGYAKWFRDISKFSTYQKEVAKRFYASIEKVPEYRVRTPLQRIVQILKRHAEVCFEKDIKYKPSSIIITTLAAKQYQPASTIYSDFLDIINYIIEHLKDAIEFRNGKPCVYNPVNKEEVLSNKWDKDRSYFEAFEKWLEQLKLDFNVGNYNLSYLDKTKFIRNSLFKNNGEQFPIVNVNSISHHQNSKWKESLIKDVSIKASYLYKGFRWKKIESGTKLNKHGSLKFEVQADGLQGYEIWWQVTNTGREAELANSLRGGFYNSELVEGKRVRKESTRYTGRHYVEAYLVKNGICYGKSIPFEIIITDKFSMDFAQ

SEQ ID NO: 899 - protein, 485 aa, Streptococcus suis
MKDIIINNEIQALIQELDVPDSKYEQATKRYNSIANYIKNSELNSNRPDIYLQGSFKLGTAVRPLTDDGSYDIDIVCNFTALRRENQSQFSLKYDLGEVVKSYAKAQSMSNDPEESKRCWTLKYVDENNFHIDILPSVPLNEKDDGFIAITDKTHDAYFETTSNWETSNPKGYATWFRDISRFSIYQTEVAKRFYASIEKVPEYKVRTPLQRIVQLLKRHAEVCFEEDFEHKPSSIIITTLAAKQYQSASTYHSDFMDIINYIIEHLEDSIEFRDGKPCVYNPVNKAEVLSNKWDKDSSYFEAFEKWLEQLKLDFNVGNNNLSYLDKINCIRKSLFKKIGDQFPVVNVNSISHHQNSKWRELLIKDVSIKTSYLHKGFRWKDIKSGTILNKHGSLKFEVQASGLQDYDIWWQVTNTGREAELANSLRGDFYGSELVEGRRVRKESTLYTGRHYVEAYLVKNGVCYGKSNPFEIIITDKFSIDFVR

SEQ ID NO: 900 - protein, 485 aa, Streptococcus mutans
MENIIIGKEIKELIEELDVSDSEYEEATKRYNSIAEYIKNSELGSEKPDIYLQGSFKLGTAIRPLTEDGAYDIDIVCNFTKLKKEDQSQSSLKYELGKVVKQYAKSKSMSNDPKESKRCWTLKYVDDNNFHIDILPSVPLHNKDDEYIAITDKAKDNYFEISSNWETSNPKGYADWFREVSKYTVYQEKIAKRFYASIEKVPEYKVRTPLQRIVQILKRHAEICFEDDIEFKPGSVIITTLAAKQYRLASSIHNDFWDVISYIINHLKDGIELRNGKPCVYNPVNYSEVLSGKWDKDKRYVEAFNNWLKQLESDFNIGNDEITYPNRIQYLKRSLFKNARSQFPIINVTSLRHHQKSKWTECLVKDVFVKAMYSQNGFRWKTIRSGTALNKHGDLKFEVKANDLKQYEIWWQITNTGKEAENANSLRGDFYSSELIEGKKIKKESTLYTGRHFVEAYLVKDGICFGKSQPFEVNIVDNFTLDFAR

SEQ ID NO: 901 - protein, 484 aa, Mycoplasma simbae
MKEIFIQKELKQLIEELDVSDSNYVKATNRYHSIAKYLKNSPLSDKKPDIYLQGSFKLGTAIKPLSSDGNYDIDIVCNFTSLKKHDQSQFSLKQSLGEVLCNYSKSHSMSNDLEESKRCWTLKYVDEDNFHIDILPSVPLNDQNDGFIAITDKTKPSYNEISDDWETSNPKAYAEWFRNISEFHLYRNSIARRFCTSIEEVPEYTVKTPLQRIIQILKRHAEICFSNNLEFKPSSIIITTLAAKQYTFASHYSNDFFKIMSYIIENLKNGIKFIADRPCVLNPVNEKELLSGKWDKDAKYYKSFEDWIIQLNSDFNINNPDIPYSQRIQYIKRSLFKNNAEFLPIIDVKTIAHRKKSKWSHLERETVIIKANYLYKGFRWKEINSGVALNRNGELKFEVIANNIKDYEIWWQITNTGDEARVANCLRGDFYNSVLVEGKRIRKEYTAYVGHHFVEAYLIKNGVCYGKSDPFDVNIVSNPTFSWY

SEQ ID NO: 902 - protein, 476 aa, Streptococcus sanguinis
MKKLRPVPELEELIESIDISDANYEKATNRYYSIVDYISDSELSNYRPDIFLQGSIKLGTAIKPLTNDGNYDVDIVCNFTGKHMLEQSQEDLKNLLGKYIKSYMQKHSMKKEPYNGNRCWTIEYSDDVNFHVDILPSVPYSDSQTDDIAITDKRHHDFNNLSNSWELSNPKGYYKWFRAQSNFEHYKEEYKRLNQIFEEFPEYTIKTPLQRIVQLLKRHAEVCFENELEYKPSSIIITTLAAKSYQKVVSKSETFEELLENVILHLIEGIDNDSTNRKCVLNPVNEKENLSTKWSEDERYFKKFLYWLEQLYSDFSTNIEFSDSMKMFYIRRSIDNKNFNIGIDLKELSYYEKSKWSESLILPISISAFFRQDNTRKRIKSGEVISKNGDVDFELIGNFPPTYDIYWKITNTGMEATNANCLRGNYFKGKRFLKEKTSYFGRHYVEAYIVSNNICYGKTIPFEVNITNTFLSDLIN

SEQ ID NO: 903 - protein, 476 aa, Streptococcus pseudopneumoniae
MKKLRPVPELEELIESIDISDANYEKATNRYYSIVDYISDSELSNYRPDIFLQGSIKLGTAIKPLTNDGNYDVDIVCNFTGKHMLEQAQEDLKNLLGKYIKSYMQKHSMKKEPYNGNRCWTIEYSDDVNFHVDILPSVPYGDSQTDDIAITDKRHHDFNNLSNSWEISNPKGYYKWFRAQSNFEHYKEEYKRLNQIFEEFPEYTIKTPLQRIVQLLKRHAEVCFENELEYKPSSIIITTLAAKSYQKVVSKSETFEELLENVILHLIEGIDNDSTNRKCVLNPVNEKENLSTKWSEDERYFKKFLYWLEQLYSDFSTNIEFSDSMKMFYIRRSIDNKNFNIGIDLKELSYYEKSKWSESLILPISISASFRQDNIRKRIKSGDVISKNGDIDFELKGNFPPTYDIYWKVTNTGMEATNANCLRGNYFKGKRILKEKTSYFGRHYVEAYIVSNNICYGKTIPFEVNITNTFLSGLIN

SEQ ID NO: 904 - protein, 472 aa, Butyrivibrio hungatei
MIKYSKQLMELLKDIEVPDSDYEKAVSRYEAVANYINNHFEQYGPELFLQGSFKLGTAIKPLTDDGAYDIDIVCCMKAYSKKQISQNRLKKVVGEAVVSYANANSMKEEPHDGKRCWTLSYVDEHNFHLDILPSVVNDGWSNVIAFTDKRNPNYYDISNNWNISNPKDYYKWFIEISQHSLYKKQFAAVQMRAIEKVPDYKVKTPLQRAIQLFKRHAEVMFENDMEHKPSSIIITTLSAKAFGTYGSNIESFEDLLSILSNKLILFLDRENGKECVKNPVNQNENLSEKWMNDNTYYQEFLKWQKKLSEDFSFDRYETRAFAYSNLEGSLKRKHSIISQNERNVLAIPHHKKPKWRLKLSKDVRISAKYKLNGGIFHPLKNGTPLMKQVDLRFEIQADNLRSYDIFWQVTNTGYEASSVGQLRGDFYNSDIIEGKRVRTESTKYKGDHYVEAYIVKDEICYGKSEPFLVIVV

SEQ ID NO: 905 - protein, 464 aa, Butyrivibrio hungatei
MELLKDIEVPDSDYEKAVSRYEAVANYINNHFEQYGPELFLQGSFKLGTAIKPLTDDGAYDIDIVCCMKAYSKKQISQNRLKKVVGEAVVSYANANSMKEEPHDGKRCWTLSYVDEHNFHLDILPSVVNDGWSNVIAFTDKRNPNYYDISNNWNISNPKDYYKWFIEISQHSLYKKQFAAVQMRAIEKVPDYKVKTPLQRAIQLFKRHAEVMFENDMEHKPSSIIITTLSAKAFGTYGSNIESFEDLLSILSNKLILFLDRENGKECVKNPVNQNENLSEKWMNDNTYYQEFLKWQKKLSEDFSFDRYETRAFAYSNLEGSLKRKHSIISQNERNVLAIPHHKKPKWRLKLSKDVRISAKYKLNGGIFHPLKNGTPLMKQVDLRFEIQADNLRSYDIFWQVTNTGYEASSVGQLRGDFYNSDIIEGKRVRTESTKYKGDHYVEAYIVKDEICYGKSEPFLVIVV

SEQ ID NO: 906 - protein, 508 aa, Alkaliphilus metalliredigens
MLLFSEIDDYYEQLYKELDIPESYYEKANTSYSSFSNWLGRDDSTLREHQPQIFLQGSFKLGTVIKPIGENDSYDIDMVCKFNNLSKQEISQKELKTLLGQEVTTYAKSKGMINEPKNGKRCWTLNYHDEAKFHMDILPCVDDSKKFIDQLEIFKYAETTSYKERAIAITDKRSEAYNMISNDWEISNPQGYYLWFQEQSNFIEKRAMLAEKFQMKAEELKEYKVKTPLQKTIQILKRHRDIMFKDNPEKKPSSIIISTLAAKAYRGGDNIRDVLKYVVDNMNGYIQEINGEYRILNPVNPLENFADKWNGDQSLKNHFDTWLKEAKKSLTPYNESIDIYGDDFQKKISEQLGISEAKSKDLVKADKVMTRVEAIPHRQKPNWNVYSWVDIYIKATKTKSGFSFPKQFNSGDFLTKNVDLKFEAKAENIKQYEVHWQVTNTGTEAKSSNCLRGDFYDGQIVEGKRIRKESTSYVGTHIIECYLVKNGVCHGKSKPFIVNIRDGFSMEW

SEQ ID NO: 907 - protein, 511 aa, Proteiniclasticum ruminis
MLLFSQIDDFYEQLYKELDIPENYYEKANTSYTSFNSWLDRDESSLREYEPEIYLQGSFKLGTVIKPVGENDSYDIDMVCKFNNLSKQTISQKDLKTLLGKEVKSYAKSKNMINEPKNGKRCWTLNYHDEAKFHMDVLPCVDDSKKFIDQLEIFKYAETTSYKERAVAITDKRSEGYETISNDWEISNPQGYFLWFQEQSNFIEKRAMLAEQFQMKAEELKGYKVKTPLQKTIQILKRHRDIMFENNPDQKPSSIIISTLAAKAYNGGDNLRDVLKFVLHNMAKYIEVVDGEYKILNPVNPLENFADKWNEKQTLKNHFDNWLKEAKKGLTPYNETIDIYGDALQKTASEQLGVNEKRAFDVGKTNEIESKLITFAESIHHHQKPKWTMLNVKEVNIKALKSKKAFRFKSFASGDILPKNATLRFEAQSENIKQYDVYWQITNTGNEAQNSNCLRGDFYDGQIIEGKKVREESTLYSGTHIVECYLVKENICYGKSKPFVVNITDRFMLEW

SEQ ID NO: 908 - protein, 517 aa, Collinsella aerofaciens
MSDERVYRGYMEGQLKRALADIEIPDSYYEKAETAYNSICNDLTDQNCVLSTLGPEAILQGSMRLGTAVKPIDENGSYDVDMVCNLRTLSKSVTTQAHVKKVVGDEVKKYAKRHGMTKPPHEGKRCWTLEYVDDVNFHIDILPTIDDTSNHADCLRNRGFGVPDDARYLAHTDKRHPRYSEICSDWASTNPRGYARWFFKVADLRTYRERLAKARNVTFESIRPYRVKTPLQQYVQLLKRHRDVFLSNQQMSRGQIRSVVVTTLAAKAYEQIIHHSGWYNDFIEVVQGLSTHIRKTPDGCYELVNPADQLENFLKDWTEEDANLFYRWCEAVSDDLGQLPSTLKKGIFNRYPARSIRESLGLPKQSSSDCNCKGVRGYLDRLPHHKQHGGIEIDLLSIKIKAEKMRNGGTFVPFESDTPLPKNVSLRFSAAGDNFDGFTLKWQVTNDGREAIAANCLRGDFYLSDTSARGRKARGEKTYYIGRHYVECVAEKDGVVYGRSDPFVVNITNDDASRRNW

SEQ ID NO: 909 - protein, 396 aa, Providencia alcalifaciens
MSNSKSNDVLNTILEKIELPDSAYEKAEKRYKDLGDWLHRPESTCVNFDPHVFSQGSFRLGTAIRPDSEEQYDLDMGCNLRRGLDKTSITQKQLKHLVGHELEFYRNARGIKEELAEKKRCWRLEYADGLSFHMDIVPCVPESDTGRGLLKKRMVENSKFDENLAQNVSQLAVSITDNTDSTYAVVNENWRISNPEGYARWFETRMKTARLVINEREMRFKASIDSLPYYQWKTPLQQVIQLLKRHRDTMFKNNEDSKPISVIITTLAAKSYKGESDLASALNTVLSEMDDHISAQAPMIPNPVNPAEDFADKWYDEKSAQYRLQENFYKWLYQARADFSALCSSDDTQRIVNAAQNGLDLKLDSSSVARLLGIPAVTAKPTFAIQSSDPKPWFKQ

SEQ ID NO: 910 - protein, 396 aa, Vibrio fluvialis
MSNSKSNDVLNTILEKIELPDSAYEKAEKRYKDLGDWLHRPESTCVNFDPHVFSQGSFRLGTAIRPDSEEQYDLDMGCNLRRGLDKASITQKQLKHLVGHELELYRNARGIKEELAEKKRCWRLEYADGLSFHMDIVPCVPESDTGRGLLKKRMVENSKFDENLAQNVSQLAVSITDNTDSTYAVVNENWRISIPEGYARWFETRMKTARLVINEREMRFKASIDSLPYYQWKTPLQQVIQLLKRHRDTMFKNNEDSKPISVIITTLAAKSYKGESDLASALNTVLSEMDDHISAQAPMIPNPVNPAEDFADKWYDEKSAQYRLQENFYKWLYQARADFSALCSSDDTQRIVNAAQNGLDLKLDSSLVARLLGIPAVTAKPTFAIQSSDPKPWFKQ

SEQ ID NO: 911 - protein, 396 aa, Unknown
  Description of Unknown: Gammaproteobacteria sequence
MSNSKSNDVLNTILEKIELPDSAYEKAEKRYKDLGDWLHRPESTCVNFDPHVFSQGSFRLGTAIRPDSEEQYDLDMGCNLRRGLDKTSITQKQLKHLVGHELELYRNARGIKEELAEKKRCWRLEYADGLSFHMDIVPCVPESDTGRGLLKKRMVENSKFDENLAQNVSQLAVSITDNTDSTYAVVNENWRISNPEGYARWFETRMKTARLVINEREMRFKASIDSLPYYQWKTPLQQVIQLLKRHRDTMFKNNEDSKPISVIITTLAAKSYKGESDLASALNTVLSEMDDHISAQAPMIPNPVNPAEDFADKWYDEKSAQYRLQENFYKWLYQARADFSALCSSDDTQRIVNAAQNGLDLKLDSSSVARLLGIPAVTAKPTFAIQSSDPKPWFKQ

SEQ ID NO: 912 - protein, 396 aa, Unknown
  Description of Unknown: Solemya velum gill symbiont sequence
MSNSKSNDVLNTILEKIELPDSAYEKAEKRYKDLGDWLHRPESTCVNFDPHVFSQGSFRLGTAIKPDSEEQYDLDMGCNLRRGLDKTSITQKQLKHLVGHELELYRNARGIKEELAEKKRCWRLEYADGLSFHMDIVPCVPESDTGRGLLKKRMVENSKFDENLAQNVSQLAVSITDNTDFTYAVVNENWRISNPEGYARWFETRMKTARLVINEREMRFKASIDSLPYYQWKTPLQQVIQLLKRHRDTMFKNNEDSKPISVIITTLAAKSYKGESDLASALNTVLSEMDDHISAQAPMIPNPVNPAEDFADKWYDEKSAQYRLQENFYKWLYQARADFSALCSSDDTQRIVNAAQNGLDLKLDSSSVARLLGIPAVTAKPTFAIQSSDPKPWFKQ

SEQ ID NO: 913 - protein, 396 aa, Shewanella sp.
MSNTKSNDVLNTILEKIELPDSAYEKAEKRYKDLGDWLHRPESTCVNFDPHVFSQGSFRLGTAIRPDSEEQYDLDMGCNLRRGLDKTSITQKQLKHLVGHELELYRNARGIKEELAEKKRCWRLEYADGLSFHMDIVPCVPESDTGRGLLKKRMVENSKFDENLAQNVSQLAVSITDNTDSTYAVVDENWRISNPEGYARWFETRMKTARLVINEREMRFKASIDSLPYYQWKTPLQQVIQLLKRHRDTMFKNNEDSKPISVIITTLAAKSYKGESDLASALNTVLSEMDDHISAQAPMIPNPVNPAEDFADKWYDEKSAQYRLQENFYKWLYQARADFSALCSSDDTQRIVNAAQNGLDLKLDSSSVARLLGIPAVTAKPTFAIQSSDPKPWFKQ

SEQ ID NO: 914 - protein, 396 aa, Unknown [sequence omitted]

SEQ ID NO: 915 - protein, 396 aa, Vibrio ordalii
MSNTKSNDVLNTILEKIELPDSAYEKAEKRYKDLGDWLHRPESTCVNFDPHVFSQGSFRLGTAIRPDSEEQYDLDMGCNLRRGLDKTSITQKQLKHLVGHELELYRNARGIKEELAEKKRCWRLEYADGLSFHMDIVPCVPESDTGRGLLKKLMVENSKFDENLAQNVSQLAVSITDNTDFTYAVVNENWRISNPEGYARWFETRMKTARLVINEREMRFKASIDSLPYYQWKTPLQQVIQLLKRHRDTMFKNNEDSKPISVIITTLATKSYKGESDLASALNTVLSEMDDHISAQAPMIPNPVNPAEDFADKWYDEKSAQYRLQENFYKWLYQARADFSALCSSDDTQRIVNAAQNGLDLKLDSSSVARLLGIPAVIVKPTFAIQSSDPKPWFKQ

SEQ ID NO: 916 - protein, 396 aa, Unknown
  Description of Unknown: Alteromonas sequence
MSNTKSNDVLNTILEKIELPDSAYEKAEKRYKDLGDWLHRPESTCVNFDPHVFSQGSFRLGTAIRPDSEEQYDLDMGCNLRRGLDKTSITQKQLKHLVGHELELYRNARGIKEKLAEKKRCWRLEYADGLSFHMDIVPCVPESDTGRGLLKKRMVENSKFDENLAQNVSQLAVSITDNTDSTYAVVNENWRISNPEGYARWFETRMKTARLVINEREMRFKASIDSLPYYQWKTPLQQVIQLLKRHRDTMFKNNEDSKPISVIITTLAAKSYKGESDLASALNTVLSEMDDHISAQAPMIPNPVNPAEDFADKWYDEKSAQYRLQENFYKWLYQARADFSALCSSDDTQRIVNAAQNGLDLKLDSSSVARLLGIPAVTTKPTFAIQSSDPKPWFKQ

SEQ ID NO: 917 - protein, 396 aa, Vibrio thalassae
MSNTKSNDVLNTILEKIELPESAYEKAEKRYKDLGDWLHRPESTCVNFDPHVFSQGSFRLGTAIRPDSEEQYDLDMGCNLRRGLDKTSITQKQLKHLVGHELELYRNARGIKEELAEKKRCWRLEYADGLSFHMDIVPCVPESDTGRGLLKKRMVENSKFDENLAQNVSQLAVSITDNTDSTYAVVNENWRISNPEGYARWFETRMKTARLVINEREMRFKASIDSLPYYQWKTPLQQVIQLLKRHRDTMFKNNEDSKPISVIITTLAAKSYKGESDLASALNTVLSEMDDHISAQAPMIPNPVNPAEDFADKWYDEKSAQYRLQENFYKWLYQARADFSALCSSDDTQRIVNAAQNGLDLKLDSSSVARLLGIPAVTTKPTFAIQSSDPKPWFKQ

SEQ ID NO: 918 - protein, 396 aa, Vibrio gigantis
MSNSKSNDVLNTILEKIELPDSAYEKAEKRYKDLGDWLHRPESTCVNFDPHVFSQGSFRLGTAIRPDSEEQYDLDMGCNLRRGLDKTSITQKQLKHLVGHELELYRNARGIKEELAEKKRCWRLEYADGLSFHMDIVPCVPESDTGRGLLKKRMVENSKFDESLAQNVSQLAVSITDNTDFTYAVVNENWRISNPEGYARWFETRMKTARLVINEREMRFKASIDSLPYYQWKTPLQQVIQLLKRHRDTMFKNNEDSKPISVIITTLAAKSYKGESDLASALNTVLSEMDDHITAQAPMIPNPVNPAEDFADKWYDEKSAQYRLQENFYKWLYQARADFSALCSSDDTQRIVNAAQNGLDLKLDSSSVARLLGIPAVTAKPTFAIQSSDPKPWFKQ

SEQ ID NO: 919 - protein, 396 aa, Shewanella sp.
MSNTKSNDVLNTILEKIELPDSAYEKAEKRYKDLGDWLHRPESTCGIFDPHVFSQGSFRLGTAIRPDLEEQYDLDMGCNLRRGLDKSSITQKQLKYLVGHELELYRNARGIKEDLAEKKRCWRLEYADGLSFHMDIVPCLPESDTGRGLLKRRMVENSKFDESLAQNVSQLAVSITDNTDPTYAVVNENWRISNPEGYARWFETRMKTARLVINEREMRFKASIDSLPYYQWKTPLQQVIQLLKRHRDTMFKNNVDSKPISVIITTLAAKSYKGESDLASALNTVLSEMDNHISAQAPMIPNPVNPAEDFADKWYDEKSAQYRLQENFYKWLYQARADFSALCSSDDTQRIVNAAQNGLDLKLDSNSVARILGIPAVTAKPTFAIQSSDPKPWFKQ

SEQ ID NO: 920 - protein, 396 aa, Vibrio toranzoniae
MSNSKSNDVLNTILEKIELPDSAYEKAEKRYKDLGDWLHRPESTCVNFDPHVFSQGSFRLGTAIRPDSEEQYDLDMGCNLRRGLDKTSITQKQLKHLVGHELELYRNARGIKEELAEKKRCWRLEYADGLSFHMDIVPCVPESDTGIGLLKKRMVENSKFDENLAQHVSQLAVSITDNTDFTYAVVNENWRISNPEGYARWFETRMKTARLVINEREVRFKASIDSLPYYQWKTPLQQVIQLLKRHRDTMFQNNEDSKPISVIITTLAAKSYKGESDLASALNKVLSEMDDHISVQAPMIPNPVNPAEDFADKWYDEKSAQYRLQENFYKWLYQARADFSALCSSDDTQRIVNAAQNGLDLKLDSSSVARLLGISAVTAKPTFAIQSSDPKPWFKQ

SEQ ID NO: 921 - protein, 396 aa, Shewanella xiamenensis
MSNIKSNDVLNTILEKIELPDSAYEKAEKRYKDLGDWLHRPESTCVNFDPHVFSQGSFRLGTAIRPDSEEQYDLDMGCNLRRGLDKTSITQKLLKHLVGHELELYRNARGIKEELAEKKRCWRLEYADGLSFHMDIVPCVPESDKGRGLLKKRMVENSKFDENLAQNVSQLAVSITDNTDSTYAVVNENWRISNPEGYARWFETRMKTARLVINEREMRFKASIDSLPYYQWKTPLQQVIQLLKRHRDTMFKNNVDSKPISVIITTLAAKSYKGESDLASALTTVLSEMDNHISAQAPMIPNPVNPAEDFADKWYDEKSAQYRLQENFYKWLYQARADFSALCSSDDTQRIVNAAQNGFDLKLDSNSVARILGITAVTAKPTFAIQSSDPKPWFKQ

SEQ ID NO: 922 - protein, 396 aa, Psychromonas arctica
MSNTKSNDVLNTILEKIELPDSAYEKAEKRYKDLGDWLHRTESTCGNFDPHVFSQGSFRLGTAIRPDSEEQYDLDMGCNLRRGLDKSSITQKQLKHLVGHELELYRNARGIKEELAEKKRCWRLEYADGLSFHMDIVPCMPESDTGRGLLKKRMIENSKFDESLAQNVSQLAVSITDNTDSTYAVVNGNWRISNPEGYARWFETRMKTARLVINEREMRFKASIGSLPYYQWKTPLQQVIQLLKRHRDTMFKNNEDSKPISVIITTLAAKSYKGESDLASALNTVLSEMDDHISAQAPLIPNPVNPAEDFADKWYDENSAQYRLQENFYKWLYQARADFRTLCSNDDAQRIVEAAQNGLDLKLDSNTVALALGISSVTSKPTHTIHSSDPKPWFKQ

SEQ ID NO: 923 - protein, 396 aa, Tolumonas lignilytica
MSNTNSNDVLNTILEKIELPDSAYEKAEKRYKDLGDWLHRPESTCGNFDPHVFSQGSFRLGTAIRPDSEEQYDLDMGCNLRRGLDKSSITQKQLKHLVGHELALYRNARGIKEELAEKKRCWRLEYADGLSFHMDIVPCLPESDTGRGLLKRRMVENSKFDEILAQNVSQLAVSITDNTDPTYAAVNENWRISNPEGYARWFETRMKTARLIINEREMRFKASIDSLPYYQWKTPLQQVIQLLKRHRDTMFKNNEDSKPISVIITTLAAKSYKGESDLASALNRVLSEMDDHISAQVPLIPNPVNPAEDFADKWYDEKSAQYRLQENFYKWLYQARADFSALCSNDDTQRIVNAAQNGLGLKLDSNSVARILGIPAVTAKPTFAIQSSDPKPWLKK

SEQ ID NO: 924 - protein, 395 aa, Proteus mirabilis
MINTKNNYILNNILEKIELPDSAYEKAEKRYQDLGDWLHRPESICVNLDPHVFSQGSFRLGTAIKPDSEEQYDLDMGCNLRRGLDKISNTQLQLKHLVGYELKLYRKARGIKEELTEKKRCWRLEYADGLSFHLDIVPCIPESDDRRSILKKRMVENSQFDDSLAQQVSQLAVSITDNTDSSYTVVNDNWRISNPEGYARWFETRMKTAHLIINEREMRFKASIDTLPFYQWKTPLQQVIQLLKRHRDTMFKDNEDSKPISVIITTLAAKSYKGESDLISALNTVLAEMDSHINAQIPLVPNPVNPVEDFADKWYDQKSLQYRLKENFYKWLYQARADFKALCSQDDAQRIVDAAQNGLDLKLDSKEVALALGISAVTAKPTFAIQPSDPKPWFK

SEQ ID NO: 925 - protein, 396 aa, Kiloniella spongiae
MLGNRSNEVLKSILGKIELQDEAYEKAEKRYKDIGEWLHRPSSSCVEYDPHVFSQGSFRLGTAIKPDSDEEYDLDMGCNLRQGLSKNQITQEQLKNNVGDELELYRKARGIKEDLAEKKRCWRLEYADGLSFHMDIVPCIPESETDRGILKKRMIENSRFDDALAQNVSEHAVSITDNTDHRYKVTTNNWRISNPEGYARWFETRMKTAKSIINEREISFKASIDSLPYYQWKTPLQQAIQLLKRHRDTMFKDNEDCKPISVIITTLAAKAYNGEADLASALTKILSRMGEYINAAVPVVPNPVNPAEDFADKWYDESSAEYKLEQNFYKWLYQARVDFKTLCAKDNSQHVVEAADRGLNVHLDATSVALALGLSATVITPTKEIHASDPKPWFAQ

SEQ ID NO: 926 - protein, 396 aa, Kiloniella majae
MLGNRSNEVLKSILGKIELQEDAYEKAEKRYKDIGEWLHRPESSCVEYDPHVFSQGSFRLGTAIKPDSDEEYDLDMGCNLRQGLSKNQITQERLKNNVGDELELYRKARGIKEDLAEKKRCWRLEYADGLSFHMDIVPCIPESETDKGVLKRRMIENSRFDDALAQNVSELAVSITDNTDPRYNITTNNWRISNPEGYAHWFETRMKTAQSIINEREMSFKASIDSLPYYQWKTPLQQAIQLLKRHRDTMFKDNDDCKPISVIITTLAAKAYNGESDLASALTNILSRMGEYVNAAVPLVPNPVNPAEDFADKWYDKSSTEYKLQENFYKWLYQAKVDFKTLCVKDNSQLVVEVADRGLDVHLDATSVALVLGLSAAVITPTKEIHASDPKPWFAQ

SEQ ID NO: 927 - protein, 398 aa, Marinobacter sp.
MNRNEENAVLVKILEEVELPEVAYEKADRRYKDLGDWLQRPDSSCTEYDPHVYAQGSFRLGTAIKPSQGEEYDLDMGCKLREGLGKDRISQKGLKNQVGKELELYRTARGIKEELAEKRRCWRLEYADGMSFHMDIVPCIPEQDTQRTLLRKRMIEASNFDENLADSVSELAVSITDNTDPEYAEITSNWRISNPEGFAKWFESRMRTARSVLNEREINIRASIDDLPYYRWKTPLQSVIQLLKRHRDTMFKAGNEESKPISVIITTLAARAYNGESSLESALENILNRMGDFVNQTAPYVPNPVNPDEDFGDKWDSEEHKQLHLREHFHAWLRQARADFKTILAKNNSQNIVEAATKGLEINLDKRQVERSLGLSPAVIFPTTRIEANDSPKPWCES

SEQ ID NO: 928 - protein, 398 aa, Blastopirellula sp.
MQNGNANDILEKILEEIDLPDSAYEKAKDRYQSLGQWLQRPESSCADHDPHVSPSGSFRLGLANRPVDNNDAYDLDMACNLNNGITKASHTQKELKSLVGNELELYRNAKGISKKLDEKRRCWTLEYGDKLNFHMDILPCIPESATRQVHLREAMRFVSKLDVNLAGDVAALAVSITDNTDANYTVLTDEWRISNPEGFAKWFESRMKIAREFIESRQLIVEASIETLPFYRWKTPLQQAIQILKQHRDIMFRKNPESKPISVIITTLASHAYQGELDVASALQRILDDMDSYINEVRPLVPNPVNPAEDFADKWYSAEHAKHNLQANFFAWLRQARAHFKNILEAEDLVRIVESAESGLNVKLNEVEIAGLIGAGIVAATQPQKVHASSAKPWAKWK

SEQ ID NO: 929 - protein, 396 aa, Pseudoalteromonas ruthenica
MAENSNNAILEAMLSAIELPDSAYEKAESRYKDLGEWLHREESKCSKFEPKISPQGSFRLGTANRPFKGEEYDLDMSCNLQEGLTKDVTTQQELKELVGDDLEQYRKARGIQAALGEKRRCWRLDYADNISFHMDIVPCIPEDLVQKSVLEKRMIESSSFNNTLAEEVSELAVSITDNTDPQYALHTNDWRISNPEGYAQWFESRMRLAEAVLNQRMFEAKASIEELPNHQWKTPLQMVIKLLKRHRDTMFENDDDSKPISIIITTLAAKAYSGESDLVSALENILYDMAALVSPSVPRVPNPVNPVEDFADKWYSTEHLHLNLEANFHRWLLQAQADFEALRSHENVKNVLEAAKRGFNVNLDSTFVSKALGLAPATASAPKLVQGSPSRPWCKL

SEQ ID NO: 930 - protein, 397 aa, Colwellia agarivorans
MADNSSNAILENILSAIELPDSAYERAEGRYKDLGEWLHREESTCSRFEPKISPQGSFRLGTANRPLKGEQYDLDMSCNLQEGITKDVATQEHLKNIVGDDLEQYRKARGIQAALDEKRRCWRLDYADDISFHMDIVPCIPEDLDQKSVLEKRMIESSSFNSTLAEEVSELAVSITDNSDPQYSLYTNDWRISNPEGYAQWFESRMRLAEVTLNQRMFEAKASIEELPNYQWKTPLQMVIKLLKRHRDTMFENDDDSKPISIIITTLAAKAYSGESDLVSAMENILNRMGTLISPSIPRVPNPVNPVEDFADKWYSDEHRHLSLENNFNRWLFQAQADFDALRSKENVKNILEAAKRGFNQSLDSTFVSKTLGLAPAVASSKPKAIPQSSSRPWCKL

SEQ ID NO: 931 - protein, 387 aa, Gammaproteobacteria bacterium
MAKLLEKIELPEGAYKTAEKRYQDIGEWLHRENSKCANFEPHVSPQGSFRLGTAIRPENDEEYDLDMSCNLRYGLAKETVTQKQLKDLVGNELEQYRIARNIKEDLSEKKRCWRLEYADDLSFHLDIVPCIPENEPIRSTLKARMINSTLLSEDLASAVSDLAVSITDNTDIGYKILTGEWRISNPEGYARWFESRMRMASEFLTEREMVYKASIDTIPYYQWKTPLQSSVQLLKRHRDTMFEGNEDSKPISVIITTLAARAYRGEGDLMSALSNILNSMEGYIQQNAPIVPNPVNPAEDFAEKWHSEKHSHLKLKDNFFRWLFQAKADFAALCSKENSQVILEAADRGFAVNLDKIGIEQVLGLSAAVIIPATRVEASDPRPWFEV

SEQ ID NO: 932 - protein, 396 aa, Desulfosarcina cetonica
MLDKRSNAILAKLLESIELPEGAYEKAEKRYTDIGEWLHREDSKCVDFDPHVSSQGSFRLGTANKPYRGDEYDLDMGCKLRQGLSKDTITQEQLKILVGDELEQYRKARNIKEDLAEKKRCWTLKYADGLSFHMDIVPCIPESDPTRAVLKERMIKFAQLDESLASDVSKLAVSITDNTDPGYKAITDNWRISNPEGYARWFESRMRTASAYLSEREMVFKASIDTLPYYKWKTPLQSAVQLLKRHRDTMFEGNEDSKPISVIITTLAARAYRGESDLVSALSNILGSMDKYIQPKVPFVPNPVNPAEDFADKWYSEKHARLKLKENFHRWLFQAKADFAALCSKDNSQVIVEAADRGFSVNFDKVSIEQVLGLSAAVITPPRRVEAAGPRPWFKV

SEQ ID NO: 933 - protein, 397 aa, Acinetobacter junii
MNIFNKEILLQKLIDNLDLPDSAYEKAIDRYQDIGEWIGRPESSCSEFEPHIFPQGSFRLGTAIKPLNENEMYDLDLACNFRFGIQPLTHSQEELKTLVGIELEAYRVARNIKSDLEEKHRCWRLEYADHIHFHMDIVPCVPANVARKGMLFESLRQYGTDQNLAGNISEKAVCITDDRHPAYEEKGADWQISNPEGYALWFSSRVKLGLTTRSLFEASRVDEVPLYKEKAPLQRAIQLLKRHRDKMFAKNPESKPISIIISTIAAQSYSGEQTIEEALRKTLMGLKQFADSGLEVVPNPVNPDENFADRWNMPECTDLQLKRNFVLWVSSALRDFNFILNDNQDISVLSETIEDRFSIPINQKEISQFSGKNDQLIASNILTPKRIENVVAKPWRH

SEQ ID NO: 934 - protein, 397 aa, Acinetobacter junii; identical to SEQ ID NO: 933

SEQ ID NO: 935 - protein, 398 aa, Acinetobacter junii
MVNIFNKEILLQKLIDNLDLPDSAYEKAIDRYQDIGEWIGRPESSCSEFEPHIFPQGSFRLGTAIKPLNENEMYDLDLACNFRFGIQPLTHSQEELKTLVGIELEAYRVARNIKSDLEEKHRCWRLEYADHIHFHMDIVPCVPANVARKGMLFESLRQYGTDQNLAGNISEKAVCITDDRHPAYEEKGADWQISNPEGYALWFSSRVKLGLTTRSLFEASRVDEVPLYKEKAPLQRAIQLLKRHRDKMFAKNPESKPISIIISTIAAQSYSGEQTIEEALRKTLMGLKQFADSGLEVVPNPVNPDENFADRWNMPECTDLQLKRNFVLWVSSALRDFNFILNDNQDISVLSETIEDRFSIPINQKEISQFSGKNDQLIASNILTPKRIENVVAKPWRH

SEQ ID NO: 936 - protein, 397 aa, Acinetobacter sp.
MNIFNKEILLQKLIDNLDLPDSAYEKAIDRYQDIGEWIGRPESSCSDFEPHIFPQGSFRLGTAIKPLNENEMYDLDLACNFRFGIQPLTHSQEELKNLVGIELEAYRIARNIKSDLEEKHRCWRLEYADHIHFHMDIVPCVPANVARKGMLFESLRQYGTDQNLAGNISEKAVCITDDRHPAYEEKGADWQISNPEGYALWFSSRVKLGLTTRSLFEASQVDEVPLYKEKAPLQRAIQLLKRHRDKMFAKNPESKPISIIISTIAAQSYSGEQTIEEALRKTLMGLKQFADSGLEVVPNPVNPGENFADRWNMPECADLQLKRNFVLWVSSALRDFNFILNDNQDITVLLETIEDRFSIHINQKEVSQFSGTNDQLIASNIITPKRIDNVVAKPWRH

SEQ ID NO: 937 - protein, 411 aa, Vibrio parahaemolyticus
MNRRNNEKLLNDLIDNLDLPDSAYEKAINRYQDIGEWFGRDGSTCSVNEPHIFPQGSFRLGIAVRPLSGDEEYDLDLACNLRRGITSQTHTQSELKSIIKNELESYRSARNIKSPIEEKHRCWRLDYADGLSFHMDIVPCIPRDEVSRKSLAIAMQNHGIEESLARQVAELAVGITDDRHHAYKSRSSDWMISNPEGYAQWFEERMFSNTLLKAACESAQVDDVPRYNQKTPLQRAIQMLKRHRDQMFAHNPDSKPISVIITTLAAEFYRSSNSIEDTLKDILAGLKQFVESDSDEVLNPVNPSENFADRWKMPAYKQLELKDSFHRWVEKVDQDFKFLLNSNELALISESISNNLSITSDPKKLEVTLDLVSPANSSSLLRASTIATASSVSEVSFSDTPRVPKKPEGFA

SEQ ID NO: 938 - protein, 399 aa, Vibrio cyclitrophicus
MRDNEKLLNELIASLDLPDSAYEKAVKRYEDIGEWLGREESECAENDPHIFPQGSFRLGIAIKPLSGEEEYDLDLACNLRSGVDSSSHSQKELKTLIGFELEQYRQARNIKKELDEKHRCWRLEYADSLNFHMDIVPCIPQSEIQKKSLAKAMTSYGINESFAEQASDLAVGITDDRHSNYNKRVSDWMISNPEGYAKWFENRMNTAQLLKAACESAQVDEVPIYKQKTPLQRVVQILKRHRDQMFVDNQDSKPISVIITTLSARAYTGASSLELALKDVLNGLMEFVQSDSNQVLNPVNPQENFADRWAMPAYKHLELKQNFHLWVYQVNRDFEFILSSNELELISESIGGNLAVAMEKSALSSMLAIPFGAEAAHTTHVVSEPVSKPWSKGRGEICK

SEQ ID NO: 939 - protein, 399 aa, Aliivibrio fischeri
MRDNEKLLNELIASLDLPDSAYEKAVKRYEDIGEWFGREESECAENDPHIFPQGSFRLGIAIKPLSGEEEYDLDLACNLRSGVDSSSHSQKELKALIGFELEQYRQARNIKKELDEKHRCWRLEYADSLNFHMDIVPCIPQSEIQKKSLAKTMTSYGINESFAEQASDLAVGITDDRHSNYNKKVSDWMISNPEGYANWFENRMNTAQLLKAACESAQVDEVPIYKQKTPLQRVVQILKRHRDQMFVDNQDSKPISVIITTLSAKAYTGASSLELALKDVLNGLMEFVLSDSNQVLNPVNPQENFADRWAMPAYKHLELKQNFHLWVYQVKRDFEFILASNELELISESIGGNLAVAMEKSTLSSMLAIPFDAEAAHTTHVVSEPVSKPWSKGRGEICK

SEQ ID NO: 940 - protein, 402 aa, Vibrio vulnificus
MSKRDNEQLLSQLVDDLDLPDSAYETAVRRYESIGEWLGREDSSCADCDPHIFPQGSFRLGIAIKPLSGLEEYDLDLACNLRSGVDSTTHTQKELKELIGTELELYRNARSIKQPVEAKHRCWRLEYADNLKFHMDIVPCVPESEIRKKSLVVAMESYGIVESLAQKVAELAVGITDDRHPNYSQKVSDWLISNPEGYAQWFQNNMHPTELLEVACESAQVDEVPFYKTKTPLQRVVQILKRHRDKMFADNADSKPISVIITTLAASAYSGSSSLESALKEVLLGLKKFVNSDSNEVLNPVNPKENFADRWSMSAYNDLELKKNFHNWVNQVNRDFDFLLESDELEMISESLAKNLSVSLESHKLASLLSIPLTSDAIASQPKIVSEPVSKPWSKGRGDFCK

SEQ ID NO: 941 - protein, 402 aa, Vibrio parahaemolyticus
MSKRDNEQLLSQLVDDLDLPDSAYETAVRRYESIGEWLGREDSSCADCDPHIFPQGSFRLGIAIKPLSGLEEYDLDLACNLRSGVDSTTHTQKELKELIGTELELYRNARSIKQPVEAKHRCWRLEYADNLKFHMDIVPCVPESEIRKKSLVVAMESYGIVESLAQKVAELAVGITDDRHPNYSQKVSDWLISNPEGYAQWFENNMHPTELLKVASESAQVDEVPFYKTKTPLQRVVQILKRHRDKMFADNADSKPISVIITTLAASAYSGSSSLESALKEVLLGLKKFVNSDSNEVLNPVNPKENFADRWSMSAYNDLELKKNFHNWVNQVNRDFDFLLESDELEMISESLAKNLSVSLESHKLASLLSIPLTSDAIASQPKIVSEPVSKPWSKGRGDFCK

SEQ ID NO: 942 - protein, 402 aa, Vibrio campbellii
MSKRDNEQLLSQLVEDLDLPDSAYETAVHRYESIGEWLGREDSSCADCDPHIFPQGSFRLGIAIKPLSGLEEYDLDLACNLRSGVDSTTHTQKELKELIGTELELYRNARSIKQPVEEKHRCWRLEYADNLKFHMDIVPCVPESEIRKKSLIVAMESYGIVEPLAQKVAELAVGITDDRHPNYSQKVSDWLISNPEGYAQWFENNMHPTVLLKVACESAQVDEVPFYKTKTPLQRVVQILKRHRDKMFVDNSDSKPISVIITTLAASAYSGSSSLESALKEVLLGLKKFVNSDSNEVLNPVNPKENFADRWSMPAYNDLELKKNFHNWVNQVNRDFDFLLESDELEMISESLAKNLSVSLESHKLASLLSIPLTSDAIASQPKIVSEPVSKPWSKGRGDFCK

SEQ ID NO: 943 - protein, 402 aa, Vibrio crassostreae
MSKRDNEQLLSQLVEDLDLPNSAYKTAVHRYESIGEWLGREDSTCADCDPHIFPQGSFRLGIAIKPLSGLEEYDLDLACNLRSGVDSTTHTQKELKELIGTELELYRNARGIKQPIEEKHRCWRLEYADNLKFHMDVVPCVPESEIRKKSLVVAMESYGIVESLAQKVAELAVGITDDRHLNYSQKVSDWLISNPEGYAQWFENNMHPTELLKVACESAQVDEVPFYKTKTPLQRVVQILKRHRDKMFVDNSDSKPISVIITTLAASAYSGSSSLESALKEVLLGLKKFVNSDSNEVLNPVNPKENFADRWSMPAYSDLELKKNFHNWVNQVNRDFDFLLESDELEMISESLAKNLSVSLESHKLASLLSIPLTSDAIASPPKIVSEPVSKPWSKGRGDFCK

SEQ ID NO: 944 - protein, 394 aa, Pseudoalteromonas luteoviolacea
MRNNENLLQELADNLDLPDGAYKQAIDRYQSLGKWFGRDESSVKDNDPHIFPQGSFRLGIAIKPLSGEEEYDLDLACSLRSGITPMSHSQNDLKDIVGNELEDYRKAKGISEELESKHRCWRLEYQDNLKFHMDIVPCIPENEVKMKSLAKAMASRGLAESFSKEVADNAVGITDDRLENFDGKPSEWMISNPEGYARWFESRMVENFQIKAACEALQVDDVPVYNTKTPLQRAVQVLKRHRDTMFKENPDSKPISVIITTLSATYYDGSSSLESAFLSVLKGLKEFSDSDSDVVLNPVNPEENFADRWSMPNYKHLELKKNFHLWVDQVVRDFEYLFTSDNLVMISESVLKSLSVSIEQKQLVSILGLSLAATKVTAQPKAVNEPVSKPWHRS

SEQ ID NO: 945 - protein, 397 aa, Desulfobulbaceae bacterium
MITNEQKKIILDNMIKMLELPDSAYDKARWRYEDLGEWFDRQDSIVAGNSPHIFPQGSFRLGTAIRPLDESEEYDLDLACKLRGGLSKTSHTQEYLKKIVGIELDAYRAARGIKNELESKHRCWRLEYQDHLSFHMDIVPCIPADEVSRKVILESLRSSGLDDLVAFSASQTTVSITDDRHAGFKTICNDWNISNPEGYAKWFEHRMNQLQTGILLQRAQVDSVPLFKRKTPLQRVIQLLKRHRDNWSKDNPESKPISIIITTLAARAYNGETDIVAALGSVLDTMGSLIRPTKPKVPNPVDPAEDFADRWYRRNCLHLRLEENFSNWLLQARNDFRHITSTTDINFISEQLEDKFSLRVNKSELKRHLGISLATATIITPKVHTIDRKELAKPWCK

SEQ ID NO: 946 - protein, 397 aa, Thiomicrospira sp.
MITNEQKRAVIDNMVKLLELPDSAYDKARKRYEDLGEWFDRDESAMSGNNPHIFPQGSFRLGTAIRPLDESEEYDLDLACKLRDGISKDSHTQETLKKLIGIELEAYRKARGIKRELEPKHRCWRLEYQDDLSFHMDIVPCIPADENRRKEILESIRKTGLDEFVAGSASQTTISITDDRHEGYKHICDDWNISNPEGYAKWFEYRMNPQQTRILPEKAQVDDVPLFKKKTPLQRVIQILKRHRDNWSKDNPDSKPISIIITTLAARAYNGETDIVAALGNVLEKMGGLVSPSRPRIPNPVDPEEDFADRWYRQDCLHLRLEEHFNAWLLQARTDFQHITSTTDTEFICEQIDEKFSLRVNESELKKQLGISAASVNIITPKTHTIDRQDSARPWKW

SEQ ID NO: 947 - protein, 397 aa, Nitrosomonas nitrosa
MITNEQKRVVIDNMVKLLELPDSAYDKARKRYEDLGEWFDRDESAVSGNNPHIFPQGSFRLGTAIRPLDESEEYDLDLACKLRDGISKDSHTQEILKKLIGIELEAYRKARGIKSELEPKHRCWRLGYQDDLSFHMDIVPCIPADEKRRKAILESIRNTGLDEYVAGAASQTTVSITDDRHEGYKHICDNWNISNPEGYAKWFEYRMNPQQTRILLEKAQVDDVPLFKKKTPLQRVIQILKRHRDNWSKDNPDSKPISIIITTLAARAYNGETDIVTALGNVLEKMGGLVRPTKPRVPNPVDPEEDFADRWYRHDCLHLRLEDNFNAWLLQARTDFQHLTSTTDTEFLCEHIEEKFSLRVNEAELKKQLGISAASVNIVTPKAHTINRQDSARPWEW

SEQ ID NO: 948 - protein, 273 aa, Desulfobacterales bacterium
MITEEQKKVIIDNMIKLLELPDSAYDKARKRYEDLGDWLDREESAVKDNNPHVFPQGSFRLGTAIRPLDETEEYDLDLACKLRDGITKENHTQEYLKKILGQELEAYRTARSIKKELEAKHRCWRLEYQDDLSFHMDIVPCIPADEVGRKSILESMRNSGLAELVAGSASQTTVSITDDRHKDFKNICNDWNISNPEGYTKWFEYTMNPRKTIILLEKAQVDDVPLFKKKTPLQRVIQLLKRHRDNWSKDNPDSKPISIIITTLAARAYNGES

SEQ ID NO: 949 - protein, 399 aa, Bilophila sp.
MLTSQQKNSSSINSVIEKLELPASAYEKARKRYDDLGAWFDRDDSLVKDNNPHIFPQGSFRLGTAIRPLDESEAYDLDLSCKLRDGITKDTHTQEYLKKLVGHELNAYRAHRGIKSELEAKHRCWRLEYQDDLSFHMDIVPCIPSDSVRKTMILEAMRKAGENEVIAGTVSQLTVSITDDRHPDFRSICEGWNISNPEGYAKWFESRMSSSQRVVLLEKAQVDDVPIYERKTPLQRVVQLLKRHRDQMVKDDPEVKPISIVITTLAARAYQGEADIADALSNVLLKMGEYVNQDKPRVPNPVDPAEDFADRWSMPKYSHLQLERNFWNWLRQARVDLSQITSSDDTTMITEQVKSKMSVDLNLSEIGRALGISTPAIITATPKKHEITSPAKPWSNSNK

SEQ ID NO: 950 - protein, 397 aa, Deltaproteobacteria bacterium
MTTKEQKKLLLENMTSLLELPESAYQKAKDRYEDIGKWFDRDESLCKDNNPHIFPQGSFRLGTVIRPLDESEAYDLDLACNLRKGITKKTHTQESLKVLVGREIESYRVARRIKASKEAKHRCWRLEYQDDHNFHMDIVPSIPADDSRQKLIFESLRKSGADDSFAESTSHMTISITDDRHPEYKQLSENWHISNPEGYANWFKSRMNLSLRSIMEQAQVDEIPIYQRKTPLQRSIQLLKRHRDMMFKDDSDVKPISIIITTLATRAYQGESDIELAISSILSRMGNLVNSSRPRVPNPVDPAEDFADRWSRPECNHLNLEQNFWNWLKQAQNDFELLGASDDANFISEQAGQKFSVCMDASELRKCLGLAMASSITIITPKEHTISQPAKPWRQGK

SEQ ID NO: 951 - protein, 393 aa, Geobacter bremensis
MTNEQRNLLLEQMTSLLELPDSAYDKAKDRYEDIGEWLGRDDSACGVYDPHIYPQGSFRLGTAIRPLIEGEAYDLDLGCKLREGLTKSTISQEELKVLVGGEIELYRKARGITAPLEAKHRCWRLEYQDHLNFHMDIVPCISADDTRRGMIFESLRKSWQDGALAELVAHLTVSITDDRHPQYRAICDDWKVSNPEGYAKWFESRMNERLGIFEKAQVDEIPVYRRKTPLQRSVQLLKRHRDHMFKDDCDIKPISIIITTLAAKAYGGEDDLYAALTTILRRMGDLVNTTRPRVPNPVNPEEDFADRWSMPECKDLNLEGNFWAWLRQANADFDTLLKSGDAGFIVEHAKRRFGTGMDAIDLRRKLGLAHGVSLVIPKSHSIEVEPPRPWKQG

SEQ ID NO: 952 - protein, 406 aa, Deltaproteobacteria bacterium
MNNSRNRIIEEIAGAIDIPDSAYEKAQARYKDLGGWFGRKEARCYAFGPHICSQGSFRLGTVIRPVDEDGEYDLDMGCRLNIGIAKSTHTQQRLKELVGADLEDYRIARGINDKQEEKHRCWRLKYADILKFHLDIVPSIPETPANRRLIQEAMIRTGASAGLAVLVANLTGAITDNRMWNYRIIDDGWRLSNSEGFARWFESRIRLEKALMERLALQARAAKLDELPAYKWKSPLQRCVQLLKRHRDIMFADDPEGRPASIIITTLSAMAYMGEAEIADALERILSGTESLINPYSPRVPNPVNPDEDFADRWTDQALGNKNLEANFWSWLRQAKLDFETVGKQRNPELIVEAARAKLGVSLNADDLKTKLGIGSKGDLLKPAAVPAGLKFPDKPLIPKKPAGFA

SEQ ID NO: 953 - protein, 395 aa, Verrucomicrobia bacterium
MKTKDQIIEALVAALEIPPSAYDKAHDRYKDLGDWFCEGSLKANKPRIYAQGSFRLGTVIRPLHDGESYDLDVGCRLEAGISKHTHTQENLKTLVGDELEAYRQARQIKKEIEEKHRCWCLEYSDELRFSEDIVPSIPEEMTKQASLAETMVKHGLARGLAENVSHHSGNITDNRQANYRYIDPDWRISNSEGYAKWFESRMEIATGLVEKVAMMAKQAKVEKLPAWKWKTPLQKAIQLLKRHRDSMFAKNPDSKPISIIITTLAAAAYRGEDNTTSALERILADMDRYILPTIPRVPNPVNPNEDFADKWHEPKYAHLNLEGNFHGWLKQARADFQNTEKLNTEELIQKFTVQKFGLRIPQDEIAKILPLLSSKPADYQNIQIITEKPARPWCM

SEQ ID NO: 954 - protein, 396 aa, Nitrospira japonica
MNDSLRDRLLTDLVRELDIPDNAYEAAESRYHDLGEWLRDESKAKIAQFQPLVSAQGSFRMGTVTKPWKTDHHDLDIGCSLQEGITPETCTQYDLKHLVGSDLYTYRSERRIQDEPEEKHRCWRLNYQDNLHFHADVVPCVPHSERIQAIIKSRMLQTGTSPLLAQDISKLAVAITDDRHPGYRRLDHDWYISNPEGYARWFESRMKQAHALLKSRTLQAKVGRIEDLPVFRWKTPLQAAIQILKRHRDVMYENLPERKPISIIITTLAAHAYRGEFDLSDALIQILDNMCVNPSEPRVPNPVNAQEDFADRWKSSEGRALRLEENFFVWLEQAKRDFYAILSPSDYGMLPEHIRKRFGVSINQDLMRQISGTLSPRISSPALHIKREMVPKPWGR

SEQ ID NO: 955 - protein, 398 aa, Bacillus safensis
MERFKENILKTLLDKLDLPETAYEKAKKRYEDLGEWFNREDSSLKENKVHIFPQGSFLLGTAIRPISNKDEYDLDLACKLRYGVSESTHSQKQLKEIIGTELQKYIKYKGITTDLISKHRCWRIEYKDTISFHLDIVPAIPATDVKKQTLFESMQSKDTDKGIAQDASNTALFITDDRDPSYDQKEGQWNISNPQGYGIWFKTQMRTLELRAKFEAAEVEDLPINIQKTPLQRSIQLLKRHRDIMFKDDESKPISIIITTLAAKAYAGESNVYTALNNILEAMPQLINSSLPRVPNPVNPEEDFADRWGMEAYNHLRLEDNFNMWLKQAQIDFSTLTTSTNLKELNEITNMKFYVSLEENEIHRDLGFNSINKIASLREPKKHIIQDPAKPWNFKLGE

SEQ ID NO: 956 - protein, 254 aa, Staphylococcus sp.
MAIKQAELNLSFLVEELDLPESAYEKAQKRYEDLGEWFNRDNSLLNYNNVHIFPQGSFMLGTAIRPVEKDDEYDLDLVCKLREGISKNSHTQKEIKELIGAELEAYRKARGIQTRLDEKHRCWCLEYKDNISFHLDIVPAIPADELKKTQLYELINNTDIENEVAENASSSAISITDNRDSNYNEISSEWNISNPEGYGLWFAKEMRTNAERTLLEKARVDELPIHERKTPLQRCLSFGFHFLQFDYIFLWIHY

SEQ ID NO: 957 - protein, 394 aa, Staphylococcus saprophyticus
MAIKQAELNLSFLVEELDLPESAYEKAQKRYEDLGEWFNRDNSLLNYNNVHIFPQGSFMLGTAIRPVEKDDEYDLDLVCKLREGISKNSHTQKEIKELIGAELEAYRKARGIQTRLDEKHRCWCLEYKDNISFHLDIVPAIPADELKKTQLYELINNTDIENEVAENASSSAISITDNRDSNYNEISSEWNISNPEGYGLWFAKEMRTNAERTLLEKARVDELPIHERKTPLQRCVQLLKRHRDIMFKENPDSKPISIIISTLAARAYTRELDIASALNNILKKMESMINSTTPRVPNPVNPQEDFTDKWEMSEYKHLRLEDNFKIWLKQAQKDFRIITESRDASELNKTFEKKFEINTDDKTLRESLGLANRETKKDKPKEHDIENPPKPWKL

SEQ ID NO: 958 - protein, 395 aa, Bacillus sp.
MKIEKEAILKSLVEQLDLPDSAYEKAKKRYEDLGEWFNRDDSLLKNNEVHIFPQGSFLLGTALRPVNKEEEYDLDLACKLRSGVNNFTHTQKAIKELVGKELEAYRTARGIKENLASKHRCWRLEYHDSISFHLDIVPAIPADDIQKSMLFEAINKNGTSEFIADKASNSAMLITDDRDPNYNDIVSNWNISNPTGYGIWFTDRMNIFEGRALYEKALISEIPNYERKTPLQRCIQLLKRHRDIMFGDNESKPISIIITTLAAKAYSGETNIYTALNNILEKMPRLIYPRTPRVPNPVNPEEDFADRWEMPEYKHLKLEQNFNIWLQQAKLDFNVTTSITDPILLNENFNKKYSVSVGQEELNKNLGLVGMNIGSSNINKPKMHNIHDPARPWKI

SEQ ID NO: 959 - protein, 385 aa, Pseudomonas sp.
MAVEALELPDSSYEKAINRYKDLGEWFGRPESTIEANDPHVFAQGSFALGTAIRPLLEGESYDLDLACKLRTGVSKATHSQYDLKQLLGKELESYREARRISNPLEQKHRCWRLEYRDDLSFHMDVVPCIPTDTNLKQQLRTILESRGMNEALASTVADDSVNITDDRLPTYRLKDDDWHVSNPEGYVEWFESRQRAEGLLTLAEARAQVDEVPLYRRKTNLQRCIQLLKRHRDLMFKDEPDSKPISIIITTIAARAYSGNPSLAGAMEEVLRGLSEFRTSNSNEVPNPANPNENFADRWQTDEGRRLRLKENFQDWVRQAAIDIPRLGNLANSADLSEQLKDKLNVQYSATTLESQVGLLATAAKFQAPHVHIPQDAPSPWSQN

SEQ ID NO: 960 - protein, 396 aa, Pseudomonas sp.
MTADSYETALRLAVEALELPDSSYEKAINRYKDLGEWFGRPESTIEANDPHVFAQGSFALGTAIRPLLEGESYDLDLACKLRTGVSKATHSQYDLKQLLGKELESYREARRISNPLEQKHRCWRLEYRDDLSFHMDVVPCIPTDTNLKQQLRTILESRGMNEALASTVADDSVNITDDRLPTYRLKDDDWHVSNPEGYVEWFESRQRAEGLLTLAEARAQVDEVPLYRRKTNLQRCIQLLKRHRDLMFKDEPDSKPISIIITTIAARAYSGNPSLAGAMEEVLRGLSEFRTSNSNEVPNPANPNENFADRWQTDEGRRLRLKENFQDWVRQAAIDIPRLGNLANSADLSEQLKDKLNVQYSATTLESQVGLLATAAKFQAPHVHIPQDAPSPWSQN

SEQ ID NO: 961 - protein, 396 aa, Pseudomonas citronellolis
MTADSYEKTLKLAVEALELLDSAYEKAVNRYKDLGEWFGRPESTIEANDPHVFAQGSFALGTAIRPLLDGESYDLDLACKLRTGVAKASHSQHDLKQLVGKELERYREARRISNPLEEKHRCWRLEYRDEMSFHMDVVPCIPTDSNVKQQLTSILESRGLDKALASTVADDSVNITDDRLPNYRIKDGGWHISNPEGYIEWFKSRQRAEGFLNLAEARAQVDEVPLYRRKTHLQRCIQLLKRHRDLMFKEESDSKPISIIITTIAARSYTGSPTLSGAMEQVLKGLSEFRASNSNEVPNPANPNENFADRWQTDEGRRLRLKENFHDWVRQASIDIPRLGELVSSAELSEQLNEKLSVSYSSAALMTQVGLQATAATYLAPHVHIPQDAPSPWSHK

SEQ ID NO: 962 - protein, 390 aa, Dokdonella immobilis
MTTSANQRLEAILQEIDLPERAYQLAQNRYEDIGSWLGRVDSSLAPYQPHVFVQGSFALGTPIRPIVDGEEYDLDFTCRLKSGVTRISHTQQQLKELLRIELAAYREARQIKKELEEKNRCWRLGYQDELRFHMDIVPGIPADELRRRELSEAMAQNGLESAVAEQAARRAIWITDIEDPNYALLSRIWPSSNPGGYLLWFRTRMMSLQKRLLAEAQVDPVPVYRSKNSLQRVVQLLKRHRDVMFMDQPDSKPASIILTTIAGRAYVEGESLAQSMQRVLDELERVRASDTDEILNPVNPKENFADRWFREDCARFLLKQNFHLWVQQANRDFRLMLDDETTRLVEIVEDRLNVKVSDDLRRALGLASTVSVSSPRIIQTASAPPKPWAQ

SEQ ID NO: 963 - protein, 394 aa, Pseudomonas sp.
MDHEERSLTTAVEALELPPGAYERAKRRYESLGEWFSRKESTLADNDPHIFVQGSFALGTAIKPLLEGESYDLDLSCKLREEVFRHTHSQAQLKEMVRLELEGYRDAKQIREDLEEKHRCWRLYYQDDMNFHMDVVPGVPVDEARKQALSIAMESFGFRQVLANDVAELAVYITDDQRPNYEAISDDWLLSNPDGYCKWFESKSDPEPVGPAGAVVTMEAQVDEVPFHSRKTNLQQAVQLLKRHRDVMYKDDPDPKPISVIITTLAASSYLPAATLGEALTCCLGALSHFVESNANVVPNPVNPKENFADRWATLEGKKLRLKENFQLWVRQALRDFEKIRSLDGQSLIDHLKDVLGVNVSLNQVGAPVMASAASTPASTIVVTKAPRPWSGRG

SEQ ID NO: 964 - protein, 391 aa, Unknown
  Description of Unknown: Pseudomonas sequence
MDHEERSLTTAVEALELPPGAYERAKRRYESLGEWFSRKESTLADNDPHIFVQGSFALGTAIKPLLEGESYDLDLSCKLREEVFRHTHSQAQLKEMVRLELEGYRDAKQIREDLEEKHRCWRLYYQDDMNFHMDVVPGVPVDEARKQALSIAMESFGFRQVLANDVAELAVYITDDQRPNYEAISDDWLLSNPDGYCKWFESKSDPEPVGPVVTMEAQVDEVPFHSRKTNLQRAVQLLKRHRDVMYKDDPDPKPISVIITTLAASSYLPAATLGEALTCCLGALSHFVESNANVVPNPVNPKENFADRWATLDGKKLRLKENFQLWVRQAVRDFEKIRSLDGQSLIDHLKDVLGVNVSMNQVGAPVMASAASTPAPAIVVTNAPRPWSGRG

SEQ ID NO: 965 - protein, 391 aa, Pseudomonas donghuensis
MDHEERSLTTAVEALELPPGAYERAKRRYESLGEWFSRKESTLADNDPHIFVQGSFALGTAIKPLLEGESYDLDLSCKLREEVFRHTHSQAQLKEMVRLELEGYRDAKQIREDLEEKHRCWRLYYQDDMNFHMDVVPGVPVDEARKQALSIAMESFGFRQVLANDVAELAVYITDDQRPNYEAISDDWLLSNPDGYCKWFESKSDPEPVGPVVTMEAQVDEVPFHSRKTDLQRAVQLLKRHRDVMYKDDPDPKPISVIITTLAASSYLPAATLGEALTCCLGALSHFVESNANVVPNPVNPKENFADRWATLDGKKLRLKENFQLWVRQAVRDFEKIRSLDGQSLIDHLKDVLGVNVSLNQVGAPVMASAASTPAPAIVVTKAPRPWSGRG

SEQ ID NO: 966 - protein, 391 aa, Pseudomonas putida
MDNEELSLTTAVEALELPPGAYEKAKRRYESLGEWFSRKESTLAANDPHIFVQGSFALGTAIRPLLEGESYDLDLSCKLREEVFRHTHSQAQLKEMVRLELEGYRDAKQIREDLEEKHRCWRLYYQDDMNFHMDVVPGVPVDEARKQALSIAMESFGFRQVLANDVAELAVYITDDQRPDYEAISDDWLLSNPDGYCKWFESKSDPEPVGPVVTMEAQVDEVPFHSRKTNLQRAVQLLKRHRDVMYKDDPDPKPISVIITTLAASSYLPAATLGEALTCCLGALSHFVESNANVVPNPVNPKENFADRWATPEGKKLRLKENFQLWVRQAVRDFEKIGSLYGQSLIDHLKDVLGVNVSLNQVGASVMASAASTSAPAIVVTKAPRPWSGRG

SEQ ID NO: 967 - protein, 389 aa, Pseudomonas sp.
MDIEERSLLVAVEALELPPSAYEKAVQRYKSLGEWFSRPESSVAENDPHIFVQGSFALGTAIRPLLAGESYDLDLSCKLREGVYPQTHSQSDLKELVGIELEGYREAKRIQEALEEKNRCWRLYYQDGVSFHMDVVPGVPVEEGRRQELAITMESYGVKQVLARDVSNLAIYITDRRRPDYEDVNAGWMVSNPDGYCKWFESRSEPVYEKGLVTLEAQVDEVPFYQRKTNLQRAIQLLKRHRDVMYRDNPDWKPISIIITTLAAQAYQPGGSLKDAVALCLAGLSAFVVSNSDIVPNPVNPKENFADRWKMPEGEKDRLKEHFHLWVGQALQDFGKIRDLDGQRLVEHIEDCFETPTSTAALGIAPAPAQVAAPAIVVSQPPRPWGSNG

SEQ ID NO: 968 - protein, 362 aa, Pseudomonas sp.
MSRFESILTNIVAHSALPLDAYETAVDRYQGFGKWLERDDSPLKDNDIHAFPQGSFALGTAVSPVNPADSYDLDFAFKFRKDVSIDTHTQKQIKLMLERELELYRLHTGIAEPLEEKHRCWRLLYPSFHLDIVPCIPAHEKQRSLLVASMESIGTATEEAQSIASLAVLITDNESATFEQIDRNWLVSNPDGYARWFAARSQNLNSVYSAEAFVEAVPYFSQSTNLQRVIQLLKRHRDVMFKLEPDSKPISVIITTIAAQAYQPAQSLEQTLEMAMAGLRSFIGSNVHVLRNPVDPNENFADRWDDPRYADLQLKQNFHNWVIQLGKDIDWACPVTTDAKKRYLHRYLGGCHVPNHSPQLHR

SEQ ID NO: 969 - protein, 397 aa, Gemmatimonadetes bacterium
MTAAALTPSPSSTPLWTTLADELDVAPSLYERATDRHTSLGEWLCRPESSLARYEPSVRPQGSFRFGTVIKPLVEGATYDLDQVVTLRRLGTQDLSQFELKRRLGVELAAYARAHGMQALDEKHRCWRLKYRDEVAFHLDSLPSVPAAEAAVLQLRRLGVDERWALRAVAITDDRHPQYNVVGAEWLTSNPSGFARWFEARAALGRAGATGRSAQASVEEVPPYEWRTPLQRAVQILKRHRDVMFQNAPSLAPISMIITNLAAQAYEGEQDLGQALAGIVERMGQYVRASVPRVPNPTHPAEDYADKWRLQPALEDNFWRWVEQVRTDVRYFSQQALSPDLVQRRFAIRLSEDQQRRLTNRAASAAAAPAIVAAAAPARIDGAPRPWQSTPRDRSTY

SEQ ID NO: 970 - protein, 391 aa, Acidobacteria bacterium
MTMTDTKAAFTALLKFVVEHIDIPLSYYQKAAVRHRSLGDWLCRRESRVAHLSPHVSPQGSFRYGTVIRPLTADAEYDLDNVTTLKLPKDAMTQRQLKDLYGLEIKDYARAHDMCAPAEEKNRCWRLKYADEVSFHLDTLPSVPEDAARIAALMAVGVPRDLAERAIAITDRRHPLYDQKTLALLSSNPRGFARWFEQQARPIAVSRIRQLVESRAYATVDDVPPYEWKTPLQVAIQLLKRHRDVMFVDTPDLAPISMIITNLAAQAYRGEVDLGEALSNILETMPSLVRPSAPRVPNPADPAEDYADRWRQDPRLERSFWAWHAQAKADVARLVRALGSGTLEVEVKRVFRLELTEAESRATGRLVSVVSAAPAPDIHIASAPRPWGHGE

SEQ ID NO: 971 - protein, 393 aa, Spirochaetes bacterium
MPDIGNEEILKAIAAAVELPDSAYEKAKDRYEDLGEWLGLPSSGIAKYSPHTLPQGSFRIGTAIRPLLDKEEYDLDITCRLETGLMMENIAQADLRSMMKKDIEAYRRERGIQAPLCEKHRCFRLEYQDHLSFHMDIVPSIPDSPESRALLEKAFSQRAYSVSLIQNVSSMASRITDDRSLDYKSISSSWLRSNPEGYARWFEERMLSQRLLKLFQERAQVEALPSYKRKAPLQRAIQILKRHRDWMFKDMPNSKPISIIITTLATQAYGGEDDLESTLFAVLAGMERQVSQTKPRVPNPMNPEEDFADKWDDPKYASLRLEENFKKWLLQAKADCSRILGSTSPDELRKSTTNFSVTLRESEVERLTRGRSPKPTPPIVIISKDPPKPWMEL

SEQ ID NO: 972 - protein, 393 aa, Spirochaetae bacterium
MPDIGNEEILKAIVAAVELPDSAYEKAKDRYEDLGEWLGLPSSDMSKYSPHTLPQGSFRIGTAIRPLLDKEEYDLDITCRFETGLMMGNISQADLRSMVKKDIEAYRRERGIQAPLDEKHRCFRLEYQDHLSFHMDIVPSIPDSPESRVLLEKAFSQRAYSASLIQNVSSMASRITDDRCPDYKTISSSWLSSNPEGYARWFEEQMLSQRLLKSFQERAQVDALPSYKRKAPLQRAIQILKRHRDWMFKDMPDSKPISIIITTLATQAYNGEDDLESTLFAVIAGMERHVSQTKPRVPNPVNPEEDFADKWDDPNYAPLRLEENFKKWLLQAKADCNRILGSTNPQDLRKSAGNFSVTLRESEAERLMKGRSPNPTPSIVIIPKDPPKPWMVL

SEQ ID NO: 973 - protein, 392 aa, Halanaerobium congolense
MDKAEKLFLVKTIIEEIELPDYVYDKAKKRYESIGEFLEESELSVNDPHIFSQGSFRLGTVIKPINGDEEYDLDLACKLNKNFSSENRTQKELKELVGNELENYRKSNGIQEELESKHRCWRLEYQDDLSFHMDIVPAIPAQISSQNNIRDIIFEKGNIENLDEIVPNTLFITDDRDKNYDKISSEWNISNPEGYANWFQERSLTRKAETGIKMESKVDDLPFYKKKNPLQRSIQLMKRHRDNMFGDDDSKPISIIITTLAAKTYDGESNLLDALKKIIFNMEDFINREEPRVPNPVNPEEDFADKWSMEKYEHLNLKKNFHVWLEQIKADFNNLFDMRSADELRKFLSKKFAASIKSDILEKRLNFDSGKEKNKYKKLENPGKPWRDNYNE

SEQ ID NO: 974 - protein, 392 aa, Bacillus mycoides
MQKTITKNILLEMIEQLDLPASIDRKVRDRYISLSNWFARENSSLKDINIDIFSQGSFALGTTIKPLKEDEEYDLDMGCKLNIEGYKGSHTQEELKQLIGRELELYRNRVGIEKPLDEKRRCWRLEYKDEVGFHLDIVPCIPLENERKEIYESRLFEAYGYEQTFNQDVAHFAVNITDNENEDYSTITDEWNISNPQGYVRWFQNRMQKNEQGIFEAKASIEPVPKYEQKTILQCCIQLLKRHRDNMFEENKDSKPISIIITTLAARAYDGEQNLKEAIINILNKMPQYIHSQKPRVPNPVKPEEDFTDRWDNPEFNHLNLEANFKIWLHQAYLDFKKLLEIEKSEEIHSILNENFSLNVNSERLEKEFGYKVASVPTVQVINAPATKPWCP

SEQ ID NO: 975 - protein, 392 aa, Bacillus mycoides; identical to SEQ ID NO: 974

SEQ ID NO: 976 - protein, 392 aa, Bacillus cereus
MQKTITKNILLEMIEQLDLPASIDRKVRDRYISLSNWFARENSSLKDINIDIFSQGSFALGTTIKPLKEDEEYDLDMGCKLNIEGYKGSHTQEELKQLIGRELELYRNRVGIEKPLDEKRRCWRLEYKDEVGFHLDIVPCIPLENERKEIYESRLFEAYGYEQTFNQDVAHFAVNITDNENEDYSTITDEWNISNPQGYVRWFQNRMQKNEQGIFEAKASIEPVPKYEQKTILQCCIQLLKRHRDNMFEENKDSKPISIIITTLAARAYDGEQNLKEAIINILNKMPQYIHSQKPRVPNPVKPEEDFTDRWDNPEFNHLNLEANFKIWLHQAYLDFKKLLEIEKSEEIHSILNENFALNVNSERLEKEFGYKVASVPTVQVINAPATKPWCP

SEQ ID NO: 977 - protein, 391 aa, Rubeoparvulum massiliense
MPETIYKKSVLEEMIEQLDLPEYVVEKTIQRYKSLGEWFNRENSSFKDVDIKIFPQGSFALGTTIKPINEQEEYDLDMGCKVIIPNFKSLFTQEQLKEMVGTELESYRVAKGIKQELEEKHRCWRLEYMDEIKFHLDIVPCIPLNIDMQSVYKKQLEDAFNYEELLNKSVVDAAINITDDRLDNYSIISQDWNISNPEGYLKWFESRMTTGNFGLYNRSSITPVPIYSRKTILQRCIQLLKRHRDNMFGEDDSKPISIIITTLAARAYNGELNLEEALINLLKNMPTYINPSTPRVPNPVNPNEDFTDRWDTSEGKKLDLEGNFKNWLLQAKVDFYNLLKTESYETASLILNNKFSLNIDKSFLNKKYISDKQRNVTSLPINPPKPWGDAY

SEQ ID NO: 978 - protein, 393 aa, Virgibacillus dakarensis
MPETIYKKGVLEEMIEQLDLPEYVVEKTIQRYKSLGEWFNRENSTFKDVDINIFPQGSFALGTTIKPISEQEEYDLDMGCKINIPNFKSLFTQKQLKEMVGTELESYRVAKGIKQELEEKHRCWRLEYMDEIKFHLDIVPCIPLNIDKQSVYKKQLEDTFNYEQSLKKSVVDVAINITDDRLDNYSIISQDWNISNPEGYLKWFENRMATGDFGLYNRSSITPVPIYSRKAILQRCIQLLKRHRDNMFGEDDSKPISIIITTLAARAYNGELNLEEALINLLENMPTYINPSTPRVPNPVNPNEDFTDRWDTLEGEKLDLEGNFKNWLLQAKVDFNNLLKTENYETASLILNNKFSLNIDNSILNKTYNLKSDKQRSVTSLPINPPKPWGDAY

SEQ ID NO: 979 - protein, 393 aa, Bacillus hemicellulosilyticus
MPETIYKKGVLEEMIDQLDLPEYVVEKTIQRYKSLGEWFNREDSSFKDVDINIFPQGSFALGTTIKPINEQEEYDLDMGCKINIPNFKSLFTQEQLKEMVGNELESYRVAKGIKQELEEKHRCWRLEYMDEIKFHLDIVPCIPLNIDKQSVYKKQLEDAFNYEEFLNKSVVDAAINITDDRLDNYSIISQDWNISNPEGYMKWFESRMTIGDIGLYNRSSITPVPIYSRKAILQRCIQLLKRHRDNMFEENDSKPISIIITTLAARAYNGELNLEEALINLLKNMPTYINPSTPRVPNPVNPNEDFTDRWDTLEGKRLDLEGNFKNWLLQAKVDINNLLKTESYETASLILNNKFSLKINNSFLNKTYNLKSDKQGNVTSLPINPPKPWGDAY

SEQ ID NO: 980 - protein, 383 aa, Azospirillum sp.
MGKTAIEIIAENIELPDSYYETAKSRYEDLGEFLCTDSNISMFEPKVFPQGSFRLGTAIKPLNGNSAYDLDLTCRLEKGFNSRNSSQKELKDITGKAIDDYIQKRGIKEGKEEKRRCWRINYQGNINFHMDIVPGIPLNDKKFLVESMKASGMDESLSGKLADFAYNITDNKTDNYNHITQNWPISNPEGYAQWFESRMRLGVDFVAINKAHYEELPFFKRKTILQRSVQILKRHRDIMFQKNDDVKPVSIIITTLAARAYQGERELDISIFNILTKMEEMLNNKGYGPRVPNPTKPEEDFADKWKEDPQLEKNFYMWIMQAKADLCNIKDASSLNAVFDKAHNSFGLILNESMFEEDAININKVPIKNNRIEVAKLPKPHMK

SEQ ID NO: 981 - protein, 384 aa, Rhodococcus sp.
MTLVTTHAMPSDLDQLLVGGLRELDITSVERDAVVQRYEELGVVLDERWASTRGANKVFAQGSFMLGTVVRNVNRNDDIDIDLVAVRDITKTSISQEELKDEVGNAVRLYATRAVSDFPEVEESSRCWTLTWPGMHMDVLPAIPNTEAAGDNLLITDKDVHRWLPSNPLGYAEWFRTQARRRLMASHEMEEKRLEVQQVPEWRQRSVLQRAVQALKRHRDIHFSDRPDQRPSSIVLTTLAAHAYRGGTDLHQVLRQIVASMPEHLHEEAGHWSLPNPAQPDENFTEYWATEPQRAARFFEWLDAAATTFSGLETKSGLDQTIPFLKEAFGSRFATGAVQTLAGDLRSARDDGSLRLHTNSGLRVAPDSAATRRVRRHSFAGGPR

SEQ ID NO: 982 - protein, 282 aa, Actinotalea ferrariae
MTQTAAPAPVGDLGHLIGGGLAALDITPSEFDLAVRRYGQLGEVLDEQWSTTLGQNSVFPQGSFRLGTVVRNVARNDDIDIDIVAVRDVARSSISQEELKRDVGRAVRTYARTPGSGHPEVEESSRCWTLTWPEMHMDVLPAIPNRGSRRNDLLITDRGVRQWLPSNPTGYAVWFRTRMATTTLTARAEEAKRLEVEAVPEWHRRTTLQRVVQALKRHRDIHFAHRLHDRPASIVITTLAAHAYAGGSDLYGSLRQVVAEMANHIEWRDDTWTLSNPAQPEP

SEQ ID NO: 983 - protein, 399 aa, Luteimicrobium subarcticum
MSTTASTAFGIFDRERDLDRPALGGLDQLLGEGLAELDITQAEHDLAVQRYEELATFLDERWAATHGSNAVFSQGSFKLGTVVRNVSRNDEIDIDIVAVRDVIRGSISQEELKREVGDAVRTYANSAASNYPDVGESSRCWTLTWPEMHMDVLPAIPNPESHDLLIPDRDVRMWLASNPSGYAAWFAGRSRVAEFAHRAEAKRLDIQAVPQWRRRTVLQRVVQALKRHRDVYFADRLDDRPASIVITTLAALAYAGGTDLYGALRQVTTEMGSYLDVVDGVWVLQNPAQLDENFTDAWATEPQRAALFFEWLRAAEKAFAGFEVKSGLQHAIPMLEAAFGSRFARGASRGLADELGAARHDGALRMHTGGVLGAASQGPVVTESRPVRRHGFAGGPSSH

SEQ ID NO: 984 - protein, 391 aa, Acidaminococcus fermentans
MISEKYLDNILNRISHALDIGDDLFKEAEEEYRHLGKWINQKLEEEDIQYKVDIFPQGSMALGTVVHPLSVKGNYDGFDLDWVLAFQDNYGLSPRKMKCDIVRGWLYDYLDRNGNSIGRIEEKRRCWHIENSEHPGFHTDVVPGYIQTQHLQITDKDEINNTYSYITSNPKGYQDWFFRRCEISKKRLLEAYNREFQADAKIEKLKRHKLKTPLQKAIQILKRYRDVQFRNVDETEHIKPISIILTTLAATFYDNEDSIFATIESFLKQAYPYIMDNKNENGYFIADPSNEKENLADKWNVHSERAVAFFVFLERAQKDFNREKLMQMSNIELASHLKKILGEDVTTRVFNELAEERKNSQNQGLLKVDPKRGMLSAAGSIAVTESHHYGR

SEQ ID NO: 985 - protein, 510 aa, Shewanella sp.
MTQIVSREEALLTAAKKLDISPTKYKQAIDRFNSMKTHLEQGNYPGTFRVPEVYLQGSFKLGTEIRPFKNSKDADYDIDLVCNLGHSKQAVLASTVKNQVGERIKENGTYSRLLDDEGKRCWTLNYAEDDGVGFHMDILPSVVENSLLARPQSIAATNKDQENSYSWTTSNPKGFAAWFYERNGTVFEQAKLTQKQRIFNNQRQLYNSIDDVPNIHVKTPLQRAIQLLKRHRDVRFSQSDIETFKPISMIITVLAANSYNNEATIYDTLRNLISSLNQHSHQLSNSFVFNDYYARNTYTLITRTSDGKWLIPNPANPGENFADRWHEDDNARAKAFFRWVDWLRDDFINIDTFIEEDKLTKSLVDVYKPTNLPALSFNVPHKEQLRYPIVANIYSANIKASYKSNIYWKEFQSGQPLLKGKELKFKLKTNVPAPFDVYWQVVNTGQEAANVGQLRGEISTQSNTSADEIYRTESTSYTGDHWVEGFVIKDRVCVARTGEFVVSVRDRFAV

SEQ ID NO: 986 - protein, 510 aa, Unknown; identical to SEQ ID NO: 985
  Description of Unknown: Shewanella sequence

SEQ ID NO: 987 - protein, 510 aa, Vibrio vulnificus
MTQIVSREEALLTAAKKLDISPTKYRQAIERFNSMRTHLEQGNYPGTFRVPEVYLQGSFKLGTEIRPFKNSKDADYDIDLVCNLGHSKQAVHASTVKNQVGDRIKENGTYSRLLDDEGKRCWTLNYAEDDGVGFHMDILPSVAEDSLLAQHQSISATNKDQQNRYSWTTSNPKGFAEWFYERNGTAFEQAKLTQKQRIFNNQRQLYNSIEDVPNIHVKTPLQRAIQLLKRHRDVRFSQSDIETFKPISMIITVLAANSYNNEATIYDTLRNLISSLNQHSHQLSNSFVFNDYYARNTYTLITRTSDGKWLIPNPANPGENFADRWHEENNARANAFFQWVGWLRDDFINIDNSIDEDKFTKSLVDVYKPTNLPALSFNVPHKEQLRYPIVSHIYSANIKASYKSNIYWKEFQSGQPLLKGKELKFKLKTNVPAPFDVYWQVVNTGQEAANVGQLRGEISPQGYTTLGEIYRTESTSYTGDHWVEGFVIKDSVCVARTGEFVVSVRDRFSV

SEQ ID NO: 988 - protein, 510 aa, Vibrio parahaemolyticus
MTQIVSREEALLTAAKKLDISPTKYRQAIERFNSMRTHLEQGNYPGTFRVPEVYLQGSFKLGTEIRPFKNSKDADYDIDLVCNLGHSKQAVHASTVKNQVGDRIKENGTYSRLLDDEGKRCWTLNYAEDDGVGFHMDILPSVAEDSLLAQHQSISATNKDQQNRYSWTTSNPKGFAEWFYERNGTAFEQAKLTQKQRIFNNQRQLYNSIEDVPNIHVKTPLQRAIQLLKRHRDVRFSQSDIETFKPISMIITVLAANSYNNEATIYDTLRNLISSLNQHSHQLSNSFVFNDYYARNTYTLITRTSDGKWLIPNPANPGENFADRWHEENNARANAFFQWVDWLRDDFINIDNSIEEDKFTKSLVDVYKPTNLSALSFNVPHKEQLRYPIVSHIYSANIKASYKSNIYWKEFQSGQPLLKGKELKFKLKTNVPAPFDVYWQVVNTGQEAANVGQLRGEISPQGYTTSGEIYRTESTSYTGNHWVEGFVIKDSVCVARTGEFVVSVRDRFSV

SEQ ID NO: 989 - protein, 364 aa, Shewanella sp.
MVTQIVSREEALLTAAKKLDISPTKYKQAIDRFNSMKTHLEQGNYPGTFRVPEVYLQGSFKLGTEIRPFKNSKDADYDIDLVCNLGHSKQAVLASTVKNQVGERIKENGTYSRLLDDEGKRCWTLNYAEDDGVGFHMDILPSVVENSLLARPQSIAATNKDQENSYSWTTSNPKGFAAWFYERNGTVFEQAKLTQKQRIFNNQRQLYNSIDDVPNIHVKTPLQRAIQLLKRHRDVRFSQSDIETFKPISMIITVLAANSYNNEATIYDTLRNLISSLNQHSHQLSNSFVFNDYYARNTYTLITRTSDGKWLIPNPANPGENFADRWHEDDNARAKAFFRWVDWLRDDFINIDTFIEEDKLTKSL

SEQ ID NO: 990 - protein, 511 aa, Vibrio campbellii
MTNLVTREEALLEAARKLDIAPHKYRQAIERFNSMKAHLEQGVYPGTMRVPEVYLQGSFKLGTEIRPFKNSKDADYDIDLVCNLAHSKQHVQPSTVKEQVGDRIRQNGTYARLLDDEGKRCWTLNYAEEDGIGFHMDVLPSISESGLLAHSSAIAATNKNEQEQYSWTTSNPKGFAQWFYEKNGVAFEREKLTQKTQIFNNQRQMYGSVNDVPNIHVKTPLQRAIQLLKRHRDVRFSQSEVENFKPISMIISVLAAKCYQNETTIFETLRNLISRLEQQANQLSSQFIYNQLDASSLYSLITRTQDGKWIISNPTNPGENFADRWHEDDHARAKAFFQWIGWLRDDLININHLVESDLFTKSLVNVYRPTNLPALNFQVSHKDTGSWPIVLNPSYSASVKGSYKTNVFWKGFKSGQSLLKGKQLKFKLQTDVPRPFDVYWQVVNTGQEAREARQLRGEISEHVNTSSSEIFRTESTSYIGDHWVEGFIIKNGVCVAKTGEFIVSVRDTYTR

SEQ ID NO: 991 - protein, 530 aa, Unknown
  Description of Unknown: uncultured bacterium sequence
MNNIVTREEALQHAAKKLDISPSKYKQAMERFESMRSYLQEGSYKGTNGPPEIYLQGSFKLGTEIRPYINSKDADYDIDIVCRLEHQKETTTAKTIKHQVGDHLKAHGTYVRMLNDEGKRCWTLNYAEQDGVGFHMDILPSVQECWHTVREYLGHSNAIAATNRCSDSGNYDWSPSNPKDFAVWFYSKNRAAFENVKQSQKQLLFENFRQDGLFNSRDSVPNIHVKTPLQRTIQLLKRHRDIRFSNQKNEKHKPISMVITLLAAQVYRNESAIYETLKNLLDAFSRQADQMQPTFRFNEAMALSEYTLITRKADGTWYIPNPTNYGENFADKWHEDDHARAKAFFQWVTWAKDDFINITEQLNEEHYTRFLATPENKTSVALSKIKVSFFNVAHRQLPESQWPVEIYYQASIAASYNKKGWRLFSDGSTTFQLNSGDPVERYKKICFKAKTNVSQPFQVYWQVVNTGYEATEARCLRGDFYQSSGDCSFVLGTKTRRESTEYRGIHWIECFIVKNGICVARSGEFLVRIV

SEQ ID NO: 992 - protein, 537 aa, Thiomicrospira sp.
MNRIVTREEALRKAAEQLDISPSKYKQAMERFDSMKSYLLDGEYAGASAEPEIYLQGSFKLGTEIRPYKDSKDADYDIDIVCRLEHEKETTTPKTVKHQVGDHLKAHGTYVKMLDDEGKRCWTLNYAEQDGVGFHMDILPSVQESWSTFSDYYWYRSAIAVTDRCGDSGSYDWSPSNPKDFAEWFYDKNKAAFEDVKQTQKQILFENYRQDGLFTTRDAVPDIHVKTPLQRAIQLLKRHRDIRFCNQQNEKCKPISMVITVLAAQIYGNESTIYETLRNLIDTLSRHADQMQPTFRFDEAMAQSAYTLITRTADGKWHIPNPTNHGENFADKWHENENGVPHARAKAFFQWVAWAKEDFLNIAERLDEEHYTRSLVSPANNSKSLTVAHPRGLSFNVAHRQKPESQWSVMLEPEVTVTIRASYNKNGWRLFSDGSSKFAIHSGDPVEPGKRICFKAKTNVSHPFQVFWQVVNTGDEASQASCLRGDFYNSSGDCSFELGTKTRIEPTRYRGFHWVECFIVKNSVCVARSGEFVVRIV

SEQ ID NO: 993 - protein, 530 aa, Desulfobacterales bacterium
MTNFITREDALLRAAQKLDISPSKYQQAMERFESMRSYLQEGEYEGANGQPEIYLQGSFKLGTEIRPYKDSKDADYDIDIVCRLEHEKEVTSAGIVKHQIGDHLKANGTYSKMLDDEGKRCWTLNYAEQDGVGFHMDILPSVQEACNTFGEYYWYHSAIAATNRSGEDHSYDWTTSNPKGFAEWFYDKNKTAFNNIKLVEKQALFDHYQKDGLFENRDSVPDIHVKTPLQRAIQLLKRHRDIRFCGQDNERVKPISMVITVLAAQAYRNETTVYETLKNLVEAFSKHAEQIQPTFRFDEALAKSAYTLITRTADGKWGIPNPTNRGENFADRWHEDNHARARAFFQWVTWIKEDFVNIAERLHEGYYSRFLGYPDNKGTVASSKSSALIFNVPHRQSPESQWPVQIVYQSSISASYNKNGWRLFADGSTKYQLRSGDPVDRKKRICFKAKTNVNPPYQVYWQVVNTGDEATMEQCLRGDFYPSSGNCSFELGTKTRIEPTKYRGFHWVECFIIKNGACVARSGEFVVRIV

SEQ ID NO: 994 - protein, 395 aa, Paenibacillus sp.
MAILKEMNIVTVELRQNYNKILENLAKELDISPSKYQQAVQRYTAVGNWIADGEYDGVQGELHIYTQGSFRLGTVVRPLKEGAESDYDIDLVCELPLKKFSTTPASLKKSIGERIKENAMYQKMLDKEKKRCWTLNYAEQDGIGFHLDILPSVPESVELIADLIGHGISGDIAQKSISITNRERENVYSWSSSNPNGYAEWFETIKRPVFEKMKIVQKQYIFENNKAIFNQIDEVPDQLVKTPLQRAIQILKRHRDVRFAGHEWEADKPISMIITTLSARAYQHEMDLYTTIKNIVEKLSTLEQLLNSGIKFSGDLTMLQLINRDKDGYWIIPNPVNPAENFADRWHENGNRKAKAFFQWITWVKEDLVDILQLSDVGKITKTLEQRFGEKIVSK

SEQ ID NO: 995 - protein, 386 aa, Paenibacillus sp.
MTVELRQNYNKILENLAKELDISPSKYQQAVQRYTAVGNWIADGEYDGVQGELHIYTQGSFRLGTVVRPLKEGAESDYDIDLVCELPLKKFSTTPASLKKSIGERIKENAMYQKMLDKEKKRCWTLNYAEQDGIGFHLDILPSVPESVELIADLIGHGISGDIAQKSISITNRERENVYSWSSSNPNGYAEWFETIKRPVFEKMKIVQKQYIFENNKAIFNQIDEVPDQLVKTPLQRAIQILKRHRDVRFAGHEWEADKPISMIITTLSARAYQHEMDLYTTIKNIVEKLSTLEQLLNSGIKFSGDLTMLQLINRDKDGYWIIPNPVNPAENFADRWHENGNRKAKAFFQWITWVKEDLVDILQLSDVGKITKTLEQRFGEKIVSK

SEQ ID NO: 996 - protein, 405 aa, Paenibacillus sp.
MRICVPVFWVMTTLKEMNIVTVELRQNYNKVLENLAAELDISPSKYQQAVQRYTSVGNWIADGEYDGVQGELHIYTQGSFRLGTVVRPLKEGAESDYDIDLVCELPLKKSSTTPASLKKSIGERIKENAMYQKMLDKEKKRCWTLNYAEQDGIGFHLDILPSVPESVDLIADLIGHGIPGDIAKKSISITNRERENVYSWSSSNPNGYAEWFETIKRPVFEKMKIVQKQYIFENNKAIFNQIDEVPDQLVKTPLQRAIQILKRHRDVRFAGHEWEEDKPISMIITTLSARAYQHEMDLYSTIKNIVEKLSTLEQLLNPGIKFSGDISMLQLINRNKDGYWIIPNPVNPAENFADRWHENGNRKAKAFFQWITWVKEDLVDILQLSDVGKITKTLEQRFGDRIVSK

SEQ ID NO: 997 - protein, 410 aa, Paenibacillus borealis
MTIEIESKVSSLLDGIASRLDISPTKYKQAVERYTAVSSWIAEGDFEGVEDIHFYPQGSFRLGTVVRPIKNGQDADYDIDLVSEFQISKDSMTPEDLKQIVGTRITEHEKYRKMLDEEGRRCWTLLYAEEEGVGFHLDVLPATPEEAALRNHLIDPRIAQKAIAITHKNKNRTYDWYCSNPSGYADWFDDINKPALDIVKSVQKRNLFETNREIYASIDEVPEALLKTPLQRAIQILKRHRDVRFINHPMALDRPISMIITTLAAKLYNGEPTVLLALRNIVNQFDMLSALLSSDYSLNKSLQTQSLITRKDDGTWVIPNPVNPNENFADRWHENNNQKARAFFQWASWVKEDIVEIIGTNDVGKIVKGYETTFGEVSINAARTLGLPTSAAVISPPLVQISAPNKPWGN

SEQ ID NO: 998 - protein, 410 aa, Paenibacillus naphthalenovorans
MTIELESKVSALLEGIASRLDISPTKYKQAVDRYTAVSNWIAEGQFEGVEEIHFYPQGSFRLGTVVRPIRNGQDADYDIDLVSEFQISKKKTSPKALKEAVGKRIAENETYKKMLDEEGRRCWTIHYAEQDGIGFHIDVLPATPEDASLRNNLVDSRIAEKAIAITHKNKDKTYEWYSSNPSGFADWFENINKPVFDLVKATQQRSLFENNRDIYASIDEVPEALIKTPLQRAIQILKRHRDVRFTNHPMAEDKPISMIITTLAAKLYNGEPNVFLTLRNIVNQLDALSDLLKPEFSDNKVLQEQSLITRNADGTWVIPNPVNPDENFADRWHENNNQKARAFFQWTKWIKEDVIEIIGTNDVGKIVKSFESTFGQVSITTARALGLPTSAAVLSAPMVQISNPNKPWGR

SEQ ID NO: 999 - protein, 411 aa, Paenibacillus sp.
MTIELESKVSSLLEGIASRLDISPTKYKQAVDRYTAVSSWIAEGGFEGVEDIHFYPQGSFRLGTVTRPIRNGKDADYDIDLVSEFKITKKSITPQKLKEVVGTRIAEHEKYKKMLDEEGRRCWTLLYAEEDGVGFHLDVLPATPEDAPLRTSLIDSRIAEKAIAITHKNKDCTYKWSSSNPRGYGDWFDDINKTVFESAKSLQQRSLFENNRDIYASIDEVPDALIKTPLQRAIQILKRHRDVRFTNHPWALDKPISMIITTLAARLYNGEPNVFLALRNIVNELDELSAFLKPDYGTNKSLYGKTLIKRNADGTWSIPNPVNPDENFADRWHENDHQKAKAFFQWASWVKEDIVKIISTSDVGKIVKSFESSFGQVSLNAARALGLPTSAAMSSTPMVHIVSPNKPWGES

SEQ ID NO: 1000 - protein, 415 aa, Tepidanaerobacter acetatoxydans
MESINKGLIFEEIGKQLDISPTMYKLAVERYTAVAEYLEENDLKAHFYPQGSFRLGTVTRPIRNGIESDYDIDLVCQILVDKNNTSPSTIKNTVGNLLRKNKRYKKILDEEGRRCWTLIYAEKDGIGFHLDILPSIRESIEIIESLIKEYNLAPRYAESAIAITNKNKIDNLYNWESSNPNGYGLWFDEINKSFYDLVEKSTRKQIYENNRDIFASIDDVPPQLIRTPLQRVIQILKRHRDLRFNGHKLEDDKPISMIITTLVSQIAKNENCLTTDIFVLLKFIALKLAQYAILLSNIEISQQQYAVIKRDIYTGKWYISNPVNPAENFADRWHENDNRKAKAFFQWVNWVYLDLIQNMDKPGFDINSLKNVLGNNVVEKANAKYQSLLLQHHNDCMQSSSLSTVNITSPGKPWG

SEQ ID NO: 1001 - protein, 415 aa, Tepidanaerobacter acetatoxydans; identical to SEQ ID NO: 1000

SEQ ID NO: 1002 - protein, 372 aa, Desulfovibrio frigidus
MDQLGEKYTLLLDEIARELDIPPSKYKQAVDSYSSVGEWLGDGEYGNCYDGPDVYPQGSFRMGTVVRPFKDGAEADYDIDLVFELKKDVNTTTAKEVRQQVGKRLKDHKTYERLLKPESRRCWTLEYAEEKDGVGFHLDVLMAVPKNVGSDAVAITHRNEDNTYEWASSNPKGYAEWFEEKNQVAYAAVEKLQKDFILEGYEGLYANIDEVPDQLVKTPLQRSIQILKRHRDQRFSGQPYESAKPISMIITTLAAMLYGNEATTFEALTNIVQQLDAHASLIDHGFALESMQAERELVIKTDDGKWVIPNPVDPDENFADRWHENGDEKAKYFFQWVKWVRQDLTDILGEHSISEISEAVSPYLGERAVKAA

SEQ ID NO: 1003 - protein, 409 aa, Desulfovibrio frigidus
MDQLGEKYTLLLDEIARELDIPPSKYKQAVDSYSSVGEWLGDGEYGNCYDGPDVYPQGSFRMGTVVRPFKDGAEADYDIDLVFELKKDVNTTTAKEVRQQVGKRLKDHKTYERLLKPESRRCWTLEYAEEKDGVGFHLDVLMAVPKNVGSDAVAITHRNEDNTYEWASSNPKGYAEWFEEKNQVAYAAVEKLQKDFILEGYEGLYANIDEVPDQLVKTPLQRSIQILKRHRDQRFSGQPYESAKPISMIITTLAAMLYGNEATTFEALTNIVQQLDAHASLIDHGFALESMQAERELVIKTDDGKWVIPNPVDPDENFADRWHENGDEKAKYFFQWVKWVRQDLTDILGEHSISEISEAVSPYLGERAVKAASARVASIGAPIIMAGNAVDDDYPNVDINDPAKPWYDG

SEQ ID NO: 1004 - protein, 397 aa, Alteromonas sp.
MAILVYNFSQLLEEVAKELDISPSKYKLAVSRYESVAKWINGGKYESFDGKIKIYPQGSFRLGTVVRPIREQTEKDYDIDLVCEFEEQATATQAKIVKHRVGNRLKEHTTYKAMLDEEGRRCWTLLYSEQDGAGFHLDVLPSSGYSADDFYPISITHKENESYSWASSNPKGYAAWFDARNVNAYRLVALEQKRMISNSCSDIYAKIDDVPDQLIRTPLQRAIQLMKRHRDMRFDGNQKYAPISMIMTTLAAHLYNNETNVYEALTNIVNKLSAHMGLLDNKVIVDERLSTRGLIKRLPDGTWYISNPTNPEENFADRWHENGNARAKAFFQWVDWLKRDFLDVPQRDRDSIRFSLEACIGKSIVNKVWSKCIPSPDAQAPANVNISGPAKPWRVDE

SEQ ID NO: 1005 - protein, 395 aa, Hahella chejuensis
MSKQYSIFLEKAAEALDIPPSKYKQAVSRYEAVGTWLESGEYNGQIEGVCIYPQGSFRLGTVIRPYKDHKDQDYDIDLVCELGAAVTSSDAEETKHLVGNRLKEHERYRQMLDKEGKRCWTLNYAEQDGVGFHMDVLPSVLSPTGVSQTTISITSKIDDGYEWCSSDPKGYAEWFKHRNRVAFERDALRQKRSISLNFQDTYASIEDVPDLLVRTPLQRAIQLLKRHRDVRFSDRANWKCAPISMIITTIAVHLYQNESDVLQALQNIILSLDAHIPLLHGREVSANFSNQKIIHRLPDGTWYIGNPVNPDENFADRWHEDGNARAKAFFQWVEMLKEDFVSAAKSGDAVFKKKMEGLFDNAIANKYLPNSTPKVVPPPVRNVSISAAPKPWRNS

SEQ ID NO: 1006 - protein, 395 aa, Teredinibacter turnerae
MSKQYSIFLEKAAEALDIPPSKYKQAVSRYEAVGAWLESGEYNGQIEGVCIYPQGSFRLGTVIRPYKDHKDQDYDIDLVCELGAAVASSDAEETKHLVGNRLKEHERYRQMLDKEGKRCWTLNYAEQDGVGFHMDVLPSLLAPTGASQTTISITSKLDDGYEWCSSDPKGYAEWFKYRNRVAFERDALRQKRSISLNFQDTYASIEDVPDLLVRTPLQRAIQLLKRHRDVRFSDRDDWKCAPISMIITTIAAHLYQNESDVLQALQNIILSLDAHVPLLHGREVSANFSNQKIIHRLPDGTWHIGNPVNPDENFADRWHEDSNARATAFFQWVEMLKEDFVSAATSGDAVFKKKMEGLFDIAIANKYLPTSTPKMVTPPARNVSISAGPKPWRNG

SEQ ID NO: 1007 - protein, 395 aa, Alcanivorax sp.
MSKQYSIFLEKAAEALDIPPSKYKQAVARYEAVGAWLESGEYNGQIEGVCIYPQGSFRLGTVIRPYKDHKDQDYDIDLVCEFGAVVASSNAEETKHLVGNRLKEHERYRQMLDKEGKRCWTLNYAEQDGVGFHMDVLPSLLAPTGASQTTISITNKLDYRYEWCSSDPKGYAEWFKHRNRVAFERDALRQKRSISLNFQDTYASIEDVPDLLVRTPLQRAIQILKRHRDVRFCDRSDWKCAPISMIITTIAAHLYRNESDVFQALQNIILSLEAHVPLLHGREVSANFSNQKIIRRLPDGTWYIGNPVNPDENFADRWHEDGNARAKAFFQWVEMLKEDFVTAATSGDAVFKKKMEGLFDNAIANKYLPNSTPKVVPPPVRNVSISAGPKPWRNG

SEQ ID NO: 1008 - protein, 399 aa, Candidatus Tenderia electrophaga
MTVDRSKYSRFLQKVAEDIDISPGKYQDAVERYQAVGRWLEDGNYPGCSGELSIYPQGSFRLGTVVRPIRGGVEASYDIDLVSEFPIEKHRTDPGTMKKMVGDRLCEHGTYRRLLDEEGKRCWTLEYAEQDDVGFHLDVLPCISNPSGLLDTSIAITNKKNGTYDWSASNPKGYGLWFDSQNQAAFEFSLSEQKRALQVRAPDIYARVDDVPDLLVRTPLQRSIQLMKRHRDIKFNNARYNGYAPISIIITTLAAQFYQDDSDIYTALSGIVNKLHAHSVLVENGIVDRSKVPYSPIKRTPDGGWYIGNPVNPEENFADRWHEDNHARARAFFSWVAALKEDLLNILDETRPDVLRKRLTAVLGAVATASHLDLIAPVEAAVVSTPKIHISGAAKPWRA

SEQ ID NO: 1009 - protein, 400 aa, Methylocaldum sp.
MTVDIRKYSEFLEQVASEIDIPPGKYQDTVDRYQAVGHWLEEGAYSNCAGELSIYPQGSFRLGTVVRPIRDGIEACYDIDLVCEMPLLKDRTTPQAVKAMVGERLREHGTYKKLLDPEGRRCWTLEYAEQDGVGFHLDVLPAVPDSREFLDTAIAITNKSGTAYTWSASNPCGYGAWFDGKNAAAFARAVVEQKQTIQRRASLIYASIDKVPDQLVRTPLQRAIQLMKRHRDLRFNHHERIDYAPISIIITTLAAHLYGNELDVYSALSGIVSKLQAHAALVEGKAIDRSLATMGLIQRRPDGTWHIGNPINSEENFADRWHEDNHARAQAFFSWVDALQKDLLNILGETNPRLLQDHLSRVLGAAVVTKNFDVLVPPAPFIDTPPRIHITGAAKPWRDV

SEQ ID NO: 1010 - protein, 412 aa, Leptospira kirschneri
MKEKYNRLLENISNNLDISPSKYKQALDRFDSVSRYFQNSQNQPLLFKIRIYMQGSFRLGTVVRPLKNQEESDYDIDLVCEVQSIKNSTTPYDLKMVIKDRLDESETYSKLLDDEGKRCWTLNYAEQDGIGFHMDILPAAFESESKKETIRSLGVSNEIANLAIAITDKRNNEYNWLSSNPDGYAEWFSSVNRKAFEILAPVQRKTLLKENNLIFNSDSDVPNALIKTPLQRAIQILKRHRDQRFAGSEFESDKPISIIITTLSALSYNGELDTYAALKSIVDNLRFYSRLMSRSLNEEHFLDKKLIQKNPNGIWAILNPVNPEENFADRWHEHNDRKAKAFFQWIKWVAEDLIDILNQSNSLQTLTESLNASLGKQVVQKAIDTDSNFILSSIAPKRVYTIENVSKPYKKC

SEQ ID NO: 1011 - protein, 416 aa, Leptospira kirschneri
MLDEMKEKYNRLLENISNNLDISPSKYKQALDRFDSVSRYFQNSQNQPLLFKIRIYMQGSFRLGTVVRPLKNQEESDYDIDLVCEVQSIKNSTTPYDLKMVIKDRLDESETYSKLLDDEGKRCWTLNYAEQDGIGFHMDILPAAFESESKKETIRSLGVSNEIANLAIAITDKRNNEYNWLSSNPDGYAEWFSSVNRKAFEILAPVQRKTLLKENNLIFNSDSDVPNALIKTPLQRAIQILKRHRDQRFAGSEFESDKPISIIITTLSALSYNGELDTYAALKSIVDNLRFYSRLMSRSLNEEHFLDKKLIQKNPNGIWAILNPVNPEENFADRWHEHNDRKAKAFFQWIKWVAEDLIDILNQSNSLQTLTESLNASLGKQVVQKAIDTDSNFILSSIAPKRVYTIENVSKPYKKC

SEQ ID NO: 1012 - protein, 416 aa, Leptospira santarosai
MLDEMKEKYNRLLENISNNLDISPSKYKQALDRFDSVSRWFQNSQNQPLLFKLRIYMQGSFRLGTVVRPLKNQEESDYDIDLVCEVQSIKNSTTAYGLKMAIKDRLDESETYSKLLDDEGKRCWTLNYAEQDGIGFHMDILPATFEAESKKEIIRSLGVPNEIANLAIAITNKKNSEYNWLSSNPDGYAEWFSSVNRKAFEILAPVQRKTLLKENNLIFNSDSDIPNALIKTPLQRAIQILKRHRDQRFAESEFESDKPISIIITTLSALSYNGEMDTYSALKSIIDNLRFYSGLMSRSLNEEHYLDKKLIQKNPNGIWTILNPVNPDENFADRWHENDDRKAKAFFQWITWVAEDLLDILNQSNNMQRLTESLNASLGKQVVQKAINMDSNFILPSIPPKRVYTIENVSKPYKKC

SEQ ID NO: 1013 - protein, 416 aa, Leptospira noguchii
MLDEMKEKYNQLLENISNSLDISPSKYKQALDRFDSVSRWFQNSQNQPLLFKLRIYMQGSFRLGTVVRPLKNQEESDYDIDLVCEVQSIKNSTTPYDLKMAIKDRLDESETYSKLLDDEGKRCWTLNYAEQDGIGFHMDILPATFEAESKKETIRSLGVPNEIANLAIAITDKKNSEYNWLSSNPDGYAEWFSSVNRKAFEILAPVQRKTLLKENDLIFNSDSDIPNALIKTPLQRAIQILKRHRDQRFAKSEFESDKPISIIITTLSALSYNGEMDTYAALKSIIDNLRFYSRLMSRSLNEEHYLDKKLIQKNPNGIWTILNPVNPEENFADRWHENDDRKAKAFFQWITWVGEDLLEILNQSNNMQRLTESLNVSFGKHVVQKAISADSNIILSSIPPKRVYTIENVSKPYKKC

SEQ ID NO: 1014 - protein, 481 aa, Peptoclostridium acidaminophilum
MNDKQLNDLFLRIAEELDISDTLFERAETSYQALGEYINNNCDCSVNLYTQGSFRLGTVIRPLSDEDEYDLDLASEVTNQSIITPKNLKNMIGDILRDSKRYSSKLEEKKRCWRIEYSDEAQFHMDITPAIPDKTATDSILVTNKKDDASYSFIVSNPKGYSDWFEKRKATTEIIRKAALFEAAGVEPVKTKNNKVKLPLQRAIQILKRHRDKMFEFNPENKPISIIITTLAAKAYNGEMGVYDAVKIILETMSTFISAEGGYYYIPNPSNPQENFADKWNSEPVKAEMFFDWLERAKKDIVIVTPTILDDYTVLEESLGETVIGRAVSKTTSITHDSNLPAIEYNSPVIKNALSVPHRQKPPFQLPKYKVLGIKAMVTINGNSYAYKNNGTPIPKNSGIDFSLIVSPKRLKGGYTVKWQVVNTGDEAQFADSLRGGFETEINSTKRHEDTQYRGTHYVQAFLLKRGKCIAMSTEFIVNIQ

SEQ ID NO: 1015 - protein, 481 aa, Peptoclostridium acidaminophilum; identical to SEQ ID NO: 1014

SEQ ID NO: 1016 - protein, 292 aa, Eubacterium acidaminophilum
MFLRIAEELDISDTLFERAETSYQALGEYINNNCDCSVNLYTQGSFRLGTVIRPLSDEDEYDLDLASEVTNQSIITPKNLKNMIGDILRDSKRYSSKLEEKKRCWRIEYSDEAQFHMDITPAIPDKTATDSILVTNKKDDASYSFIVSNPKGYSDWFEKRKATTEIIRKAALFEAAGVEPVKTKNNKVKLPLQRAIQILKRHRDKMFEFNPENKPISIIITTLAAKAYNGEMGVYDAVKIILETMSTFISAEGGYYYIPNPSNPQENFADKWNSEPVKAEMFFDWLERAKKD

SEQ ID NO: 1017 - protein, 371 aa, Candidatus Firestonebacteria bacterium
MLTADRVLKLAHDLDSIVENLDISESRYLEAVKRYEAVGSWLSSEKSPLLKLKFIPRIYSQGSFRLGTVVRPINNKDECDIDLVCLLTAEEQKSITSKELKEIVGESLKQNGIYAKLLDKEGRRCWTLNYENEFHLDILPAILDVELNKVGGLYKTAIKITDKAESVYKWEPSNPDGYATWFSERQKLIFASLKKSMAASLKESIDEVPDYKVRTPLQKSVQVLKRHRDVYFDGKENKPASIIITTICAVLYNGQADVYTALHDILSDFDIEQYKKEEGYYLANPSNIAENFMERWNEDDSLPLAFFEWLEDAKNDFCDTGLIRKSSADVTTILEAKLGTTIKTTRNNLVNSVPLVSINTGNVSKRQPWGL

SEQ ID NO: 1018 - protein, 501 aa, Aequorivita sp.
MVNQTLLQIAQYLDISPTDYKKAQERFSAVKNWLDNGAYKSGYSPDVYLQGSFRLGTVVRPYHKDKEGNYDIDQVCELTKYSESKSPRILKNDIGDRLKEDSDYERMLEREGRRCWTITYASEIGRPGFHIDILPAFKSDTGTLYNIDITHQEENIYSWSSSNPKGYYLWFKSKNVYSPSFIETQRSAIFNANRELYEGKEDVPKQLFRTSLQRAIQIMKRHRDVHFVNKDFKPISIIITTITAQVYNVESNIIEIIDEFVNYALNRNEFLIKNGYLNKDNILDYSNGKWMIPNPVDYARPDDEKENFADRWNMDSQLANAFFEWCQQLKRDIDSFKKSGLSDSLNLKIKSFGTGEKIDRILLRETEKILENRIGIFSSNNRELLELIHLGIEGKTEWEPVKELAERYYQKADEGESKDVAKVNYYQIARHRGKSFSEETRADIVEVLRRNSNSPSFVLCCNLLLGSATQQMIKDCMKDFTSENILEWPILRLYKHPFILD

SEQ ID NO: 1019 - protein, 506 aa, Winogradskyella jejuensis
MSNQILLQVAQYLDISPTDFKIAQERFNAVKNWLNEGTYRSGYLPDVYLQGSFRLGTVVRPYRKDKDGNFDIDQVCELTKYNESKSSEILKNDIGDRLKENSDYERMMDEEGKRCWTIEYATENNRPGFHIDILPALKSDEGTLHNIDITHKENNVYTWSTSNPKGYYLWFKSKNTYSTSFIESQRNAIFNANRELYERKEEVPKQLFRTSLQRAIQIMKRHRDVHFVNKDFKPISIIITTITTQVYNAESNIVEIIDQFVNYALSRNEFLIKNGYLNKDNILDYSNGKWLIPNPVDYARPESERENFADKWNIESKLANAFFEWCQQLKRDINSFKKSGLSDSLDLKTKSFGTGEKVDKVLIKETDKILENGIGISSSNNRELLELIHLGIEGKTEWEPVKELAERYYHKADEGESKDVAKVNYYQIARHRGKSFSEEARADIMDVLSRNNNSASFVLCCNLLLGSATQQMIRACMKEFNYENILEWPILRLYNRPFVLENTVEV

SEQ ID NO: 1020 - protein, 495 aa, Actinobacteria bacterium
MLDNMVASLDISPTDYETARSRYRAVGEWLGNGDYGLGTSVDVYLQGSFRLGTVVRPYADGQDADYDIDQVCEIAGGGGEPRGLKHEVGDRLKEHSDYNRMLDDEGRRCWTLEYAPEDGRPGFHLDVLPSRPADAISTQIRITHKEDGVYSWRSSNPKGYYRWFSERNTVSPAVLDEQMRSIFSANRELYASVDDVPKQLARTSLQRAIQAMKRHRDVCFNGREGAPISIIVTTICAHKYSGRDVLGTIRDFTEYVAGRFGAAQVGQTLPVDGVLDYHDEAWLIKNPADDRENFADKWIEDPELAKNFFAWVYQLRRDLDAFEDSGDPPDLGLAVRGIQTRETPYGERLLESMSIGPVGSSQRFLDLIHQGIEGRIPWSAVREVAVRNVDLEDDAKGKDTAWVNYYQVKIHSGAGLTADDRQGVQSILRRHASEPDFIFCCNVLLGTATADMLRACVKERGEDALRWPITRLASNQIARHSSTMVPARKFAYESR

SEQ ID NO: 1021 - protein, 413 aa, Clostridium saccharoperbutylacetonicum
MSKLNKKAMINEILKQLDITPTMFKLAKERYTSVSKYLEDNGIEAEFYPQGSFRLGTVTRPIKKGKDSDYDIDFVCQIKGIRSEKDGTNEIEKIKNEVGDLLKENETYNKILDDEGRRCWTLIYAEKDGIGFHLDILPSVSESDNKKRELNYKYGIPEKYVSTTIAITNKDDDQYTWCTSNPIGYSEWFNEINEPFYRMIQEQEKRALFENYTDLYDSIEDVPDQLVKTPLQRVIQILKRHRDIRFSGKEDEKYKPISMIITTLVAQVVKHYGISGLDTYNLLKCVVNKLDESINKIQNNNAEFGFIKRNQGTKEWYIPNPINPEENFADKWSEDNNKRAEMFFTWIKYVNKDLIEQLKDDEVELDVLKASFGQEICESAYSKYNLESNMLSENTTGPKLITNPGSPWRKING

SEQ ID NO: 1022 - protein, 411 aa, Acetobacterium woodii
MNEGEKMRNKSIDLETLAAKLDISPTMHNYAIERYYGISEYLNNNGIEAIFYPQGSFRTGTVVRPIVDGKESDYDIDVVCELGNIKTNTTAERTKKSVGDILKNSELYQKKLFPEQDRCWTLEYAEIVEGIGFTMDVVPCVGEDENQIDYVIKMGIDTVLAQQAIAITERVSAGKYQWQASNPKGYGEWFDNINRKFLQVNLYEKKNEIFNENRSLFSVESSIDDVPDYYVRSALQRVIQLLKRHRDLYYGRIKNGSELRPISAIITTLCAKISNETSITDVEGLLFYVVNGLKEYTSLMQGQTPIQRFSGEIRNYIEKRDQKWWIPNPVSPDDNYADTWTDDTARAFFAWVETVTIDLSNTSVENEARYLTGLKTAFGMEFVDKGLSLDSANIPIKKPSLVISPTKPYKK

SEQ ID NO: 1023 - protein, 405 aa, Acetobacterium woodii
MRNKSIDLETLAAKLDISPTMHNYAIERYYGISEYLNNNGIEAIFYPQGSFRTGTVVRPIVDGKESDYDIDVVCELGNIKTNTTAERTKKSVGDILKNSELYQKKLFPEQDRCWTLEYAEIVEGIGFTMDVVPCVGEDENQIDYVIKMGIDTVLAQQAIAITERVSAGKYQWQASNPKGYGEWFDNINRKFLQVNLYEKKNEIFNENRSLFSVESSIDDVPDYYVRSALQRVIQLLKRHRDLYYGRIKNGSELRPISAIITTLCAKISNETSITDVEGLLFYVVNGLKEYTSLMQGQTPIQRFSGEIRNYIEKRDQKWWIPNPVSPDDNYADTWTDDTARAFFAWVETVTIDLSNTSVENEARYLTGLKTAFGMEFVDKGLSLDSANIPIKKPSLVISPTKPYKK

SEQ ID NO: 1024 - protein, 399 aa, Ruthenibacterium lactatiformans
MANKKIDFDTIVKALDITPTMYKNAVDKYTAIAAYLDEQGIKADFYPQGSFRLGTVVRPLKNGKDADYDLDVICQLKEDKASTDAKTVKSKVGNALKASKLYADRLLPEDDRCWTLEYATVDGTVGFSLDVVPCVGQSEDIILSVEALGVPASYAQEAIAITERMITQYDWQASNPKGYALWFDSINRAFLNYDREARRQAIFNENRAVFASVEEIPEILERSALQRVIQILKRHRDLFFYRARKEDKKPISAIVTTLAAQIASHADPSLSTYELLEFVSNDIERYSALLQGKTTGYYSNYEARAYIKKDDQKWTITNPVDPNDNYADSWDDETASLFFRWAAAVKQDFIDISETEQEKYYAGLKNGMGATLVDKALPVQTINKPIKPVSITGTKPWRC

SEQ ID NO: 1025 - protein, 407 aa, Clostridium oryzae
MNKTLRKEDLVKLVKGLDITPTMFKNATEKYENLGHYLQEVGLEVDIFPQGSFSIGTIVRPYRNLQDGSYDLDFICRVNKQKENTNAKTIKYDVYKALCKNETYKKLLCKEEYDKCWTLEYAEIDGIDFNMDIVPAVREDNDTILYLQSKGINITMANKAVAITNRKKGVYKWSTSNPKAYREWFEVINAPFIEYNRQTKLEKMISESRGFYNSIESIPIGMERSALQRVIQLLKRHRDVYFSKNKRERDKPLSAVITTISALIARNASPSLDVYDLLQFIVHEFEVYSNIQRMNESEFNEVYKEKKVIERQNGKWIIMNPVNPKDNLADAWNEEPEKAVCFFQWVKQIKKDFIDSLYEQDDKFISALENGLGSNYVQKNINKNNYNFLKPQLIINTPKHWRSHCDK

SEQ ID NO: 1026 - protein, 404 aa, Clostridium botulinum
MISKEKRVQDFVKLIKNLDISPTMFKNAKEKYKNIYKFLSEKGLDIDIYPQGSFSLGTVVRPYRGDKEMDYDLDCICLVNYEKSKTTPKAVKQIVGDTLLSSQTYKERMQEEWDKCWTIKYAEINKVGFNIDVVPAVNEDNKTIERLQTKSENASKIVLSIAITNKIKDNEYRWCTNNPKGYKEWFDEINKPFKDYNRDSRRQMLFEENRLIYNSIEDIPEEIERSALQRVIQILKRHRDIYFSKIKKEDYKPISAIITTISAKIAELGDSSLDIVELLEYVANEFEIYSKQQNLSESDFKSKYTNKKVIKREAGIWKIENPVNPEDNLADSWNDDPCRVKYFFMWVKEVKKDFIDSFNLDDAKFISVLESSLGSEFVGKNIDVNFYCTEKPTTIYNTPKPWRI

SEQ ID NO: 1027 - protein, 388 aa, Unknown
  Description of Unknown: uncultured Clostridium sp. sequence
MINKKTKEEDLIKIVKGLDITPTMYKNATEKYKSLADTIIAYGLDVEIYPQGSFSLGTVVKPYSQNEDSVYDLDFICKLNGVSKNNTNPKNVKFQVKDAICSNKIYAERLQIEYDKCWTLEYAKVSGCYFNMDIVPAVKEEEIKILNILNSPQYSIAITNKENSQLYSWCTINPKAYVEWFQSINKKFNDYNREIRLKNILNENLAFFNSVEEIPPMLERSSLQRVIQILKRHRDVYFNKVRREDLKPVSVILTTLVAQIAQSAPANYSVYELLEYTVKALTSLLEGLKFNQNFALKDNNKWILLNPVNSLDNLVDSWNENIEKPKWFLRWIKCLRGDFLTDILDDKKYEILLENSFGYTAVNKFVDLNKNEIKEPEMIINMAKPWRL

SEQ ID NO: 1028 - protein, 368 aa, Streptococcus anginosus
MLNRDKFILNSLNDLDLTPTMEKNARDKYAALSKYLDEHGLKSDFHPQGSFLIGTTIRPYRDGKDQDYDLDILAILKRKKEDTDAKSVKNDVGNCIKESGIYSDKLEKEDRNCWTLKYAEVSDGVGFSLDIVPSVDEDILIKNDIIDSGVSYSNAEKTVAITNKEVSEYNWLTSNPIGFGDWFLGISNQHLTNDMKSKQYNNLPYDIRMVFASAEKIPTYYYRSNLQRAVQFIKRHRDIYYDRIKLRNDKPSSILISALVADSVKDKWILSVSEIVNAFIVGVLNRSISIMQDDKILNPVDLRENLIERYTDSKLNNMNKWIAELNNFMNIDDDRKFKQNIHNDINTRVFAESFETPTIITPTKPWKK

SEQ ID NO: 1029 - protein, 368 aa, Fusobacterium necrophorum
MLNRDKLILNSLNDLDLNPTMEKNARDKYAALSKYLDEHGLDSDFYPQGSFLIGTTIRPYRDGKDQDYDLDVLAILKRKKEDTNAKSVKNDVGNCIKESGIYSDKLEKEDRNCWTLKYAEVSDGVGFSLDIVPSVDEDILIKNDIINSGVSYSNAEKTVAITNKEISEYNWLTSNPLGFGDWFLRISNQHLTNDMKSKQYNNLPYDIRMVFASAEKIPTYYYRSNLQRAVQFIKRHRDIYYDRSKLRNDKPSSILISALVADSVKDKWFLSVSEIVNAFIVGFLNGSISIIQEGKILNPVDLRENLVERYTDSQLSNMNKWIMGLTEFMHIDDDRKFKQNLHNDINTRVFAESFETPTIITPTKPWKK

SEQ ID NO: 1030 - protein, 368 aa, Unknown
  Description of Unknown: Streptococcus sequence
MLNRDKEILKSLSDLDLSPTMEKNARDRYAALSKYLDEQGLDSDFYPQGSFLIGTTIRPYRDGKEHDYDLDVLAILKRKKEDTDAKSVKNDVGNCIKESGTYSDKLEKEDRNCWTLKYAEVADGVGFSLDIVPSVDEDSSTKNEIVNSGVSYSNAEKTVAITNKELSVYDWLTSNPLGFGDWFLEISNRHLSTDMKSEQYNNLPYDIRMVFASAEKIPTYYYRSSLQRAVQFIKRHRDIYYDRSKLSGDKPSSILISALVADSIKNEWFLSVSDIVNAFIVGFSNRSISLMQDGKILNPVDLRENLIERYTDNRLSNMSKWVSALNDFMNIEDERKFKQSIHNDINTRVFAETFETPTIITPTKPWKK

SEQ ID NO: 1031 - protein, 368 aa, Veillonellaceae bacterium
MLNRDKEILKSLSDLDLSLTMEKNARDKYAALSKYLDEHGLDSDFYPQGSFLIGTTIRPYRDGKEHDYDLDVLAVLKRKKEDTDAKSVKNDVGNCIKESGIYSDKLEKEDRNCWTLKYAEVADGVGFSLDIVPSVDEDISIKNDIIYSGVSYSNAERTVAITNKESSFYDWLTSNPLGFGDWFLEISNQHLTTEMKSEQYKNFPCNMRMVFESTEKIPTYYYRSNLQRAVQFIKRHRDIYYDRSKLSGDKPSSILISALVADSIKNAPFLSVSDIISAFILGFSNKSISLMQDGRILNPVDLRENLIERYTASRLRNMDKWVSALKELMNIEDERDFQKSIHNDINTRVFSKAFETPTIITPAKPWKK

SEQ ID NO: 1032 - protein, 368 aa, Lactobacillus salivarius
MFNRDREILASLSDLDLSPTMEKNARDKYAALSSYLDEKGLDSDFYPQGSFLIGTTIRPYRNGKDHDYDLDVLAILKRNKIETNARKVKNDVGNCIKESNIYSDKLEKEDRNCWTLKYAEVSKGIGFSLDVIPSVDETISVKRDIVLSGVPYSQVEKTIAITDKKVDTYDWLTSNPLGFGDWFIEISNRHLTDKMKIEQYNNLPGDMRMEFASVEEIPTYYYKSNLQRAVQFIKRHRDIYYDRSKLINEKPASILISALVADSVKDEYFLSVSDIVNIFIVSFINKNISIMKDGKILNPVDLRENLIEQYTENRLNNMTRWILELNKFMNVEDRREFQQNIHNDINTRVFTKAFENPTIITPTKPWRN

SEQ ID NO: 1033 - protein, 368 aa, Lactobacillus salivarius
MFNRDREILASLLDLDLSPTMEKNARDKYAALSSYLDEKGLDSDFYPQGSFLIGTTIRPYRNGKDHDYDLDVLAILKRNKIETNARKVKNDVGNCIKESNIYSDKLEKEDRNCWTLKYAEVSKGIGFSLDVIPSVDETISVKRDIVLSGVPYSQVEKTIAITDKKVDTYDWLTSNPLGFGDWFIEISNRHLTDKMKIEQYNNLPGDMRMEFASVEEIPTYYYKSNLQRAVQFIKRHRDIYYDRSKLINEKPASILISALVADSVKDEYFLSVSDIINIFIVSFINKNISIMKDGKILNPVDLRENLIEQYTENRLNNMTRWILELNKFMNVEDRREFQQNIHNDINTRVFTKAFENPTIITPTKPWRN

SEQ ID NO: 1034 - protein, 368 aa, Lactobacillus salivarius
MFNRDREILASLSDLDLSPTMEKNARDKYAALSSYLDEKGLDSDFYPQGSFLIGTTIRPYRNGKDHDYDLDVLAILKRNKIETNARKVKNDVGNCIKESNIYSDKLEKEDRNCWTLKYAEVSKGIGFSLDVIPSVDETISVKQDIVLSGVPYSQVEKTIAITDKKVDTYDWLTSNPLGFGDWFIEISNRHLTDKMKIEQYNNLPGDMRMEFASVEEIPTYYYKSNLQRAVQFIKRHRDIYYDRSKLINEKPASILISALVADSVKDEYFLSVSDIVNIFIVSFINKNISIMKDGKILNPVDLRENLIEQYTENRLNNMTRWILELNKFMNVEDRREFQQNIHNDINTRVFTKAFENPTIVTPTKPWRN

SEQ ID NO: 1035 - protein, 367 aa, Lactobacillus salivarius
MFNRDREILASLSDLDLSPTMEKNARDKYAALSSYLDEKGLDSDFYPQGSFLIGTTIRPYRNGKDHDYDLDVLAILKRNKIETNARKVKNDVGNCIKESNIYSDKLEKEDRNCWTLKYAEVSKGIGFSLDVIPAVDETISVKRDIVLSGVPYSQVEKTIAITDKKVDTYDWLTSNPLGFGDWFIEISNRHLTDKMKIEQYNNLPGDMRMEFASVEEIPTYYKSNLQRAVQFIKRHRDIYYDRSKLINEKPASILISALVADSVKDEYFLSVSDIVNIFIVSFINKNISIIKDGKILNPVDLRENLIEQYTENRLNNMTRWILELNKFMNVEDRREFQQNIHNDINTRVFTKAFENPTIITPTKPWRN

SEQ ID NO: 1036 - protein, 368 aa, Lactobacillus salivarius
MFNRDREILASLSDLDLSPTMEKNARDKYAALSSYLDEKGLDSDFYPQGSFLIGTTIRPYRNGKDHDYDLDVLAILKRNKIETNARKVKNDVGNCIKESNIYSDKLEKEDRNCWTLKYAEVSKGIGFSLDVIPSVDETISVKRDIVLSGVPYSQVEKTIAITDKKVDTYDWLTSNPLGFGDWFIEISNRHLTDKMKIEQYNNLPGDMRMEFASVEEIPTYYYKSNLQRAVQFIKRHRDIYYDRSKLINEKPASILISALVADSVKDEYFLSVSDIVNVFIVSFINKNISIMKDGKILNPVDLRENLIEQYTENRLNNMTRWILELNKFMNVEDRREFQQNIHNDINTRVFTKAFENPTIITPTKPWRN

SEQ ID NO: 1037 - protein, 368 aa, Streptococcus sp.
MANRDKVIWESLSNLDLSPTMEKNARDKYNALAKYFEEQGLDSTFYPQGSFLIGTTIRPYRDGKNHDYDLDVLVILNRKKEDTDAKSVKNDIGACLKESGIYSDKLEKEDRNCWTLKYAKVTDEIGFSLDIVPSVEEDILIKNQIVNSGVSDLLVAKTVAITDKETYEYKWLTSNSLGFGEWFLEISNKHLTTGMRIQQYNKLPENIRSLFLSSEEIPVYYYRSNLQRAVQFIKRHRDIYYDRSRLEGDKPSSIILSALIADSIKDESFLSVVDIVNTFITKYRNKSISIMQYGEILNPVDLRENLIERYTVNRLKNMDTWIEELSRFMSIDDESQFKRSIHNDINMEVFGEFFQNPTKITPTKPWKK

SEQ ID NO: 1038 - protein, 368 aa, Streptobacillus moniliformis
MINKDKAILHALTDLDLSPTMEKNARDKYDALSKYLDEQGLNSDFYPQGSFLIGTTVKPYRDGKERDYDLDILAILKIKKEETDAKSVKNDIGRYIKESKIYGEKLEKEDKNCWTLKYADVSDGVGFSLDIVPSVDEDILIKNDIINSGVSYSNAIKTVAITNKNLSEYEWITSNPLGFGDWFLEISNQHLTTNMKLEQYDNLPHDIRRVFASTEKIPTYYYRSNLQRAVQFIKRHRDIYYDRSKLRNDKPSSILISALVAECVKDKYYLSVSEIITTFIDGFKDKNISIMVDGKILNPVDLRENLIENYTDSMLLNMDSWIENLNNLMSIQNEKMFKKNIHNDVNSRVFGEEFNSAKIIEPTKPWMK

SEQ ID NO: 1039 - protein, 371 aa, Staphylococcus pasteuri
MQNIDKIILTSLSDLDLTPTMEKNARDKYHAISKYLNEQGLECDFYPQGSFLIGTSIRPYKNGTEHDYDLDIVSVLNREKIKTRADKVKNDVGDFIKRSKLYSEKLEKEDIYCWTVKYAEVSDGIGFSLDIVPAVNECISIKNDVLKSGVEFSKTQKILAITKKSDIYEWETSNPLGFGDWFIEISNKHLTREMIKEQYENLPVEIRMQYRSVEEIPNFYYKSNLQRAVQFIKRHRDIFYDRSNRNSDKPSSILLTALIADSVKNEYLLSISEIIKNFIIEFKSSNISIMKDNRILNPVDLRENFIEFYTESQKILFENWLEELEQFINTTDELRFKQLIHNDINTRMFTDIFKNVEKVSPVKPWENIYDR

SEQ ID NO: 1040 - protein, 370 aa, Helcococcus kunzii
MEKRDKLLIESLNDIDITPTMEKNAREKYKAISEYLNGHDLESDFYPQGSFLLGTVIRPYRDGKDKNYDLDILALLKNEKSNTDPHSTKNDVGDCIKSSELYKSKLSKEDKNCWTLEYAEVSGGVGFNLDIVPCVNEEENIKAEIVNSGVDLNYVFKTVSITEKEGSNYSWLTSNPLGFGDWFKDISERFISTEMKMEQFHNFPIELREIYNKVENIPNYYYRSNLQRAVQVVKRHRDIFYDRSRNVKYKPSSILITALIADSVKDEFNLSIIDIIKVFIHKFKNKQISIMVDNKILNPVDLREDFISNISESEKNIMNSWIADLSNFISIDSEVEFKKSIHNDFNSKMYSDAFYNVNIVNPTKPWRYSE

SEQ ID NO: 1041 - protein, 370 aa, Streptococcus sp.
MEKRDKLLIESLNDIDITPTMEKNAREKYKAISEYLNGHDLESDFYPQGSFLLGTVIRPYRDGKDKNYDLDILALLKKEKSNTNPQSTKNDVGDCIKSSELYKSKLSKEDKNCWTLEYAEVSGGVGFNLDIVPCVNEEENIKTEIVNSGVDLNYVFKTVSITEKEDSNYSWLTSNPLGFGDWFKDISERFISTEMKMEQFHNFPIEIREIYNTVENIPNYYYRSNLQRAVQVVKRHRDIFYDRSRNVKSKPSSILITALIADSVKDEFNLSIIDIIKVFIHKFKNKKISIMVDNKILNPVDLREDFISNISESEKNIMNSWIADLSNFISIDSEIEFKKSIHNDFNSKMYSDAFYNVNIVSPTKPWRYSE

SEQ ID NO: 1042 - protein, 363 aa, Staphylococcus pseudintermedius
MNKSDIIEKVLKNIDISPTMERNAHEKYDNISSYLSNKGLVCNFYPQGSFLLGTVIRPYKDGKDKLYDLDVISIIDKEKSKTTPYKSKYDIGNLLKESEIYSEKLKEEDIHCWTLEYANVGDVGFTLDIVPSVVNNYSIYNHYNEASIEQKSISITERISVGNYGWKNSNPIGFGDWFKQISDRHISELQLAKQKEKLQYELRDFYASVEEIPQYLYRTSLQRAVQFLKRVRDIYFERTKNQSFKPSTFLLTSLVASSVEHKFNLSIEEIIQAFINGFMNKTIPIMRGGDILNPIDNSEILNINWTRKNYEDMVNWLSYMNKYLLNDGIREFEQEIRNELQIPSIHSETKYNNVSEIKPWKGE

SEQ ID NO: 1043 - protein, 363 aa, Staphylococcus pseudintermedius; identical to SEQ ID NO: 1042

SEQ ID NO: 1044 - protein, 363 aa, Staphylococcus pseudintermedius
MNKSDIIEKVLKNIDISPTMERNAHEKYDNISSYLSNKGLVCNFYPQGSFLLGTVIRPYKDGKDKLYDLDVISIIDKEKSKTTPYKSKYDIGNLLKESEIYSEKLKEEDIHCWTLEYANVGDVGFTLDIVPSVVNNYSIYNHYNEASIEQKSISITERISVGNYGWKNSNPIGFGDWFKQISDRHISELQLAKQKEKLQYELRDFYASVEEIPQYLYRTSLQRAVQFLKRVRDIYFERTKNQSFKPSTFLLTSLVASSVEHKFNLSIEEIIQAFINGFMNKTIPIMRGGDILNPIDNSEILNINWTRKNYEDMVNWLSYMNKYLLNDGIRKFEQEIRNELQIPSIHSETKYNNVSEIKPWKGE

SEQ ID NO: 1045 - protein, 362 aa, Macrococcus caseolyticus
MNKNEIIEKLLASIDISPTMEKNAHDRYESISKYLEEQGLNCNFYPQGSFLLGTVVRPYKDGKDKIYDLDVISMIDKEKFDTNPNQTKNDVGELLKESGLYSEKLKEEDTHCWTLEYANVGDVGFTLDIVPSVVNDYSVYDNYNEATIDQKSISITERISDGRYEWKQSNPIGFGDWFSQISNRHMSESQIIQQRSRLLYELRGLYASAEEIPTYLYRSSLQRSVQLLKRIRDVYYERKTNQLYKPSTFLLTSLVASAVEHEDNLSVDEIINVFINGYKKGTISIMHGVNIINPIDSSEVINYGGTRKHHESMIDWLNHIEKYLLNIETRKFEQEIRNELHVPISSDTNENDVSEIKPWKGE

SEQ ID NO: 1046 - protein, 249 aa, Unknown
  Description of Unknown: butyrate-producing bacterium sequence
MSNISERQKDILSIIRGLDISPTLYKNAVEKYQALGHFLNDNGLEAEIYPQGSFAFGTVVRPSAKDSSASYDLDFICQVTGTRDDYTPAGLRDKVESVLKSSKIYADRLKIDDTCFTIEYADVGEIGFSIDVVPATDESEKTKQRLVLKSAAPVLIDTSISIPKCGNERKFQWITNNPKGLRKWFDDINAPFLASSKKAERMRIFAENRALYESVEEIPDELERSALQRVIQILKSHRNNYYASLKRWR

SEQ ID NO: 1047 - protein, 403 aa, Unknown
  Description of Unknown: Ruminococcus sequence
MNISERQKDFLSVVEKMDISPTLFKNAQSKYEALAAFLDEHGIEATIYPQGSFALGTVTRPAKKADSPSYDLDCICQVTGTKSDYTPSGLRNLIEDTLKGNDTYGGKLVKWEECFTIEYADINGVSFSIDLVPAVSDTDSEKAALITKGLSPQIVDTSIAIPRQNSEKSYRWISNNPKGFKKWFDEINAPFLMYAPKYIERGIFESATAEELPNEIRRSALQRVIQILKYQRDAYYSNLSDGDEIKPISALITTMATRIASNYEKKNCSVFELLEYVLNRLEMCIHQTEMTFEQYALRYDNSPVLSYKSGKWSVPNPADPDDNLANKWNDDARIPKSFFKWVTAIKTDLFEVLTQKDDNQFGVVLENSFANYDPNNPIIKKYRKARIATPINASTASKPYHCS

SEQ ID NO: 1048 - protein, 408 aa, Lachnospiraceae bacterium
MISVFERQTDILKLISQLDISPTMYKNAEEKYKSLAAFLEKNGILADIYPQGSFAFGTVVRPSANDPNANYDLDFICQLRITRDDIAPSKLRQDIEDALLSSNVYGGKLIKCGECFTIEYADISGIGFSIDIVPAVDESQHIKNELFKLSNNPLLIDTSIAIPRENGKRNYNWITNNPRGFKKWFDDINKPFLDYNRDERRAMIFENNQTLFNSVDDIPSVLEHSALQRVIQILKYHRDMYYKNLSVENHDELKPISAIINTLAAEIAQNASPASDVFTLLAYVLNTLDIYGMQQTISFEEFRQNHSTCTAITRENGKWLIQNPANPQDNLADKWNSNANIPKMFFKWVTICHKDLIESMKLSDHQFYTEMSNAFGEENVRSNWGSKYTTSSPKPINTSVVSKPYRAL

SEQ ID NO: 1049 - protein, 398 aa, Butyrivibrio proteoclasticus
MIRKSERQKDILRVIESLDITPSMYKNADEKYHALAKYLSEHTNVTLDMYAQGSFAFGTVVRPYKNDKDGAYDLDFICEVDIEKGNITAEQLRDCIEDAISEGELYGGKLEVSDQCFTIHYADEGGASFSIDIVPAAHESEMKKKLLKEKSSRRDLIDTAIAIPMKDSNNYKWRTNNPKGFAKWFREINEPYKAYIRTEFRKSLFESTDIYDKIEDIPEGMERSAVQRVIQLLKRHRDLYYSHLKEDKPISAIINVLVAEVASSLHPSTDIFTLLEAVLNEINESSKFYNDRIKGEILLENRAVARKNREWYIENPANPEDNLADAWNKSEDIAKGFFKWVSVAKKDLIDSMDKPDDEFRALSESALGQDIIKSAWGDKYEDKAPTPISASSKPWRCY

SEQ ID NO: 1050 - protein, 397 aa, Unknown
  Description of Unknown: Ruminococcaceae sequence
MQVIESLDITPTMFDNATDKYQAIAKFLASKGVDADIYPQGSFALGTVVRPVTRTPDAGYDLDLICQLRKDREEQSPGELRSEVERILKDSELYGGKLELFDQCITIHYADVGKVSFSIDVVPAANESDINKQRLVEKSQVPMLIRSSIAIPMYQEKVYTWATNNPKGYREWFEEINRPFLAVVSEKQRRALFESNARVYASIEDIPDSHLRSAVQRVIQILKAHRNVHFSHLKDGDVLKPISAILSTIAAQVAQPMNPWTSVFDLLKAVLEDFHTYGHYRNPNMTEKVFTETYVGKSLIARRNREWILENPANPEDNLVDKWNENPDAAQAFFNWIDVAYKDLTMAFDLKDNEFRAKMDSAFGESTVSKVWGSKYRQSAPRIITSSNAMPKPWRMQ

SEQ ID NO: 1051 - protein, 387 aa, Lactobacillus fermentum
MINPGKQLEDIELTKTQRERAVTLYTHLCEGIQARGLNISFYPQGSFALKTAVRPFAKGKEQAYDVDVICNFDDYSKDELDSGQLMLLLRQTAREVCKERSLEMNYYERCVTVHYADDPSGVSFSIDLIPAVRESKLKLAVLRAKTEESELVETSIAIDSLSKGWITNNPQGYRKWFEEKAAQFDSRFIQESRGAFASVEELPDDDTPSSRLRQSIKLLKRLRDVYYDEIDAKTSSPSVIITTIVTKLAQSISPSVTSLELLDAIIRELNQVFLLHERGEAYATTYQTMPIAKIVMRENGKWVLRNPTNWEDNVLSSWNETGAVASKEFFGWIKSLQFITKDYKKRGQSDLEFEQQFRGLLLINKKSPNMPRFNVNSSNGVKPWKKQ

SEQ ID NO: 1052 - protein, 387 aa, Lactobacillus paracasei
MINPGKQLEDIELTKTQRERAVTLYTHLCEGIQARGLNISFYPQGSFALKTAVRPFAKGKEQAYDVDVICNFDDYSKDELDSGQLMLLLRQTAREVCKERSLEMDYYERCVTVHYADDPSGVSFSIDLIPAVRESKLKLAVLRAKTEESELVETSIAIDSLSKGWITNNPQGYRKWFEEKAAQFDSRFIQESRGAFASVEELPDDDTPSSRLRQSIKLLKRLRDVYYDEIDAKTSSPSVIITTIVTKLAQSISPSVTSLELLDAIIRELNQVFLLHERGEAYATTYQTMPIAKIVMRENGKWVLRNPTNWEDNVLSSWNETGAVASKEFFGWIKSLQVITKDYKKRGQSDLEFEQQFRGLLLINKKSPNMPRFNVNSSNGVKPWKKQ

SEQ ID NO: 1053 - protein, 391 aa, Enterococcus sp.
MEKTKEQLKKILEKVDLTKTQRDRAIDLYTNVCKSIEEKSGLEISFYAQGSFATKTAIRPYKNGRDRAYDVDVICEVNVTKESISPKILKEYFRNALKDSRYSNTFEESDKCFTIEFKEQDGVDFSIDIIPSVPEDYRTVQLLTGITENPHLVKSSVAIPNTLEENNYWITNNPKGYVTWFENEIQQFHSRYLLEKRDNSFSASIEELPEDEFNNNLLNIIKILKRTRDVFYYRRNSDNKPSSIIITTIIGKLAKNLRPTSSELDLLIQVITQLQQLKNYPTNSLSKRMNVTGYAISDIITRDMGQWVLNNPANGKDNILNSWNEDETKAKDFFIWIDNLQDTFATLIEKNNEERSVTEIYNAFAIDSPVSDTEKKQFSVTSNSSKPWRVK

SEQ ID NO: 1054 - protein, 341 aa, Enterococcus sp.
MEKTKEQLKKILEKVDLTKTQRDRAIDLYTNVCKSIEEKSGLEISFYAQGSFATKTAIRPYKNGRDRAYDVDVICEVNVTKESISPKILKEYFRNALKDSRYSNTFEESDKCFTIEFKEQDGVDFSIDIIPSVPEDYRTVQLLTGITENPHLVKSSVAIPNTLEENNYWITNNPKGYVTWFENEIQQFHSRYLLEKRDNSFSASIEELPEDEFNNNLLNIIKILKRTRDVFYYRRNSDNKPSSIIITTIIGKLAKNLRPTSSELDLLIQVITQLQQLKNYPTNSLSKRMNVTGYAISDIITRDMGQWVLNNPANGKDNILNSWNEDETKAKDFFIWIDNLQ

SEQ ID NO: 1055 - protein, 360 aa, Carnobacterium maltaromaticum
MEKIKKQLDKILEKVELTKTQRDRAIELYTNVCKSIEEKSGLKISFYAQGSFATKTAIRPYKNGSDQAYDVDVICEVDIKKESISPEILKEHFRNALEISRYASIFEEYDKCFTIVFKEQDGINFSIDIIPSVHEDDETVQVLMGITENPTLVKSSVAIPDTFGEGNIWLTNNPKGYVEWFENEIQKFHNRYLSEHRGTSYSASIEELPEGEFNNNLLNIIKILKRTRDVFYYRRKSDNKPSSIIITTIIGKLAKNLIPTSNELDLLMQVVTQLQQIKTYPTNSMSERMGVTGYAISDIITRNMGQWILNNPANGKDNLLNSWNDDQSKSEDFFKWVDNLQDTFLTLIEKDNEERSITEL

SEQ ID NO: 1056 - protein, 391 aa, Carnobacterium maltaromaticum
MEKIKKQLDKILEKVELTKTQRDRAIELYTNVCKSIEEKSGLKISFYAQGSFATKTAIRPYKNGSDQAYDVDVICEVDIKKESISPEILKEHFRNALEISRYASIFEEYDKCFTIVFKEQDGINFSIDIIPSVHEDDETVQVLMGITENPTLVKSSVAIPDTFGEGNIWLTNNPKGYVEWFENEIQKFHNRYLSEHRGTSYSASIEELPEGEFNNNLLNIIKILKRTRDVFYYRRKSDNKPSSIIITTIIGKLAKNLIPTSNELDLLMQVVTQLQQIKTYPTNSMSERMGVTGYAISDIITRNMGQWILNNPANGKDNLLNSWNDDQSKSEDFFKWVDNLQDTFLTLIEKDNEERSITELYNVFAINSPITSVEKKQFSVTSDSSKHWRAK

SEQ ID NO: 1057 - protein, 386 aa, Enterococcus hirae
MNNSVEKLKNILEKVDLTKTQVDRATELYTNLCKTIEEKMGLNINFYPQGSFATKTAVRPYRNGKDQAYDVDVICEVDIPKDSILPNNLKDVFKNALNESRYSTSMTEWDKCFTIEFKEKDGVEFSIDIIPSVPENMITKHELSSITEKSFLVETSIAIPNTKTNTWLTNNPKGYIKWFEEEIAKFHKNYIVDRNMDGIFASIEDLPDDDSSNMLLDVIKVLKRTRDVFYYRRSAEGKPASIIITTIVGKLASNLRPTSDVIDLFTQVIEQLQYLKEYPQKTLSQSTEITGYPISNIIKRDNGEWNMANPANGNDNILSSWNEDENRAKEFFKWVDYLYKTFVEKLVHEEEFRNLYDAIAIEKPEHMINKPQFAVNSSPTKPWRNL

SEQ ID NO: 1058 - protein, 336 aa, Carnobacterium inhibens
MNEVLAKIDLTKTQRERAKELYTNICKTIIRTSGLDINFYSQGSFATKTAVRPFKDGKDRSYDVDVICEVQNLDKSITPSKLMDIFEEAIDSAGYHNYTRWEKCFTVEYAKIDDIEFTIDIIPSVAESFETLEKIRQETECIELVETSIAIPNVAPSYNKWISNNPLGYKTWFENQTQAYEKKYEEFRKGIFDSTIEELPEDAATNLMRNVIKILKRLRDVYFSRATAQSKPSSIVITTIVAKLANKLFYAQDEFTLLNLVVSELQQLESFSRGKSIQKSLNEGFIISEIIALSNGQWILKNPANGLDNILSSWNEEKQVAKDFFNWVSDLKNLVE

SEQ ID NO: 1059 - protein, 372 aa, Carnobacterium inhibens
MTKTQRERAKELYTNICKTIIRTSGLDINFYSQGSFATKTAVRPFKDGKDRSYDVDVICEVQNLDKSITPSKLMDIFEEAIDSAGYHNYTRWEKCFTVEYAKIDDIEFTIDIIPSVAESFETLEKIRQETECIELVETSIAIPNVAPSYNKWISNNPLGYKTWFENQTQAYEKKYEEFRKGIFDSTIEELPEDAATNLMRNVIKILKRLRDVYFSRATAQSKPSSIVITTIVAKLANKLFYAQDEFTLLNLVVSELQQLESFSRGKSIQKSLNEGFIISEIIALSNGQWILKNPANGLDNILSSWNEEKQVAKDFFNWVSDLKNLVESQTSSNIEDIQKSEMLYDSLNLDFSSIKEADFEVNSAKASPWRVK

SEQ ID NO: 1060 - protein, 341 aa, Oceanivirga salmonicida
MLEGIELTATMENKARTSYKAVYDYCINQSLLVDFMPQGSFLTGTVIKPYREDENDEYNFYDIDILCLYSENSDLGQDPKEIKQTLGNIIKRNEIYKEKLEEEYDKCWTLRYNEVNNYRFKLDLVPAINNLINIYITNRDGDGSYSWKKSDSLKFGEWFLGISNRSMSLAFMEEQTIKIKKELKFEDSLKEIPKYYYQSYLQKAVKILKRNRDIFYSRKANENIIRPSSMIMCTLAAEAIENETISSIEEALTKTIRYVKTKFKDFDIKNPVCSQENLCEEWTILDKETFKEWILLFEKDFLLTNDLKEFEANVKTGINESFNLNLIQDYNEVKEVKPWMV

SEQ ID NO: 1061 - protein, 416 aa, Methylobacterium extorquens
MNRMTHDFELDPLQDPLDALLVDIAVRVQLPPGLHEKACGRGEAVCKHLERDGSPLKDRVRRFYPQGSMRIDATISTRGTDEEYDLDYVAELDVHHEASPGDVLDLVYLALVDYPTSKPVERQTRCVTVFFADGMHVDVTPSSLLPYASERESHIFHANPDKPAHEERHVPMNAFGFGEWYNARTPIERRFADAVNRRIYEAAGIEIRADAQFDEVPDQVPLIVKSVTTVALQLLKRHRNVIYAGYDGRIPPSVMLSCIAGHVASPGSTLSDMLIRLARAVARMIQAASARREKLSVVNPVYGRDCFTDRWPEGLAQQDAYATHLTRLADGLEAIRQGASLEDAQDWLRTQFGDRVVSRSLQTFNRRLGGGVGQSTRAYTQRGGLYVPSAPRIIGAGAAAAPASARSHTFMGERRW

SEQ ID NO: 1062 - protein, 416 aa, Methylobacterium extorquens; identical to SEQ ID NO: 1061

SEQ ID NO: 1063 - protein, 418 aa, Methylobacterium sp.
MNRMTPNFETDPLAEPLDALLIDIAVRVQLPPGLHEKACGRGESVCKHMERDGSSLKDRVRRFYPQGSMAIDATISTRGTDEEYDLDYVAELDVHHEAPPGAVLDLVHAALRDYPTSKPVERQTRCVTVFFADGMHVDVTPSSLLPHGAERESHIFHSSPDRPSHEGRHVPMNAYGFGGWYNQLTPVERRFADAVNRRIYEAAGIEIRADAQFDEVPGQVPLIVKSVTTVALQLLKRHRNVIYAGFEGRIPPSVMLSCIAGHSASPGTPLSDIVIRLCRTIARMIHAASARREKVSVVNPVYADDRFTDRWPENLGQQDGYAAHLTRLADGLEAIRRGASLEDAQDWLRLQFGDSVVSRSMKAFNLRLGSGIRHSAQAYTPRGALYVPSAPRIIGAGAASASMPAAARAHTFMGDLRR

SEQ ID NO: 1064 - protein, 453 aa, Methylobacterium aquaticum
MNARRSLWLGLLVIALDRPSIPPAARPRSLEAEMNHPFPKFETDPLEDPLDALLVDVAVRVQLPPGLHAKACGRGESVCNHIDRKGSPLEGRVLRFYPQGSMRIDATISTRGTDEEYDLDYVAELDEHHLAPPDAVLDLVHQALRDYPTRRAVVRQTRCVTVFFADGMHVDVTPSALLPHGAERESHIFHANPEKPANEHSHVPMNAYGFGDWYNDRTPVERRFADAVNRRIYEAAGTEIRADAQFDEVPDQVPLIVKSVTTVALQLIKRHRNVVYAGETGRIPPSVMLSCIAGEVSSPGLPLSDMVIRLARAIARKLMAASARREKVSVVNPIFPNDQFTDRWPENRRQQDDYAAKLTELADGLEYIKRHGSSLEDTQDWLRDRFGSHVVASSIRRFNERTGRAVQSGEHAYTSRGRLYVPSRPALIGLGGATAAATAPARAVAHTFRGGRR

SEQ ID NO: 1065 - protein, 420 aa, Methylobacterium aquaticum
MNHPFPKFETDPLEDPLDALLVDVAVRVQLPPGLHAKACGRGESVCNHIDRKGSPLEGRVLRFYPQGSMRIDATISTRGTDEEYDLDYVAELDEHHLAPPDAVLDLVHQALRDYPTRRAVVRQTRCVTVFFADGMHVDVTPSALLPHGAERESHIFHANPEKPANEHSHVPMNAYGFGDWYNDRTPVERRFADAVNRRIYEAAGTEIRADAQFDEVPDQVPLIVKSVTTVALQLIKRHRNVVYAGETGRIPPSVMLSCIAGEVSSPGLPLSDMVIRLARAIARKLMAASARREKVSVVNPIFPNDQFTDRWPENRRQQDDYAAKLTELADGLEYIKRHGSSLEDTQDWLRDRFGSHVVASSIRRFNERTGRAVQSGEHAYTSRGRLYVPSRPALIGLGGATAAATAPARAVAHTFRGGRR

SEQ ID NO: 1066 - protein, 419 aa, Methylobacterium radiotolerans
MNHPFPKFETDPLQDPLDALLVDIAVRVQLPPGLHEKACDRGEAVCKHIDREGSPLENRVRRYYPQGSMRIDATISTRGTDEEYDLDYVAEIDVHHLAQPGAVLDLVYEALRDYPTAKPVERQTRCVTVFFADGMHVDVTPSSLLPHGAERESHIFHAHPEKPPHEQSHVPMNAYGFGDWYNARTPIERRFADAVNRRIYEAAGIEIRADAQFDDVPDQVPLIVKSVTTVALQLIKRHRNVVYAGEKGRIPPSVMLSCIAGEVASPGLPLSDMVIRLARAIARKLKAASSRREKVSVVNPVFPKDCFTDRWPENLRQQDDYANKLTALADRLEYIKRHGSSLEDTQDWMRGCFGSPVVSSSIRGFNDRTGRAVQSGSHAYTPRGRLYVPSRPALVGIGGAAAAAPARAVAHTFRGGRRW

SEQ ID NO: 1067 - protein, 419 aa, Methylobacterium sp.
MNHFRHPPGLDPFASALDAVMADIAISVQLPPGLHAKAGGRYEAIRDFAERPGSPLNGRILRFYPQGSMAIDATTSTRGTDDEYDLDIVAALDLDPHSGPDAVLDLLYRSLEGYPTGQKVERQTRCVTVRYADRMHVDVTPAVRLGHGAERVSHIFHAHPDKPVSEHFHVPMNAYGFAEWYRARTPLERRFAAAFNKRLHEAYGMEVRADAEVDEILDQVPIIVKAVATVALQLLKRHRNVAYAGATGRIPPSVMLSCFAGQASHPGLPLADMVIRLARSVASALRAASVRREPIRVVNPVHAEDCFTDRWPENLAQQDAYAAKLTDLADGLAWIKQHGSSLEDIQDWLRERFGGHVVSTSVRRFNDRTGRAVQSGLHAYTPRGGLYVPSRPALVGVGGAAAAAPARASAHTFRGGRRW

SEQ ID NO: 1068 - protein, 419 aa, Methylobacterium sp.
MNHFRHPMDLDPFASALDAVMADIAISVQLPPGLHAKAGGRYEAIRDYAERPGSPLNGRILRFYPQGSMAIDATTSTRGTDDEYDLDIVAALDLDPQSDPDAVLDLLYRSLEGYPTSQKVERQTRCVTVRYADRMHVDVTPAVRLGYGAERVSHIFHAHPDQPASKHFHVPMNAYGFAEWYQARTPLERRFAAAFNKRLHEAYGMEVRADAEVDEILDQVPIIVKAVATVALQLLKRHRNVAYAGVKGRIPPSVMLSCFAGHASQPGLPLTDMVIRLARAVASSLRAASNRRERIKVVNPVHTDDCFTDRWPENLAQQDDYAAKLTDLADGLAWIKQHGSSLEDIQDWLRERFGSHVVSTSVRRFNDRTGRAVQSGLHAYTPRGGLYVPSRPALVGVGAVAAAAPVSASSHTFRGGRRW

SEQ ID NO: 1069 - protein, 422 aa, Rhizobiales bacterium
MNRMRLPGDEDPFHSPIDAALAEVAVNLQLPPGLHSQVGDRYEAVRRYAEREGSPLHGRIVRFYPQGSMAIDATISTRGTDEEYDLDIVAELDLDAWADPDAVLDLLYEALKDYPVSRKVERQTRCVTIRYADGMHLDVTPAVRFASTPDRESQIFHANPDKPSSEHYHVRMNAYGFAEWYRGRTPIELRFAKEFSRRFYDAHGLSLQADAEFDEIPGQTPLVVKNTATVALQLLKRHRNVAYANATGRIPPSIMLSCFAGHSAGGASTLSDMVIRQARMTAEAIRRADDRGERVSVTNPALHTECFTDRWPENLAQQREYAGMLTRLANDLTRLKTAEIDQEDLAEWLRDRFGQRVVERSMRNLNDRRGRAIQAASQSYTPKGGIYVPSTPRLVGVGVGAAAAVSAPALTRPHTFMGGRKR

SEQ ID NO: 1070 - protein, 410 aa, Bradyrhizobium japonicum
MRRDDRPDDPFADPLDAVLAELAINIQLPPGLHAKAVERYEAVRRYIERPGSPLEGRVACFYPQGSMAIDATTSTRGTDDEYDLDIVAEIEGPDLGPEALLDDLEAALESYPVSKVVRQTRCITLYYADGMHLDITPSRRRAPKEKEGEIPHAKKGTRSDPARYVPMNSYAFGKWYCARTPTEERFALALNRQLYEQAGIAFAAADVEDVPPQTPLIIKSVTTVALQLIKRHRNIAYATETGRIPPSVMLSCHAGHAARPGMRLAEMLIRQARWTARAIDDAAKRGQLLVVPNPEFPVERFTDRWPESQLQQTTYSRHLHTLANGLEAARTGDVQLEDLQEWLRGQFGDRVVTRSVKAFNQRLGRQVQSRQHGYTRSGGLFVPAAPAIIGAATSLAPVAARAHTNMGERR

SEQ ID NO: 1071 - protein, 410 aa, Bradyrhizobium japonicum; identical to SEQ ID NO: 1070

SEQ ID NO: 1072 - protein, 410 aa, Bradyrhizobium japonicum
MRRDDRPDDPFADPLDAVLAELAINIQLPPGLHAKAVERYEAVRRYIERPGSPLEGRVACFYPQGSMAIDATTSTRGTDDEYDLDIVAQIEGPDLGPEALLDDLEAALESYPVSKVVRQTRCITLYYADGMHLDITPSRRRAPKEKEGEIPHAKKGTRSDPARYVPMNSYAFGKWYCARTPTEERFALALNRQLYEQAGIAFAAADVEDVPPQTPLIIKSVTTVALQLIKRHRNIAYATETGRIPPSVMLSCHAGHAARPGMRLAEMLIRQARWTARAIDDAAKRGQLLVVPNPEFPVERFTDRWPESQLQQTTYSRHLHTLANGLEAARTGDVQLEDLQEWLRGQFGDRVVTRSVKAFNQRLGRQVQSRQHGYTRSGGLFVPAAPAIIGAATSLAPVAARAHTNMGERR

SEQ ID NO: 1073 - protein, 416 aa, Bradyrhizobium japonicum
MSNFPSLRRDDRPDDPFADPLDAVLAELAINIQLPPGLHAKAVERYEAVRRYIERPGSPLEGRVACFYPQGSMAIDATTSTRGTDDEYDLDIVAQIEGPDLGPEALLDDLEAALESYPVSKVVRQTRCITLYYADGMHLDITPSRRRAPKEKEGEIPHAKKGTRSDPARYVPMNSYAFGKWYCARTPTEERFALALNRQLYEQAGIAFAAADVEDVPPQTPLIIKSVTTVALQLIKRHRNIAYATETGRIPPSVMLSCHAGHAARPGMRLAEMLIRQARWTARAIDDAAKRGQLLVVPNPEFPVERFTDRWPESQLQQTTYSRHLHTLANGLEAARTGDVQLEDLQEWLRGQFGDRVVTRSVKAFNQRLGRQVQSRQHGYTRSGGLFVPAAPAIIGAATSLAPVAARAHTNMGERR

SEQ ID NO: 1074 - protein, 416 aa, Bradyrhizobium sp.
MSESLPWRHGYQPRDPFADQLDAVLAEIAINIQLPPGLHAKAVDRYEAVRRYIERSGSPLEGRVACFYAQGSMAIDATTSTRGTDDEYDLDIVAEIGGSDLGPEALLDDLEAALEGYPVSRIVRQTRCLTLYYADGMHLDVTPSRRRAPKEKEGEIPHAKRGARDDPPRYVPMNSYAFAKWYCARTPTEEGFALALNKRLYEQAGIAFAAADVEQVPPQTPLIIKSVTTVALQLIKRHRNSAYASETGRIPPSVMLSCHAGHAAHPGLGLAEMLIRQARWTARAIDAAAKQGRLLSVPNPEFPAERFTDRWPESQMQQTAYSGRLHLLANGLEAARNGNVQLEDLQEWLREQFGERVVTRSIKAFNQRIGSQVQARQHGYTRSGGLFTPAAPAIISTATSLAPVTARAHTNMGERR

SEQ ID NO: 1075 - protein, 417 aa, Alphaproteobacteria bacterium
MSDFPHSRRADIRPNDPFADPLDAVLAEIAVNIQLPPGLHAKAVDRYEAVRRYIERPGSPLEGRVVCFYPQGSMAIDATTSTRGTDDEYDLDIVAEIEGPDDGPEALLDDLEEALKGYPVSRIVRQTRCVTLYYADGMHLDVTPSRRRAPKEKEGEIPHAKKGARTEPPRYVPMNAYAFAQWYLIRTPVEERFALALNRRLYEEAGIAFAAAEVEEVPPQTPLIIKSVTTVALQLVKRHRNIVYATETGRIPPSVMLSCHAGHAARPGLGLADMVIRQSRWTARAIDEAARRGRRLSVLNPEFAAEQFTDRWPETQLQQTTYSRHLHTLANGLEAARNGNVQLEDLQAWLRDQFGDRVVTRSVTAFNRRIGQQVQARQHGYTRSGGLVVPAAPAIIGTGAGLAPISARGHTNMGERW

SEQ ID NO: 1076 - protein, 412 aa, Phenylobacterium sp.
MAWPPPSKDPFADPLDAVLAEIAVNLQLPPGLHAKALDRYEAVRTYIERPGSPLNGRVACFYPQGSMRIDATISTRGTDDEYDIDIVAEITGRDDGPEALLDDLEAALAGYPVSKIERKTRCITLYYADGMHLDVTPARRTALKEKEGVIAHAKKGAGAAPGRYVPMNAYAFGDWYTARTPTEERFAKALNERLYAQAGIAFADADVHDVPDQTPLIIKSVTTVALQLLKRHRNIAYADETGRVPPSIVLSCHAGHAAQPGMGLADMVIRQARWTARAIDEAARQGRLLSVPNPEFSAELFTDRWPENQSQQQGYARHLHTLANGLEAAQRGNVQLEDLQAWLRVQFGERVVTRSVKAFNDRLGRQVKAGQHGYTPKGGLFTPAAPAIIGSLSSLAPVAARAHTNMGERRFS

SEQ ID NO: 1077 - protein, 414 aa, Novosphingobium subterraneum
MASNIFRGDGRPNDPFGDPLDAILAEIALNLQLPPGLHAMAVDRYGAVCRYIDRPGSPLEGRVSSFYPQGSMAIDATISTRGTDDEYDLDAVVEIIGGSEGPEELLDLLEAALKGYPVSRIERKTRCITLYYADGMHLDVTPARRLAHKEKEGVIAHAKKGKPQEHRYVPMNAYGFCAWYNDRTPVEERFALALNRELYAKHGFTFDAAEVEEVPEQTPLLIKSVTTVALQLIKRHRNILYADEAGRMPPSVVLSCHAGHAAVPGMGLADMVMRQARWTARAIDQAARQNKLLDVANPEFLEERFTDRWPENQSQQQHYARALHGLADGLQMARERGVQLENLQDWLRDLFGQRVVTRSIDLFNKRLGQQVQARQHGYTRTGGLFTPAAPAIITGASALAPVAARAHTNMGERR

SEQ ID NO: 1078 - protein, 414 aa, Novosphingobium subterraneum; identical to SEQ ID NO: 1077

SEQ ID NO: 1079 - protein, 410 aa, Novosphingobium subterraneum
MFRGDGRPNDPFGDPLDAILAEIALNLQLPPGLHAMAVDRYGAVCRYIDRPGSPLEGRVSSFYPQGSMAIDATISTRGTDDEYDLDAVVEIIGGSEGPEELLDLLEAALKGYPVSRIERKTRCITLYYADGMHLDVTPARRLAHKEKEGVIAHAKKGKPQEHRYVPMNAYGFCAWYNDRTPVEERFALALNRELYAKHGFTFDAAEVEEVPEQTPLLIKSVTTVALQLIKRHRNILYADEAGRMPPSVVLSCHAGHAAVPGMGLADMVMRQARWTARAIDQAARQNKLLDVANPEFLEERFTDRWPENQSQQQHYARALHGLADGLQMARERGVQLENLQDWLRDLFGQRVVTRSIDLFNKRLGQQVQARQHGYTRTGGLFTPAAPAIITGASALAPVAARAHTNMGERR

SEQ ID NO: 1080 - protein, 414 aa, Sphingobium fuliginis
MASNIFRGDSRPNDPFGDPLDAILAEIALNLQLPPSLHAMAVDRYGAVCRYIDRPGSPLEGRVSSFYPQGSMAIDATISTRGTDDEYDLDAVVEIIGGSEGPEELLDLLEAALKGYPVSRIERKTRCITLYYADGMHLDVTPARRLAHKEKEGVIAHAKKGKPQEHRYVPMNAFGFCAWYNDRTPVEERFALALNRELYAKHGFTFDAAEVEEVPEQTPLLIKSVTTVALQLIKRHRNILYADEAGRMPPSVVLSCHAGHAAVPGMGLADMVMRQARWTARAIDQAARQNKLLDVANPEFFEERFTDRWPENQSQQQHYARALHGLADGLQMARERGVQLEDLQDWLRDLFGQRVVTRSVDLFNKRLGHQVQARQHGYTRTGGLFTPAAPAIITGASALAPVAARAHTNMGERR

SEQ ID NO: 1081 - protein, 410 aa, Novosphingobium sp.
MLRGDGRPFDPFGDPLDAILAEIAVNLQLPPGLHAIAVDRYTAVCRYIERPGSPLAGRVSSFYPQGSMAIDATISTRGTDDEYDLDAVVEIMGGCEGPEELLDLLEAALKDYPVSRIERKTRCITLYYADGMHLDVTPARRRAVKEKEGVIAHAKRGRPQEHRYVPMNAYGFCAWYNDRAPVEERFALALNRELYTKHGYAFDAAEVEEVPDQTPLLIKSVTTVALQLIKRHRNILYADKAGRMPPSVVLSCHAGHAAAPGMGLADMVMRQARWTARAIDQAARQNRLLDVANPEFFEERFTDRWPENQSQQQHYAQALHGLADGLQAARERGVQLEDLQDWLRGQFGQRVVTRSIDLFNKRLGQQVQARQHGYTRTGGLFTPAAPAIITGASALAPVAARAHTNMGERR

SEQ ID NO: 1082 - protein, 414 aa, Sphingomonadales bacterium
MPSNIFRGDGRPQDPFGDPLDAILAEIAVNLQLPPGLHIKAVDRYEAVCRYIDRPGSLLQGRVSSFYPQGSMAIDATISTRGTDDEYDLDAVAEIMGGNEGPEALLDLLEQALKDYPVSRIERKTRCITLYYADGMHLDVTPARRRALKEKEGVIAHAKQGLPSEHRYVPMNAYGFCAWYNERTPIEERFAIALNRELYVKHGFAFDAADVEEVPDQTPLIVKSVTTVALQLIKRHRNILYADASGRMPPSVMLSCHAGHAAVPGMGLADMVMRQARWTARAIDQTARQNKLLDVPNPEFHEERFTDRWPENQSQQQHYARALLALADGLQAVRERGMQLEDLQDWLRAQFGQRVVTRSVDAYNKRLGQQVQARQHGYTRTGGLFTPAAPAIIAGASALAPVAARAHTNMGERR

SEQ ID NO: 1083 - protein, 415 aa, Mesorhizobium ciceri
MAHSLNPFRDGRPADPFGDPLDAILAEIAINLQLPPGLHAKAVERYEAVCRHVDRPGSPLEGRVSSFYPQGSMAIDATISTRGTDDEYDLDAVAEILGGNEGPEALLDLLERALKGYTVSRIERKTRCITLFYADGMHLDVTPARRLAVKEKESVIAHAKKGRPSEHRYVPMNAFGFCAWYNDRTPVEERFAIALNRELYTKHGLAFYTADVEEVPDQTPLIIKNVTTVALQLIKRHRNILYADAAGRMPPSVMLSCHAGHAAMPGMALTDMVMRQARWTARAIDQAARQNKLLDVPNPEFYEERFTDRWPDNQARQRHYARALNTLADGLQAARESGMQLEDLQDWLREQFGERVVTRSVDAFNKRLGQQIRAGQHGYTRTGGLFTPAAPAIITGASALAPVAARAHTNMGERR

SEQ ID NO: 1084 - protein, 415 aa, Alphaproteobacteria bacterium
MMPSSIYRDDQRPSDPFADPLDAILAEIALNIQLPPGLHEKAVDRYKAVCRYIDRPGSPLEGRVSGLYPQGSMAIDATTSTRGTDDEYDIDAVAEIIGGDETPKGLLDLLERALVGYPVSRIERKTRCITLYYADGMHLDVTPARRVAAKEKQSAIPHAKQGEDVSQHRYVPMNAYGFCAWYNDRTPTERRFALALNKRLYEDAGMVFAAAEVEDVPEQTPLLIKSVTTVALQLLKRHRNVAYADAKGRVPPSILLSCHAGHAASPGMGLTDMVMRQARWTARAIDRAAGSGRLLDVYNPEFPAERFTDRWPENQRQQSDYAALLHALADGLEAARTRGAQLEDLQAWLREQFGAGAVTKSIAAFNARLGRQVQAREHGYTRSGGLFTPAAPALVGLGTLAPVAARAHTNMGERR

SEQ ID NO: 1085 - protein, 415 aa, Aureimonas sp.
MTMLTPFRGINPFTDHLDGLLADVAINVQLPPGLHRIACERYERVRRYMEREGSPLKDRILHFYPQGSMAIDATISSRWTEGDYDLDVVAQLDIPANTPPSIALDLIERALEGYPARIVRQTRCVTVYFEDMHLDVTPAVRHPGTIERQSDIFHAKEGEPRSEHFRVPMNAYGFARWYEANTPVETLFAEAYNQRLYDVYGLSFKADAEVDEVPEQCHLSIKNVATVALQLMKRFRDIAYLRATGRIPPSVMLSCYAGHAAASNLTLSDMLIRQARMLASDIRRASSSGRLLHVANPVYPDDVFTDRWPADLRQQDDFAHRLEALVAGLEAIKAGRHDLEDVGNLLRDWFGKGVVSSAMERKNQAMGRAVRTGTQGYGKTGLFVPAAPAILTSVPAAAASRVAGTPHTFMGGVPW

SEQ ID NO: 1086 - protein, 419 aa, Rhizobium leguminosarum
MTRRTVDGIDPFLNRIDAILAEIAFSVQLPPSLHGKAVDRYEAVRKHLEATTSIFYDQIEHFYPQGSMAIDATISNRGTDDEYDLDIIAQLGERFRSMSPIGILTELEKGLIGYRGLTVVRQTRCVTIYYADQMHLDISPSLRDVGTLERQSVIMHAKGPKASDDDQEVPMNAYGFGEWYIERTPTELKVVEAFKRRWEDAEHRRVKADADVDEVPLQTEFVVKSNTTLALQLIKRFRNVRYADRPGRMPPSVMLSYFAGLAARPGSSLTEALLRITKWIINEIEQATIRNQKLRVENPVYSEDVFTDRWPETIDQQKRFAADLRDLVRGIERAVNNEMLPTELQDWLREMFGDRVVTKAVDQMAMQTRLAAEQGRQGYTKRGGILVPAAPVVITSSQSSAYASPVQGSRHTYFGSNFK

SEQ ID NO: 1087 - protein, 419 aa, Unknown
  Description of Unknown: Rhizobium sequence
MTRVTVDGIDPFLNRIDAILAEIAFSVQLPPSLHGKAVDRYEAVRNHLEATSSIFHDQIEHFYPQGSMAIDATISNRGTDDEYDLDIIAQLGERFRSMSPIEILTELEKGLTGYRGLTVVRQTRCVTIYYADQMHLDISPSLRDVGTLERQSVIMHAKGPKASFDDQEVPMNAYGFGEWYIERTPTELKVVEAFKRRWEDAERRRVKADADVDDVPLQTEFLVKSNTTLALQLIKRFRNVRYADRSGRMPPSVMLSYFAGVAARPGSSLTDALLRITKWIINDIDQATIRNQKLRVENPVYSDDVFTDRWPDTIDQQKRFAADLRDLVRGIERALKGEMLPTELQDWLREMFGDRVVTKAVDQMAMQTRLAAENGRQGYTKRGSILVPAAPVVITSSQSSAYASPVQGSRHTYFGSNFK

SEQ ID NO: 1088 - protein, 419 aa, Rhizobium sp.
MTRVTVDGIDPFLNRIDAILAEIAFSVQLPPSLHGKAVDRYEAVRNHLEATSSIFHDQIEHFYPQGSMAIDATISNRGTDDEYDLDIIAQLGERFRSMSPIEILTELEKGLTGYRGLTVVRQTRCVTIYYADQMHLDISPSLRDVGTLERQSVIMHARGAKASFDDQEVPMNAYGFGEWYIERTPTELKVVEAFKRRWEDAERRRVKADADVDDVPLQTEFLVKSNTTLALQLIKRFRNVRYADRSGRMPPSVMLSYFAGVAARPGSSLTDALFRITKWIINDIDQATIRNQKLRVENPVYSDDVFTDRWPDTIDQQKRFAADLRDLVRGIERALNGEMLPTELQDWLREMFGDRVVTKAVDQMAMQTRLAAEHGRQGYTKRGSILVPAAAVVVTSSQSSAYASPVQGSRHTYFGSNFK

SEQ ID NO: 1089 - protein, 415 aa, Unknown
  Description of Unknown: Rhizobium sequence
MTRTTLDGIDPFLNRIDAILAEIAFSIQLPPSLHGKAVDRYEAVRKHLEATTSIFHDEIEHFYPQGSMAIDATISTRGTDDEYDLDIIAQLGERFRSMQPLEILTELEKGLIGYRGLTVVRQTRCVTIYYADKMHLDITPSLRDKGTLERQSVIMHAKGPEASDDDQDVPMNAYGFCQWYAERTPLELKVLEAFKRRWEDAEQRAVKADADVDEVPVQTEFIVKSNTTLALQLLKRYRNVRYANRPGRMPPSVMLSYFAGLAAKPGSSLTDALLRIANWIIGEIDQATIRNKTLHVENPVYADDVFTDRWPENVEQQERFARDLRELVKGVEKALNGEMLPTALQDWLREVFGDRVVTKAVDNMVKETRRAADQGTQGYTKRGSILVPAAPAVVTSIYASPVKASPHTYFGDRLK

SEQ ID NO: 1090 - protein, 415 aa, Ochrobactrum rhizosphaerae
MTRITVDGIDPFLNRIDAILAEIAFSVQLPPSLHSKAVGRYEAVRNHLDATTSIFHDQIEHFYPQGSMAIDATISNRGTDDEYDLDIVAQLGARFRSMTPLEILLELEKGLTGYRGLRVVRQTRCVTIYYADNMHLDITPSLRDAGTAERQSVIMHAKGPRASSDDQEVPMNAFGFCQWYNERTPTEIKVFEAFKNRWEHRQRQGITADADVDEVPVQSEFVVKSNTTLALQLLKRYRNIRYANRPGRMPPSVMLSYFAAVASKPGSTLTDALLRISKWIISEIDEASLRGKTLCVMNPVYREDVFTDRWPNDIAEQNRFATDLRELVKGIERAVKGELLPTTLQDWLREVFGDRVVTRAVDNMVAGTRRVTEYGGQSYTKRGGIMVPAVASVAMPANASSVRASPHTYYGDRFK

SEQ ID NO: 1091 - protein, 417 aa, Rhizobium leguminosarum
MNMSAFTGIDPFLDPADRILAQIAFNIQLPPSLHGKAISRYEAVRRHLEATTFFSDGIEHFYPQGSMAIDATISTRGTDDEYDIDIIAQLAARYRRLGPLGVLLTLEAALSDYPVEKVIRQTRCVTLIYADKMHLDVSAAFREGGTPERRSQIMHAKGPNPSADDCEVPSNAYGFAEHYKERTPVETAVTEAFRRKWEVYDRIRADAEVDEVPDQTPFVVKNTATLALQLVKRHRNITYDRKRRTGRMAPSVLLAHYAARSAVPNRTLTDALINLCNLLIVDIRRATSLGRTLVVVNPTWDQDEFTDRWPESIAQQEEFAGDLVELVTAVDQLRSGKLDPIDVPKRLRQLFGDYVVTEAIRKLAQDNGDAVRGATQSYTKTGGILLPASAVATPALASPKTASPISASRHDFFGDPV

SEQ ID NO: 1092 - protein, 418 aa, Agrobacterium sp.
MNMIAFTGIDPFLDPVDRILAQIAFNIQLPPSLHAKAVSRYEAVRRHLEATTFFADGIEHFYPQGSMAIDATISTRGSDDEYDIDIIAQIAVRYRHFGPLGVLKALEAALSNYPVEKVIRQTRCVTLVYGDRMHLDVSAAFREQGTPERHSQIMHAKGPNRSSDDCEVPSNAYGFAEHYKACTPVETAVSEAFRRRWNDYDRLRADAEVDDVPDQAPFVVKNMATLALQLVKRYRNITYDRKHHAGRMAPSVLLAHYAARSARPGRTLSDALVSLCNLLIIDIRRASSLGRTLTVVNPTWDQDEFTDRWPESIDQQNEFADDLANLVAAVNRLSSGNMDPVDIPAELRQLFGDYVVNEAIRKIAQETGGAVKQSSQSYTRKGGILVPSAAVAAPALVVPKAVAAPVAASRHDFFGDAV

SEQ ID NO: 1093 - protein, 418 aa, Agrobacterium sp.
MNFMRPPGINPFLDPTDRYLAEIAFTVQLPPSLHAKADGRYAATRRHLEASTFFANGIEHFYPQGSMAIDATISTRGTDDEYDIDIIAQLSPRYRRLGPLGVLKALEDALADYPVQKVIRQTRCVTLVYGDRMHLDISPGFRDVGTEERCSHIMHAKGPSHSEEDHEVPTNAYGFAEWYKERTPVELAVQEAFRRKWEDHLQVQADADVDEVPDQTPFVVKNMATLALQLLKRFRNIRYDQLGRKGRMAPSVLLAYYAARSATPGQTLTDALLNLCALIIRDIETASMLDRKLSVRNPTHYDDVFTDRWPDSVRQQDEFASDLRTLVEAIKTLRSERTDPIEIPGILKLLFGEYVVTDSIRRLAKATGSSIQGATQSYTKKGGLLVPAVVAATPAAAAPKIISPVAATRHGFYGDPVE

SEQ ID NO: 1094 - protein, 418 aa, Sinorhizobium sp.
MNVMRPTGINPFFDPTDRYLAEIAFSVQLPPSLHAKADSRYAATRRHLEASVFFADGIEHFYPQGSMAIDATISTRGTDDEYDIDIIAQLSARYRGLGPLGVLKALEDALSDYPVQEVIRQTRCVTLVYNDRMHLDISPGFRDVGMIERCSHIMHAKGPSPSSEDQEVPTNAYGFAEWYKERTPVEIAVQEAFRKKWQDHLRVKADADVDDVPDQTPFVVKNMATLALQLLKRFRNIRYDQMGRKGRMAPSVLLAYFAARSATPGQTLTDALLSLCALIIREIDTASMLDRKLCVRNPTHYDDVFTDRWPESVQQQNEFASDLRTLVESIKTLRSERTDPIEIPGILKQLFGEYVVTETIRRMAKATGSSIQSATQSYTKKGGLLVPAAVAATPAVAAPKIISPVAATRHGFYGDPVE

SEQ ID NO: 1095 - protein, 418 aa, Ensifer adhaerens
MNFMKPSGVNPFLDPTDRYLAEIAFTVQLPPSLHAKADSRYAATRRHLEISTIFADGIEHFYPQGSMAIDATISTRGTDDEYDIDIIAQLSGRYRHLGPLGILKALEAALEDYPVQEVIRQTRCVTLVYGDRMHLDISPAFRDTGTPERCSHIMHAKGPNRSNEDHEVPTNAYGFAEWYKVRTPVELAVQEAFRRKWEDHLRIRADADVDDVPDQTPFVVKNMATLALQLLKRFRNIRQDQTGRKGRMAPSVLLAYYAARSAMPGQTLTDALLNLCALIIRDIETASMLGRKLYVCNPTYADDVFTDRWPESVAQQNEFASDLRMLVEAIKTLRSERTDPVEIPGILKRLFGDYVVTDSIRRMAKATGSSIQGATQSYTKKGGLLVPAVVASTPAVASSKIISPVSATRHGFYGDPVK

SEQ ID NO: 1096 - protein, 417 aa, Rhizobium sp.
MNFMRPSGINPFLDPTDRFLAEIAFTIQLPPSLHAKADGRYAAARRHLEASTFFADGIEHFYPQGSMAIDATISTRGTDDEYDIDIIAQLAGRFRHLGPLAILKAIEAAFKDYPVQQVIRQTRCITLVYSDRMHLDVSPGFRDLWTPDRQSHIMHAKGPAASTDDHEVPTNAYGFAEWYKARTPVELAVQEAFRRKWEDHLRIRADADVDEVPDQTPFVVKNMATLALQLLKRFRNIRHDQMGRQGRMAPSVLLAYYAARSASPGQTLTDALLNLCTLIIRDIDRASMLGRTLEVRNPTYFDDVFTDRWPGSITQQNEFASDLRLLVEAIKTLRSERTDPVEIPGILKRLFGDYVVTDSIRRIAKATGSSIQGATQSYTTKGGLLVPAVIAATPAAAAPNVISPIAATRHRFYGDPL

SEQ ID NO: 1097 - protein, 415 aa, Unknown
  Description of Unknown: Rhizobium sequence
MNMNIPTGINPFLDPVDRILAEIAFSIQLPPSLHATAVSRYEAVRKHLEATASFFGDIEHFYPQGSMAIDATISTRGTDDEYDIDIIAQVGGRFRTMSPLDVLLTLERGLTGYRGLKVTRQTRCVTLHYADNMHLDISPVVRDYGFPDRQSHIMHAKGPQHGADDCRVPTNAYAFVEWYKRNTPNETVVRDAFRQRWLDAKGFAADAEVDDVPDQTHFGVKSMATLALQLVKRYRNIRYDDPRRTGRMPPSVMLAYYAARTSRPGQTLTEALVGVCNAIIADIAYASTRGRKLHVANPEYDNDVFTDRWPENVEQQNLFANDLRELVQGLEILRAGKADLTKMPDWLREMFGGRVVTSVIDRMAARNGSAIRSATQLYTPAGGVFAGAAALAAPAAAKTSPIIRPSSHTFFGDAP

SEQ ID NO: 1098 - protein, 427 aa, Unknown
  Description of Unknown: bacterium YEK0313 sequence
MHRCSQPAVEIDVNIQLAPTGLNPFDDPLDRILAEIALSVQLPPSLHDKAKSRYEAVRRHLEATTAFFDQIEHFYPQGSMAIDATISTRGTDDEYDLDIVSQLGGRFRGMAPLEILTELEAALADYPVQRVLRQTRCVTLFYADKMHLDVTPSLRVYRTLDRESLITHAKGPRRSDDDRLVDMNAYGFAQWYASRTPLELRMAKEFHRRWLDHAGLAARADADVDDVPDQCDFIVKNTATLALQLLKRFRNIRYASYSGRIPPSVMLSYYAGLAAQPNMSLSTMLVRLASWIIRDIEQASLYGRLLRVANPICEADVFTDRWPESIAQQDEFAEHLHELVRSLEAMRKGEMLPNAMMDTLRDDFGDRVVTRAADQIATEVGGGIQQSRQLYTRRGGVLLPSAAAVAAPIVNPAVSVARPHTFFGRKI

SEQ ID NO: 1099 - protein, 415 aa, Unknown
  Description of Unknown: bacterium YEK0313 sequence
MNIQLAPTGLNPFDDPLDRILAEIALSVQLPPSLHDKAKSRYEAVRRHLEATTAFFDQIEHFYPQGSMAIDATISTRGTDDEYDLDIVSQLGGRFRGMAPLEILTELEAALADYPVQRVLRQTRCVTLFYADKMHLDVTPSLRVYRTLDRESLITHAKGPRRSDDDRLVDMNAYGFAQWYASRTPLELRMAKEFHRRWLDHAGLAARADADVDDVPDQCDFIVKNTATLALQLLKRFRNIRYASYSGRIPPSVMLSYYAGLAAQPNMSLSTMLVRLASWIIRDIEQASLYGRLLRVANPICEADVFTDRWPESIAQQDEFAEHLHELVRSLEAMRKGEMLPNAMMDTLRDDFGDRVVTRAADQIATEVGGGIQQSRQLYTRRGGVLLPSAAAVAAPIVNPAVSVARPHTFFGRKI

SEQ ID NO: 1100 - protein, 415 aa, Bradyrhizobium japonicum
MSIQLAPTGLNPFDDPLDRILAEIALSVQLPPSLHDKAKSRYEAVRRHLEATTAFFDQIEHFYPQGSMAIDATISTRGTDDEYDLDIVSQLGGRFRSMAPLEILTELEAALADYPVQRVLRQTRCVTLFYADKMHLDVTPSLRVYARLDRESLITHAKGPRRSDDDRLVDMNAYGFAQWYASRTPLELRMAKEFHRRWLDHAGLAARADADVDDVPDQCDFIVKNTATLALQLLKRFRNIRYASYSGRIPPSVMLSYYAGLAAQPNMSLSAMLVRLASWIIRDIEQASLYGRLLHVANPICEADVFTDRWPESIAQQDEFAEHLQELVRSLEAMRKGEMFPNTMMDTLRDDFGDRVVTRAADQIATEVGGGIQQSRQLYTRRGGVLLPSAAAVAAPIVNPAVSAARPHTFFGRKI

SEQ ID NO: 1101 - protein, 414 aa, Xanthobacter sp.
MNIQLAPTGLNPFDDPLDRILAEIALSVQLPPSLHDKAKSRYEAVRRHLEATTAFFDQIEHFYPQGSMAIDATISTRGTDDEYDLDIVSQLGGCFRGMAPLEILTALEAALTDYPVQRVLRQTRCVTLFYADKMHLDVTPSLRVYATLDRESLITHAKGPRRSDDDRLVDMNAYGFAQWYASRTPLELRMAKEFHRRWLDHAGLAARADADVDDVPDQCDFIVKNTATLALQLLKRFRNIRYASYSGRIPPSVVLSYYAGLAAQPNMSLSAMLVRLASWIIRDIEQASLYGRLLHVANPVCATDVFTDRWPESITQQDEFAEHLHELVRSLEAMRKGEMFPNTMMDTLRGNFGDRVVTRAADQIATEVGGGIQQSRQLYTRRGGVLLPIAAVAASTVNPAVSAARPHTFFGHKI

SEQ ID NO: 1102 - protein, 415 aa, Rhodopseudomonas palustris
MNIQLTPTGLNPFDDPLDRILAEIALSVQLPPSLHDKAKSRYEAVRRHLEATTAFFDQIEHFYPQGSMAIDATISTRGTDDEYDLDIISQLGGRFRGMAPLEILTELEAALADYPVQRVLRQTRCVTLFYADKMHLDVTPSLRVYTTLDRESLITHAKGPRRSADDRLVDMNAYGFVQWYTSRTPLELRMAKAFHRRWLDHAGLAARADADVDDVPDQCDFIVKNTATLALQLLKRFRNIRYASYTGRIPPSVMLSYYAGLAAQPNMSLSAMLVRLASWIIRDIEQASLYGRLLHVANPVCEADVFTDRWPESIGQQDEFAGHLGEVVRSLEAMRKGEMAPNTMMDALRENFGDRVVTRAADQIATEIGGGIQQSRQLYTRRGGVLLPSAAAVAAPIVNPTVSAARPHTFFGRKI

SEQ ID NO: 1103 - protein, 415 aa, Unknown
  Description of Unknown: Rhizobiales sequence
MNIQPTPTGLNPFDDPLDRILAEIALSVQLPPSLHDKAKSRYEAVRRHLEATTAFFDQIEHFYPQGSMAIDATISTRGTDDEYDLDIVSQLGGRFRGMTPLEILTELEAALADYPVQRVLRQTRCVTLFYADKMHLDVTPSLRVYSKLDRESLITHAKGPRRSVDDRFVDMNAYGFAQWYANRTPLELRMAKEFHRRWLDHAGLAARADADVDDVPDQCDFIVKNTATLALQLLKRFRNIRYASYAGRIPPSVMLSYYAGLAAQPNMSLSAMLVRLASWIIRDIEQASLYGRLLHVANPICEADVFTDRWPESIAQQDEFAGHLRVLTRSLEAMRKGEMFPDTMMDVLRGNFGDRVVTRAADQIATEIGGGIQQSRQLYTRRGGLLLPSAAGVAAPIINPSVSVARPHTFFGRKI

SEQ ID NO: 1104 - protein, 415 aa, Unknown
  Description of Unknown: Afipia sequence
MNIQLAPTGLNPFDDPLDRILAEIALSVQLPPSLHDKAKSRYEAVRRHLEATTAFFDQIEHFYPQGSMAIDATISTRGTDDEYDLDIVSQLGGRFRGMTPLEILIELETALADYPVQRVLRQTRCVTLFYADKMHLDVTPSRRVYGTLDRESLITHAKGPRRSVDDRFVDMNAYGFAQWYASRTPLELRMAKEFHRRWLDHAGLAARADADVDDVPDQCDFIVKNTATLALQLLKRFRNIRYASYTGRTPPSVMLSYYAGLAAQPNMSLSAMLVRLVSWIIRDIEQASLYRRLLHVANPVCEADVFTDRWPESVAQQDEFAGHLRELIRSIEAMRHGEMFPDKMMDTLRGNFGDRVVTRAADQIATEIGGGIQQSRQLYTRRGGLLLPSAAAVAAPLVNPAVSAARPHTFFGRKI

SEQ ID NO: 1105 - protein, 415 aa, Bradyrhizobium sp.
MNIQLAPTGLNPFDDPLDRILAEIALSVQLPPSLHDKAKSRYEAVRRHLEATTAFFDQIEHFYPQGSMAIDATISTRGTDDEYDLDVVSQLGGRFRGMTPLEILTELETALADYPVQRVLRQTRCVTLFYADKMHLDVTPSLRVHGTLDRESLITHAKGPRRSAGDRFVDMNAYGFAQWYASRTPLELRMAKEFHLRWLDHAGLAARADADVDDVPDQCDFIVKNTATLALQLLKRFRNIRYASYAGRIPPSVMLSYYAGLAAQPNMSLSAMLVRLASWIIRGIEQASLYRRLLHVANPICETDVFTDRWPESIAQQDEFAEHLRDLIRSLEAMRKGEMYPDTMMDTLRGSFGDRVVTRAADQIATEIGGGIQQSRQLYTRRGGLLLPSAAAVAAPIVNPAVSSARPHTFFGSKI

SEQ ID NO: 1106 - protein, 415 aa, Afipia birgiae
MNIQLAPTGLNPFDDPLDRILAEIALSVQLPPSLHDKAKSRYEAVRRHLEATAAFFDQIEHFYPQGSMAIDATISTRGTDDEYDLDIVSQLGGRFRGMPPLEILTELESALSDYPVQRVLRQTRCVTLFYADKMHLDVTPSLRAYGTLDREGLITHAKGPRRSEDDRFVDMNAYGFAQWYASRTPLEVRMAKEFHRRWLDHAGLATRADADVDDVPDQCDFIVKNTATLALQLLKRYRNIRYASYSGRIPPSVMLSYYAGLAAHPNTSLSAMLVRLASWIVRDIEQASLYGRLLHVANPVCKADVFTDRWPESVAQQNEFAEYLRELVRSLEAMRKGEMFPNTMMDVLRGNFGDRVVTRAADQIATEVGGGIQQSRQLYTRRGGVLLPSAAAVAAPMINPAVATARPHTFFGQKI

SEQ ID NO: 1107 - protein, 415 aa, Sphingopyxis macrogoltabida
MNTQIMPTGINPFDDPLDRILAEVALSVQLPPSLHDKAKSRYEAVRRHIEGKAAFADQIEHFYPQGSMAIDATISTRGTDDEYDLDIVSQLGGRFRDMAPLEILTELESALSDYPVQRVLRQTRCVTLFYADKMHLDVTPSLRAYGTLDRESLITHAKGPRRSEDDSFVDMNAYGFAQWYASRTPLEVRMAKEFHRRWLDHAGLATRADADVDDVPEQCDFIVKNTATLALQLLKRYRNIRYASYSGRIPPSVMLSYYAGLAAHPNMSLSAMLVRIANWVVRDIEQASLYGRLLHVANPVCAADVFTDRWPESGAQQNEFAEYLRELVRSLEAMRKGEMFPNTMMDVLRENFGDRVVTRAAHQIATEVGGGIQQSRQLYSRRGAVLLPSAAAVTAPMINPAVATARPHTFFGKKL

SEQ ID NO: 1108 - protein, 415 aa, Nitrobacter sp.
MNIQLAPTGLNPFDDPLDRILAEIALSIQLPPSLHDKAKSRYEAVRRHLEGTTAFFDQIEHFYPQGSMAIDATISTRGTDDEYDLDIVSQLGDRFRGMTPLEILAEMETALADYPVQRVLRQTRCVTLFYADKMHLDVTPSLRVYGTLDRESLITHAKGPRRSADDRFVDMNAFGFAQWYAGRTPLEPRMAREFHRRWLDHAGLAARADADVDDVPDQCHFIVKNTATLALQLLKRFRNIRYANYDRRIPPSIMLSYYAGLAAQPNMSLGAMLARLASWIIRDIEQASLYGRLLHVANPVCEADVFTDRWPESIAQQNEFAEHLRDLVRSLESMRKGEMFPNTMMDVLRSDFGDRVVTRAANQIAIEVGGDIQQSHQLYTRRGGLLLPSAAAVAAPIVNPSVAAARPHTFFGRKI

SEQ ID NO: 1109 - protein, 415 aa, Bosea sp.
MNMQLAPTGLNPFDDPLDRILAEIALSIQLPPSLHDKAKSRYDAVRRHLEGTAAFFDQIEHFYPQGSMAIDATISTRGTDDEYDLDIVSQLGGRFRGMTPLQILIELETALADYPVQKVLRQTRCVTLYYADKMHLDVTPSLRVIGTLDRESLITHAKGPHRSADDRFVDMNAYGFAQWYASKTPLEPRMAREFHRRWLDHAGLAARADAEVDDVPDQCHFIVKNTATLALQLLKRFRNIRYAADSGRIPPSVMLSYYAGLAAQPNMSLSAMLARIASWIIREIEQASLYGRRLHVANPVCEDDIFTDRWPESIAQQNEFADHLRDLVRSLDAMRKGEIFPNTMMEMLRSDFGDRVVTRAADQIAIEIGGDIQQSRQLYTRRGGVLLPSAAAVAAPLVVPSVAAARPHTFFGRKI

SEQ ID NO: 1110 - protein, 419 aa, Mesorhizobium ciceri
MNTQYAFSGINPFDDPLDRILAEIALSIQLPPSLHDKAKGRYQAVRNHLEATVAFRDQIEHFYPQGSMAIDATISNRGTDDEFDLDIVSQLGGRFRAMEPLEILRALETALADYPVQRVRRQTRCVTLYYADKMHLDITPALREYGTRDRESFITHAKGPARSSDDRLVDMNAYGFAGWYDERTPLEARMASEFNRRWRDMYLSTAKADAEVDDVPDQTHFIVKNTATLALQLIKRYRNIQYAGYAGRIPPSVMLSFYAGQAAQPNSSLSAMMIRIANWIIADIENASLYGRKLHVANPVCADDVFTDRWPESVTQQDEFARHLRALVRNLEQMRRGEMFPDDMMDWLRGNFGDRVVTRAADNIAGQVGSAIQKSQQLYSKKGGVLFPTPGIIAGVAAAPLASPAVAAARPHTFFGKKI

SEQ ID NO: 1111 - protein, 418 aa, Bradyrhizobium sp.
MLTLPAYDGLDPFEDPLDRLLAQIAIELQLPPSLFDQAGDRYAAVRRMLEGTSAFAGLIEHFYPQGSMAIDSTISIRGTDDEYDLDIVAQLGGYFREMAPLAVLIELEKALVNYPVQRITRQTRCVTLHYADKMHLDITPGIRVAGTTERESYIMHAKGPKPGHDDRLVDMNAYAFACWYQERTPLERRFAKSFDRHWRGIDELMAADEAEVDDVPDQTHFSVKNTATLALQLIKRFRNIRYADYSGRIPPSVVLSYYAALSARPNMRLSEMVIRIAKWILRDIEAASMTGRRLHVANPMCPNDVFTDRWPESVAQQNEFANHLKDLVKGLEAMAKMTMAADAIGEWLRHMFGDRVVTKAADSTAVRLGAAIQNTQQSYSRKGRLLVPGTGRSLSAAVAPLVAPATSARAHTFFGLRF

SEQ ID NO: 1112 - protein, 414 aa, Novosphingobium nitrogenifigens
MMNAPIASQGRNPFDDPVDRILAEIALSAQLPPSLHRKAVGRYEAVRKYLEADAAFNGEIEHFYPQGSMAIDGTISTRGTDDEYDIDIVAQLGGRFRTMDPLSILKELERALKDYPVRKVVRQTRCVTLYYADNMHLDVTPSLRVYGTADRESYITHAKGPFVGPNDQFVDMNAYGFAGWYRANTPLEPRLAKAFRDRWFAMDSALAKAAEIDEVPEQCDFVVKNTATLALQLLKRYRNICYAHYDGRIPPSVMLSYYAGVSARPNMSLSDMLVRVANWIKGDIDEANRRGRLLHVANPVTPADVFTDRWPASFVQQEELARHLERLVVGVEAAKRGEVTPDKLTNWLRAQFGDRVVTMAVDRMANTIGQSVQDAAHGYSRKGGLILPAAAATGMAVAPSVVRASPHTFFGERI

SEQ ID NO: 1113 - protein, 413 aa, Novosphingobium nitrogenifigens
MNAPIASQGRNPFDDPVDRILAEIALSAQLPPSLHRKAVGRYEAVRKYLEADAAFNGEIEHFYPQGSMAIDGTISTRGTDDEYDIDIVAQLGGRFRTMDPLSILKELERALKDYPVRKVVRQTRCVTLYYADNMHLDVTPSLRVYGTADRESYITHAKGPFVGPNDQFVDMNAYGFAGWYRANTPLEPRLAKAFRDRWFAMDSALAKAAEIDEVPEQCDFVVKNTATLALQLLKRYRNICYAHYDGRIPPSVMLSYYAGVSARPNMSLSDMLVRVANWIKGDIDEANRRGRLLHVANPVTPADVFTDRWPASFVQQEELARHLERLVVGVEAAKRGEVTPDKLTNWLRAQFGDRVVTMAVDRMANTIGQSVQDAAHGYSRKGGLILPAAAATGMAVAPSVVRASPHTFFGERI

SEQ ID NO: 1114 - protein, 185 aa, Sinorhizobium fredii
MTTSAYRGKNPFEDPLDRILAEIAISVQLPPSLHAKACQRYKTVREYLEGSTEFKDQIEHFYAQGSMAIDATISTRGTDDEYDIDIVAQLGGRYRNMTPLAILHALAAALRDYPVQKIVQQTRCVTLFYADNMHLDVTPALRDYGTTDRQSAITHAKGPLPSNNDCMVSMNAYGHAEWYKAPHTE

SEQ ID NO: 1115 - protein, 185 aa, Sinorhizobium fredii; identical to SEQ ID NO: 1114

SEQ ID NO: 1116 - protein, 413 aa, Mesorhizobium sp.
MTTFAYQGKNPFEDPLDRILAEIAFSVQLPPFLHGKACQRYKAVREYLEGTTSFHDQIEHFYVQGSMAIDATISTRGTDDEYDIDIVAQLGGHYRHMTPLATLKALAAALKDYPVQKIVQQTRCITLFYADNMHLDVTPALRDYGTTDRQSAITHAKGPLPSNDDCMVPMNAYGHAEWYKASTPNEERVIEAFKDRWFGDNRRSIRADAEVDEVPDQMEFVVKNMATVALQLLKRYRNVRYANYSGRIPPSVMLSYFAGAAALPDMKLSDMLIRICRWIIGEIERATINRQKLDVVNPTYSADVFTDRWPENLDQQNQFARYLHDLVAGIERAKHGELDPVKLRNWLREMFGDRVVTRAADRMADATGAAIVAGSQVYSKKGSILLPAAATIVTSVAPVAAKPHTFFGDPVDE

SEQ ID NO: 1117 - protein, 413 aa, Mesorhizobium sp.
MTTFAYQGKNPFEDPLDRILAEIAFSVQLPPSLHGKACQRYKAVREYLEGTTPFHDQIEHFYAQGSMAIDATISTRGTDDEYDIDIVAQLGGRFRHMTPLAILKALAAALKDYPVQKIVQQTRCVTLFYADNMHLDVTPALRDYGTTDRQSEITHAKGPLPSNDDCMVPMNAYGHAGWYKARTPNEERVIEAFRDRWFGDHRLNIRADADVDEVPDQTQFVVKNMATVALQLLKRYRNVRYANYSGRIPPSVMLSYFAGAAALPDMKLSDMLIRICRWIIGEIERATINRQKLQVVNPTYSADVFTDRWPENLDQQNQFARYLHDLVAGIERAKRGELDPVSLRNWLREMFGDRVVTRAADRTADATGAAIVAGSQVYSKKGSILLPAAATIVTSVAPVAAKPHTFFGDPVDE

SEQ ID NO: 1118 - protein, 412 aa, Asticcacaulis sp.
MTTPNPTGINPFEDPIDRIFAEIAFSIQLPPSLHAKAVKRYEAVRNFLSAETCAFKDQIEHFYPQGSMAIDATISSRGTDDEYDIDIVAQLGTAFRGKSPLYVLTELGKALASYPVEKVTRQTRCVTLQYNDHMHIDITPSIRDDYTPDRQSRIMHAKGPTTSALDKLVEMNAYGFNEWYKSKTPEEQQVMEAFRNRWLEMNRLEKADAEVDDVPDQTQFVVKNTATLALQILKRHRNIMYADLDERMPPSVMLSRYAAVAAQPNSSLTDMILRIARWIVADIRSATALGKQLHIENPVYSADVFTDRWPETLVQQNRYANFLLRFIDGIEKAKRKAFNPIELQDWLRSMFGQRVVTRSIDSLATTVGSAVKAATPAYSRTGRLLLPTAGLALTQPSLVRAAPHTFMGDWPK

SEQ ID NO: 1119 - protein, 414 aa, Asticcacaulis sp.
MHVTTPNPTGINPFEDPIDRIFAEIAFSIQLPPSLHAKAVKRYEAVRNFLSAETCAFKDQIEHFYPQGSMAIDATISSRGTDDEYDIDIVAQLGTAFRGKSPLYVLTELGKALASYPVEKVTRQTRCVTLQYNDHMHIDITPSIRDDYTPDRQSRIMHAKGPTTSALDKLVEMNAYGFNEWYKSKTPEEQQVMEAFRNRWLEMNRLEKADAEVDDVPDQTQFVVKNTATLALQILKRHRNIMYADLDERMPPSVMLSRYAAVAAQPNSSLTDMILRIARWIVADIRSATALGKQLHIENPVYSADVFTDRWPETLVQQNRYANFLLRFIDGIEKAKRKAFNPIELQDWLRSMFGQRVVTRSIDSLATTVGSAVKAATPAYSRTGRLLLPTAGLALTQPSLVRAAPHTFMGDWPK

SEQ ID NO: 1120 - protein, 416 aa, Rhodobacteraceae bacterium
MNKHLGTPAAPWNSISEQMLAAVAIKIELPPSMHALLAERKAAIEKHLERDGSPLKGKVRVFYQQGSVAIGATIRAKFRFEGFDIDIIVELVTPGLTPWQALELLYEAMRGEPGSRYYDMTERQTRCVTVHYADGMHLDLSPSELINEFDPRQSFIYHSKPEEPRSSDHKVLTNSFGFADEYNTTCPVDLSFQQEYARRALIADHGLVVMQKDADSLPVPEHSTVVGGKSAVTVAQMLIKRNRNIRWSKRKGRTPASAIIAALSLEVAGPGRTIGQNLRVVAQHILDRLLWAKSVGELIHVENPRCPGDVFTDRWPANQTAQDTMIADMRLFLDQLAVLLDDTRSLRDRRDTLKAMFGEDVGQTVVDDLERDIGEAIRSGRHGFGALGGIAVSPTIARAKSSVKPSTFYGTRWRRS

SEQ ID NO: 1121 - protein, 398 aa, Rhodobacteraceae bacterium
MLAAVAIKIELPPSMHALLAERKAAIEKHLERDGSPLKGKVRVFYQQGSVAIGATIRAKFRFEGFDIDIIVELVTPGLTPWQALELLYEAMRGEPGSRYYDMTERQTRCVTVHYADGMHLDLSPSELINEFDPRQSFIYHSKPEEPRSSDHKVLTNSFGFADEYNTTCPVDLSFQQEYARRALIADHGLVVMQKDADSLPVPEHSTVVGGKSAVTVAQMLIKRNRNIRWSKRKGRTPASAIIAALSLEVAGPGRTIGQNLRVVAQHILDRLLWAKSVGELIHVENPRCPGDVFTDRWPANQTAQDTMIADMRLFLDQLAVLLDDTRSLRDRRDTLKAMFGEDVGQTVVDDLERDIGEAIRSGRHGFGALGGIAVSPTIARAKSSVKPSTFYGTRWRRS

SEQ ID NO: 1122 - protein, 416 aa, Rhodobacterales bacterium
MNVHLGKTTSPWDSVAEQMLAAVAIKIELPPSMHALLTERKAAIEKHLERDGSPLKGKVRLFYQQGSVAIGATIRAKFRFEGFDIDIIVELITPGMTPWQALELLYWAMRGEPGSRYYDMTERQTRCVTVHYSDGMHLDLSPSELINEFDPRQSFIYHSKPEEPRSSDHKVLTNSFGFADEYNTICPVDLSFQQEYARRALKADRGLITMQKDAESLPVPEHSTVVGGKSAVTVAQMLIKRNRNIRWARRPGRTPASAIIAALSLEVAEPGRTIGHNLQVIAQHILSRLLGSKSDGELIHVENPRCRGDIFTDRWPENHAAQDVMIADMRLFLNQLAMLLDDGRSLRERRDTLKAMFGEDVGQSVVDDLERDIGEAIRSGRHGFGALGGLAMSPTIAKAKPAVKPSTFYGTRWRRS

SEQ ID NO: 1123 - protein, 416 aa, Rhodobacteraceae bacterium
MNKHLGTPAAPWDSISEQMLAAVAIKIELPPSMHALLAERKAAIEKHLERDGSPLKGKIRLFYQQGSVAIGATIRAKFRFEGFDIDIIVELIARDLTPSQALDLLYEAMRGEPGSRYYDMTERQTRCVTVHYADGMHIDLSPSELISEFDPRRSYIYNSKPEEPRSRDHKVLMNSFGFAEEYNATCPVDLSFQQEYARRALKADYGLIAMQKDADSLPVPAHSTVVGGKSAVTVGQMLIKRNRNIRWANRDGRMPASAMLACLTLEVAESGRTIGQNLRIIAQHILDRLLWAKSVGELIHVENPRCPGDVFTDRWPENHSAQDTMIADMKLFLEQLSVLLDDRRTLRERCDTLKAMFGEDIGQQVVDDMEREIGEAIRTGRHGFGALGGLAMSPTIAKAKPTVKPSTFYGTRLNKR

SEQ ID NO: 1124 - protein, 415 aa, Aliiroseovarius crassostreae
MNKHLGTPAAPWDSVSEQMLAAVAIKIELPPSMHALLAERKAAIEKHLERDGSPLKGKIRLFYQQGSAAIGATIRAKFRFEGFDIDIIVELNTPGLTPWEALELLYEAMRGERGSRYYDMTERQTRCVTIHYADGMHLDLSPAELISEIDPRRSYIFHSKPEDQRNKDHRVLTNSFGFVEEYNSTCPVDLSFQQEYARRALQADQGLVVMQKDADSLPVPAHSTVVGGKSAVTVALQLLKRNRNIRWATRDGRMPASVMLSCLTLEVAESGRTIGQNLKIIAQHILDRLLWAKSVGELIHVENPRCPGDVFTDRWPENHSAQDKMIADMKLFLEQLSVLLDDRRTLRERRDTLKAMFGEDIGQQVVDDMEREIGEAIRTGRHGFGALGGLAMSPTIARAKPAVKPSTFYGTRFWK

SEQ ID NO: 1125 - protein, 416 aa, Rhodobacter maris
MNAFLGKPTSPWDSVAEQMLAAVAIKIELPPSMHALLAERKAAIEKHLERDGSPLKGKVRLFYQQGSVAIGATIRAKFRFEGFDIDIIVELTTPGMTPWQALELLYEAMRGERGSRYYDMTERQTRCVTIHYADGMHLDLSPAEMIDEFDPRRSYIYHSKPEEPRSRDRKVLTNSFGFAEEYNATCPVDLSFQQEYARRALRADQGLIAMQKDADSLPVPAHSSVVGGKSAVTAALQLLKRNRNIRWATRDGRMPASVMYSCLTLEVAEAGRTIGQNLRIIVQHILDRLSQAKSVGQLIHVENPRCPGDVFTDRWPEDHAAQDTLIADMRLFLNQLDILLDDRRSLRERRDVLKSMFGESIGEEVMDELERDYGEAIRTGKHAFGATGGIAMSPAIAKAKPAVKPSTFYGSTWPRR

SEQ ID NO: 1126 - protein, 417 aa, Roseovarius sp.
MNKPTYENFRPFAVIGERLLASTAIKIELPPSQHALMVQRKAAIEKHLEREDSPLNGLIRLFYQQGSVAIGATIRAKFRQEGFDIDIIVELLGRGNLTPAQVLDLLFEAMRGEPGSRYHDCTERQSRCVTVYYADGMHLDLSPAVLLDERDPRRSHIFHSKLEEPRWKDTTILTNCFGFVAHYNERCPIDQMFAEDYGRLVRDADLQLQVMAKDADSVPVPVHSTTVGGKSAVTVALQLLKRNRNIRWLPRNRRMPASVMFSCLSLEVAETGRTIGQNLKVIAEHILDRLIRAKSVGELLHVENPVCRGDVFTDRWPVDHSDQDLLIGDMRLLLRQLAELFDDRRPFKDRSKTLEDMFGETVAKQVVEEFAEEMGQSVRLGSHFLGATGGILTAPTLVSAKPAAPRNTFYGTKWSKS

SEQ ID NO: 1127 - protein, 417 aa, Rhodobacter capsulatus
MNKPTYENFRPFSVIGERLLASTAIKIELPPSQHALMVQRKAAIEKHLEREGSPLKGLIRLFYQQGSVAIGATIRAKFRQEGFDIDIIVELLERGSLTPAEVLDLLYEAMRGEPGSRYYDCTERQSRCVTVYYADGMHLDLSPAVLLDERDPRRSYIFHSKLEEPRWKDTTILTNCFGFVAHYNERCPIDQMFAEDYGRLVRDADLQLQVMMKDADSVPVPVHSTTVGGKSAVTVALQLLKRNRNIRWLPRNRRMPASVMFSCLSLEVAEAGRTIGQNVKVIAEHVLDRLIRAKSVGELLHVENPVCRGDVFTDRWPVNHTDQDLLIGDMRLLLRQLAELFDDRRSFKDRSKTLEDMFGETVAKQVVDEFSVEMGQSVRSGSHLLGATGGILAAPTLVSARPAAPRNTFYGTKWSKS

SEQ ID NO: 1128 - protein, 417 aa, Oceanicola sp.
MNKPTYENFRPFSVIGERLLTSTAIKIELPPSQHALMVQRKAAIEKHLEREGSPLKGLIRLFYQQGSVAIGATIRAKFRQEGFDIDIIVELLERGNLTPAEVLDLLYEAMRGEPGSRYYDCTERQSRCVTVYYADGMHLDLSPAVLLDERDPRRSHIFHSKVEEPRWKDTTILTNCFGFVAHYNARCPIDQVFAEDYGRLVRDADLQMQVMMKDADSAPVPVHSTVVGGKSAVTVALQLLKRNRNIRWLPRNRRMPASVMFSCLALEVAEAGKTIGQNLQVIAEHILGRLIRAKSVGELLHVENPVCLGDVFTDRWPVDQTDQDLLIGDMRLLLRQLAELFDDRRSFKDRSKTLEEMFGETVAKQVVDEFAVEMGQSVRSGSHLLGATGGILATPTLVSAKPAAPRNTFYGAKWSKS

SEQ ID NO: 1129 - protein, 560 aa, Roseovarius sp.
MLAAVAIKLELPPSQHLLMTQRKQAIEKHLERDGNPLKDLIRIFYQQGSVAIGATIKAKHRNVGFDIDIIVELLLNGISPSQGLDLLYEAIRGEPGSRYHDCTTRQTRCVTVHYADGMHIDLSPSVLLEAGDPRRSHIFHSKPEDSRSSDHYVLTNSFAFAEHYNALCPVDQTFSEAYARRVMAADQAFEVIAKDADSVPVPEHSSEVGGKSAVTVGLQLLKRNRDMRWIPRKGKRMPASVMFSCLTVEVAEAGRTIGENLRVTATHILDRLLSAKRMAKLIVVENPRCSGDLFTDRWPENRHDQDLLIEDMKLFLHQLEVVLDESRAFKGRTAALEAMFGETVARDVVKDFAEEIGGLVKSGKHALGASGSILAAPASAKAKPAARTNTFFGSKRPLRFHTGLVATSLSAQDKAMARRWPRFRATLGMGPQSLVWFGDLKGLERSFHISVEYGLPRPCDATMSRFMPVVRVLRPSLVLNFEAIEEAPLPHVYFEGPDIRLSPFCLFDPQAHEWDRTMLIADTTIPWAVRWLACYEIWEATGRWVGGGRHAGEGDQDNAA

SEQ ID NO: 1130 - protein, 578 aa, Alphaproteobacteria bacterium
MNQLPKRPFIPFDSLGERLLAAVAIKLELPPSQHLLMTQRKQAIEKHLEGDGSPLKDLIRIFYQQGSVAIGATIKAKHRNVGFDIDIIVELLLNGIRPSQALDLLYEAIRGEQGSRYHDCTTRQTRCVTVHYADGMHIDLSPSVLLEAGDPRQSCIFHSKPEDPRSSDYYVLMNSFAFAEHYNALCPVDQTFAEAYAKRVMAADQAFEVIAKDADSVPVPEHSSEVGGKSAVTVGLQLLKRNRDIRWIPRKGKRMPASVMFSCLTLEVAEAGRTIGENLRITATHILDRLLFAKSMGKLIVVENPRCSGDLFTDRWPENRHDQDLLIEDMKLFLRQLEVVLDENRSLKDRTAALEAMFGETVARDVLKDFLDETGGLVKSGKHALGTAGGILAAPASARVKPAARTNTFFGSKRPVCFQTGLAAKSLSAQAKAMARRWPQFRATPGVGTQSLVWFGDLKGLERSFHISVEYGLPRPGDTNMSRFMPVVRVLRPSLVLNFDAIEEAPLPHVFFEGPDIRLSPLCLFDPQAREWDRTILIADTTIPWAARWLACYEIWEATGRWVGGGRHASEGDQDNAA

SEQ ID NO: 1131 - protein, 418 aa, Phaeospirillum fulvum
MVAQFPPSPLGPEAPLGEILLAETAIKIELPSSLHRLAVERYDAVRRYIERTGSPLEEKVALFYPQGSMAIRATIKARKREDGYDIDIIAELLLPAYSAPAKVLDLLFEAVNGLPGSQYFGKVVRQTRCVTVLYEDGMHLDITPSLLFDESDPRKSHIFHAKAEEPASAHKRLLMNTYAFIEWFNQRTPIDLPFTEAYAMRALAHDRMIMKAAAPAEPVPDHSTKEGGKSSVVVALQLLKRNRNLRYAKRDGRMPPSVMMACFAGHVAAPGNSISGALEAIVQHMMHELGKAQAAGVLVNVRNPKCLEECFTDRWPENLTAQQIYLGDLKAFSKQLSLLMNEDLPLPKKRNLLIDMFGEGPGTAVIDEYSEKLARGIREGSRLIAPSGRVVVGATVAAATIVKPAPAHTFFGTSWPKK

SEQ ID NO: 1132 - protein, 418 aa, Phaeospirillum fulvum; identical to SEQ ID NO: 1131

SEQ ID NO: 1133 - protein, 421 aa, Rhizobiales bacterium
MNKLLIEPLGPGAPVGEILLAETAVRIELPPSLHQLAVDRYAAVSKHAERPDSPLHDKVTWFYPQGSMAIRSTIKSHRRDDGFDIDIVAELLLHGALTPAQVLDLLFEAINGPPGSMYHGMVERQTRCITVRYADGMHLDITPSELLDAHDPRRSHIFHAKPGEPATHHRYLTMNSWAFCDWFNANTPVDLLFEQAYRKRALAFDQMRVLAEAEVKPVPGHSSTEAGKSASVVALQLLKRNRNMRYASRKGQRLPPSVMMACFSGHTSVPGSSISDALDTIAAVILEALERADRSNTLIDLRNPKCNNDRFTDRWPENAQAQRIYIDDLKLFRRQLAAIMSDQLTLPQKRDLLVVMFGEGPAQSAVNDYAATLGQAVATGSRKIAPSGKVLPIAAAAPAIITPSAAQPRSHTFYGSPWGSW

SEQ ID NO: 1134 - protein, 438 aa, Methylobacterium sp.
MVNDGTLDIPGTGAGDMNNLWSNPPLGPTAPVGEILLAGTAIRIELPPSLHQLAVDRYEAIRKHIERADSPLHDRVRIFYPQGSMAIRATIKARKRVDGFDIDIIAELILPLSLTPAEVLDLLFAAINGPPGSRYHGMVERQTRCVTVYYADGMHLDVTPTVLIDERAPRLSCLFHAKAEEPPASHKRVLMNSFAFCDWFNELTPANVSFAMAYAERAAAFDRIAILADAEVKPVPAHSTIEGGKSTTVVALQLLKRNRNLRHEKRKGMRLPPSVMMAKIAAETSVPGASIAGALESIAGAIQSTLEAAEREERLVDVRNPRCQDERFTDRWPENRQAQRLYIEDLKLLRQQLAALMSDSLMLDQKRDLLVAMFGEGPAQSTVDEYAATIGRSIQSGNRLVSPLGRIVPSVAAAAPFVVKSGPAQPRPHTFFGTRWKG

SEQ ID NO: 1135 - protein, 437 aa, Methyloceanibacter marginalis
MFSWGAPVRDFERQKGKQMLDKMGSPPLGPTAPVGETLLAGVAIAIELPPSQHQLAVERWDAVRGYIERHDSPLAGRVQLFYPQGSMAIRSTIKSRKRADGFDIDVVAELSIGAALPAEVLNLLFQAINGKPGSRYHGMVERQSRCVTVYYSDGMHLDITPSQLVDENDPRRSFIFHAKAEEPASLHRRILMNSYGFVERFNTNASIDLAFAMAYAKRVQDSELIRAEAESKPVPSHSTIEGGKSSTVVALQLLKRNRNIRYEKRPGRIPPSVMMACFALEAAVPGNSIGGALEAISACMLSALEQANKDGVLVDVRNPACMEERFTDRWPENLQAQRICMDDLRHFRSQLAGLFSEQVGLDKKRDLLVAMFGESPAQTVVNEYAARMGRAIQGGERSVAKTGRVITGLGVSTPAIIRPALSQPRSHTFYGTATKNR

SEQ ID NO: 1136 - protein, 405 aa, Cellvibrio sp.
MSTQLPPNNMLEDIFTEIAIRIQLPPSKYRLACERYKTIADYLERDGSPLKDQIARFYPQGSMAIGATISSRGHDQEYDIDIVGELLLPSDTPPKIVLDTLYTAIKGEKGSRYYDMVKRRTRCVTIYYEDGMHLDVTPVILQSSYPERTSDLFHDDPDKPYEEPAKLLMNAWGFCTLFKANTADTTSFADRYSRSVRTFDVLAKAETEEVDPQEDPSRKSSDVVALQLIKRFRNIQYSNREERLPPSILLSKFVNDAANPMDSLVDALIYHTTFIRQQLVGADRTFKLIHEVNPTCEEDCFTDRWPLKISEQRQFISDLNYLLDSLKKLKSSELSIDQIQNLLADLFGEFPVKAAIRATQEMVGNATRSGSTGHKIGGGILLGATTSSLMRGAKANTNMGGDFPA

SEQ ID NO: 1137 - protein, 417 aa, Brevundimonas diminuta
MNAIVRETSNHILDEGDVLLADVAARVQLAPSNYATARDRYHTLANWVDREDSILHGKVGLVYGQGGVATGSVVANRASNDEYDVDAIVGLLVAPTSDPQFVLDALFHSVRGERGSRYYDVTERCTRCVQVSYADGMHVDLTPAVLLAGRRDRESIIFHHRPETPHVPGRHVLANPYGFAEWFKANTPAEPLFGSAFSSYQAMDRALVKAQTEPLPEQVKPHETSRALLSLQLTKRFRNLRYNDRDVRCPPSVVLSKLIAEHKVHRTGFGVALLSHVTYIRDQFRAAHDAGRLFHAANPVCPSDVLTDRWPGTLADQAIWCRDLDHYVTQLTLYVLGTPTLAQRQTILGDLFGEQAARSAVLDFAQRMGRDKEEGRSRYAPGSGRLIVPAAPAILTPTRGRAEPQTSYYGGAAWWRP

SEQ ID NO: 1138 - protein, 428 aa, Brevundimonas diminuta
MIAKSELKGPSVNAIVRETSNHILDEGDVLLADVAARVQLAPSNYATARDRYHTLANWVDREDSILHGKVGLVYGQGGVATGSVVANRASNDEYDVDAIVGLLVAPTSDPQFVLDALFHSVRGERGSRYYDVTERCTRCVQVSYADGMHVDLTPAVLLAGRRDRESIIFHHRPETPHVPGRHVLANPYGFAEWFKANTPAEPLFGSAFSSYQAMDRALVKAQTEPLPEQVKPHETSRALLSLQLTKRFRNLRYNDRDVRCPPSVVLSKLIAEHKVHRTGFGVALLSHVTYIRDQFRAAHDAGRLFHAANPVCPSDVLTDRWPGTLADQAIWCRDLDHYVTQLTLYVLGTPTLAQRQTILGDLFGEQAARSAVLDFAQRMGRDKEEGRSRYAPGSGRLIVPAAPAILTPTRGRAEPQTSYYGGAAWWRP

SEQ ID NO: 1139 - protein, 417 aa, Acidocella aminolytica
MNALTRDSSNHILDEGDVLLADVAVRIQLPPSSYAIAEGRYNTLANWIERDGSPLQGLVGLVYGQGGVATGSVVANRASNDEYDVDAIIGLSIQPNSDPQLVLDTLYDSVRGEPGSRYYNVTTRCTRCVQVAYADSMHVDLTPAVLLQGRPDRESIIFHHRAETPHIAGRHIIANPYGFADWFKANTPPEPLFGQVFGGYIVMDRALEKAQTEPLPDQLKPHETSRALLSLQLTKRFRNLRYNDRDHRCPPSVLLCRLIAEHKVFKSGFAVALLSHVTYIRDEFRAAQQAKQLYYAVNPVCPTDVLTDRWPGSLADQGLWCRDLNHYVDQLTVYVHGSPTLAQRQAILADLFGEQAARSAVRDFADRMGKDKEAGRSRYTPGTGRLVVPAAPALLAPTRGRTEPRTNYFGGDAWWRT

SEQ ID NO: 1140 - protein, 413 aa, Roseovarius sp.
MSLDDPILRKIALFTPQDILLADVAVRIQLSPTEYVTATKHYEVMGEWIDRPGSPLQGMVDGFYAQGGFSTGSTIAGHDDRCDYDLDAMAVIKWDHGVDPEHALATLHHAIAGEEGSRYFDKSERKTRCTQVQYTGMHLDVTPSVLLESMEPKTSFIFHSKPSDPAVPRQRLFANPFGLAEWFNARTRADIVFGSYFERESLKYARATALAKADTTPVPDQLPAYKKSRQVICLQLIKRWRNLVYDRRHPKLRLPPSVLLTYYVGLHTGGERSLLDELTHQVNCIITTIESATALARLVYACNPTCEHDVLTDRWPGSLYDQQVFLDELREFARKLDVLKRGVSLEEMRKILEELFGEKPARDAIAALRQQHVRDNDAGTGLYIPGRGAVPALGSLAAPSSAKAIPFSTPFGD

SEQ ID NO: 1141 - protein, 422 aa, Devosia sp.
MNYSSPTLRQIAAYSPLDVLLADVAVRVQLTPTDYQNAVAHYQAISDWLDRSGSPLEGKVLEFYPQGGFSIGATVARHSTTSDFDIDVIAQIDWSPYIDPEEALATLHDAIASVKGTRYHDKTERKTRCSTINYADMHLDVTPVVRTWGRNEKTSYIFHSKPSDLSEPKKTLLANPFGFAEWFKEMTPPDTAFGEFFERRSLDYNRILLDAKAETAPVPDQMPAYRKSRAVIALQLIKRWRNILYDRSWPNLRLPPSVLLAHYVALNANRTNTLADELIHQVDVLRSIIAGAEAQNRLIYAHNERCREDIFTDRWPGDRLNQRIFLKELDGFAADLRLMRDGGLSLAEMLKVMERLFGEKPARDAYEGFIRQQRGDLFAGKNVHIPKVGAIAALGSLAAPASARSTPYHTDFGDPETGPVRR

SEQ ID NO: 1142 - protein, 415 aa, Unknown
  Description of Unknown: Mesorhizobium sequence
MNYPDPFLSEIAKYSPLDVLLADIAVRIQLTPTDHALAEGHYHAIHEWLERDGSPLQGRIEVFYPQGGFSIGATTARHADDADFDIDVMVQLTVQADNDPEHVLSTLHSAIKGEQGSRYWDKTDRKTRCVTVLYEGMHLDVTPAVRLWGTDDRISQIYHSKKLPAGYEKYTPLANPFGFADWFNSMTPADAAFGHFFEQQSLDYNRMLKSAMQADAEPVPDQAPAYRKSRAVIALQLIKRWRNLAYDARQPTLRLPPSVVIAHSVALNANQTGSLADELRHQVACLIVALEDAERRGGTYHACNPRCDPQDVLTDRWPEDVFTQRIFIGELRTFAADLERLQRGVQLSEMRKTLERMFGEKPANDAVRNFMNRHVADNDANRAVHIISTGSVPALGSLAAPADARPTPKSSPFGD

SEQ ID NO: 1143 - protein, 415 aa, Rhizobium leguminosarum
MNYTDPVLREIAAFSPLDVLLADIAVRIQLTPTDHRLAVGHYHAIHQWLERDGSPLAGLIASFYAQGGFSIGATTARHAEDADFDIDAMVQVTMHHDTDPEDVLSTLHTAIRGEPGSRYYDKTERKSRCVTVKYDGLHLDLTPAVLIPSLEERTSFIFHSKKTATGFDKARLVANPWGFAEWFLRQTPPEAAFGQFFERQSLEYERLRFTKAESDADPVPDQDPAYRKSRAVIALQLMKRWRNLAYDARHATLRLPPSVVLAHSVAVNANRTSSLSEELLHQVVSLVSALEAAERRGMTYKAVNPACDPYDVLTDRWPEDLNSQRILIDELRAFAVDIQRLRSGLSMPEMRKTLEKLFGERPAADSVRKFMDNQVSADRGGVAAHIPSTGTVAAVTSIATPTYARPTPRTSPWGD

SEQ ID NO: 1144 - protein, 415 aa, Rhizobium leguminosarum
MNYTDPVLREIAAFSPLDVLLADIAVRIQLTPTDHRLAVGHYHAIHQWLERDGSPLAGLIASFYAQGGFSIGATTARHAEDADFDIDAMVQVTMHHDTDPEDVLSTLHTAIRGEPGSRYYDKTERKSRCVTVKYDGLHLDLTPAVLIPSLEERTSFIFHSKKTATGFDKARLVANPWGFAEWFLRQTPPEAAFGQFFERQSLEYERLRFTKAESDADPVPDQDPAYRKSRAVIALQLMKRWRNLAYDARHATLRLPPSVVLAHSVAVNANRTSSLSEELLHQVVSLVSALEAAERRGMTYKAVNPACDPYDVLTDRWPEDLNSQRILIDELRAFAVDIQRLRSGLSMPEMRKTLEKLFGERPAADSVRKFMDNQVSADRSGVAAHIPSTGTVAAVTSIATPTYARPTPRTSPWGD

SEQ ID NO: 1145 - protein, 415 aa, Rhizobium leguminosarum
MNYTDPILREIAAFSPLDVLLADIAVRIQLTPTDHRLAVSHYHAIHQWLEREASPLSGLIGSFYAQGGFSIGATTARHAEDADFDIDAMIQVSLHPETDPEHVLSTLHTAIRGEPGSRYYGKTERKSRCVTVKYDGMHLDVTPAVLIPSLEERTSFIFHSKKAATGFDKARLVANPWGFAEWFLRQTPPEAAFGQFFERQSLDYERLRLPKAESEADPVPNQDPAYRKSRAVIALQLIKRWRNLAYDARHGALRLPPSVVLAHSVALNANRTSSLSEELLHQVVCLISALETAERNGASYEVINPACNPYDVLTDRWPEDLHSQRIFTDELRAFAVDLQRLRSGLPLPEMRKTLEKLFGERSAADSVRKFMDRQVNEDRGGIAAHIPSTGKVAAVASIATPSYARPTPRTSPWGD

SEQ ID NO: 1146 - protein, 415 aa, Neorhizobium galegae
MNYADPILREIAAFSPLDVLLADIAVRIQLTPTDHRLAEQHYHSIHEWLEREDSPLTGQIESFYAQGGFSIGATTARHAEDADFDIDAMVQLDCEPDSDPEDVLSTLEKAIKGEPGSRYWTKTERKSRCITVKYDGMHVDVTPAIRWPDQSERTSFIFHSKKLASGFDKSTLVTNPWGFAEWFNERTPAEAAFGQFFEQRSLDYERFLVAKADSEADPVPAQAAAYRKSRAVIALQLIKRWRNLAYDARHSSLRLPPSVVLAHSVAKNANATAMLSDELLHQIESLISVLEAAESKGRVYEAWNPRCEVHDKLTDRWPENVGTQRVFIDELRAFAVDIERLQKGLPLPEMRKTLEKLFGERPAQDSVQKFMDKIVADDRSGRGAHIPATGTVAAVTSIATPAYARPTPQRSPWGD

SEQ ID NO: 1147 - protein, 413 aa, Methylosinus sp.
MNFNPKSLSPLGVSEPIDVLLADIAISVQLSKTEHDKAVARFETMQDWIDRKASPLHGLVRLMYPQGSMAIGATVARVSDQEEYDLDAIVDLDIRADSDPQAVLDTLYEAIRGEEGSRYFDMTIRHTRCVCVSYEDGMHIDLTPAVLVALQTPRTSTIFHSKPEDPQVEDRRLLANPWGLAEWFKEKTPKDEEFARYFEKRSLAFDARKITARAPAELVPDQEPAYQKSRALIALQLIKRWRNVLFSRRDRLRLRRPPSVLLSKLIADNANRTRTLSEEVLHQACCILARLEFGKARERLIYEANPRCPADVLTDRWPASDADQDLMIADLRDFVAKMYVLRSGNLSLAEMGKVLEGLFGERPAKKVLDEYVSRSAPGGNRIVPATGRVIGAASGLVTPAAAKQPAAHNFYGD

SEQ ID NO: 1148 - protein, 422 aa, Enhydrobacter aerosaccus
MNQIVRPTSQGDVIDILLADLAIRVQLSPSNYSLAVYRANVLSDWVDRPASPLHGRVVLTYAQGSMAYNATIARKLRTDEFDIDIIAQIIVRPGMTAKQVLDELYEAVRGELGSRYYKMVERRNRCVTIHYADGMHLDITPAVLADGRSPRTSFIFNHKPEDKSDLTGYALWANPYGFAEWFKVRTPSSDAFARAYMGRVQKWAATLEARADMEAVPEQKPPHEKSMAVIALQLLKRNRNVRFDGRSGRRPPSVMLSKFAAEVAVQTGSLFDQFRRLAQHVHDTIKLAHDRGRLVSVTNPTCAEDVFTDRWPASLNDQAIYIADLKHLLAKLYELHRPDCGLPEMQDILSDLFGETPTLEVVKAYAERLGNVIDTGNAYQERSSGRIDVVRSGLAAPAIAGASSTTSFAAPSHKFFGTEPPA

SEQ ID NO: 1149 - protein, 403 aa, Sphingomonas wittichii
MATNWLQKSTTLPLVDSLLKDIARRIQLSPTSYELAIKRYDVMRQWLERPDSVMREYFTRLYPQGSMAIGGTIASKLKNDEFDIDVIAELNISADSPPGVVLDTLFNAVNGGEGSRYHGKVTRRTRCVTVEYQDMHLDITPAVLLPNRDERTSIIFHAHEDEPATMHRHIIANPWGFADWFEDSTPAVREIMEATLFKAAADPVPDQTDLIEKSMPLIALQLLKRWRNKCYDLRQGRCPPSIVIAYYVAMNARPGRDLFSELREQTWGLLREFGAADQEERLVRVENPRCKTDVLTDRWPGDVATQRVFLNDLRRLDAELQKIVADPTVEMCSEVFSRLFGENVTRVVVEDFSKAYAVRASSGGLFTAAGSGGVALGASGLGSRAAAERAIPIPRHKDFGADV

SEQ ID NO: 1150 - protein, 410 aa, Proteobacteria bacterium
MHNVLSQRVPVPSLVDELLIDIAVRIQLSPTLHALAVERYGAIARWLERDGSPLRGRLRRLYAQGSMAIGAAIRSKENDDLFDIDLIAEIDWPVGTTPMQMLLTLYQAIKGEPGSRYYGEGIVELQTRCVTVHYADMHLDITPMWRNPAWAERGGYIAHAKLSAPVSQHALVAANPWGFAEDFMAKTPAEPWFADVILEKSYGRAIRANAEPVPEHEALYAKAMAVVALQLLKRHIYLIYERKPDGARRPPSVYIAESVARHANQTGALIDELIHQAVQLRAPLAAAAQAGQLIDVRNPALHEDNLTDRWPSGPLAQRIFMSELDHLIASLIAAKNETELPKLRARLAALFGENAVLEALNKYLERAGAETKQGTSRFQPRTATALAGLSTARSPGVQSTPVRGHRFYGD

SEQ ID NO: 1151 - protein, 359 aa, Xanthomonadales bacterium
MYAQGSMAIGATIASCRQNDEFDIDALAELSLSSNTPPRVVLDLLYEAVRGEPGSRYYSMTERCTRCVQVRYGDDMHVDITPTILRPEQPEREGFIFHANSEKPTGDDKRIVANPFGFAEWFKTRTPADAVFALDFAELSREHDRILLRKAADTEPVPEPVEAYKKSMALISLQLIKRWRNIRYDARPGRMPPSVLLAKLVADNANRTSSLYQELLHQAKQLKVFFEVAQIAGRLVHVQNPVCPSDVFSDRWPEDLWAQRVFISDLHDLVTKLEKLANCNALEAKQVCADLFGESPAVDALNKVADRYGSAISGGQAYHDRRTGSIQARASGIIATASAPLSSARTTGHRFYGGRVEDI

SEQ ID NO: 1152 - protein, 428 aa, Sulfitobacter sp.
MREAIGNWVIEELSMPLDHTSPGLDALLIATVLQMELSPRDNSVAEKRYKLIPSHLEREGSPLRLHVDNALVYAQGSRAIGTTIVHGADEDRFDLDAILEFDTPFGWTPRRVLDELFEAFQGFPDVQEIERCTRCIQLRFAFMHLDVTPMDPALKPRPERVGDIYHSPDEGHDERHKVNPYGFAEWFKGQISLPSQMFQAQVRSLRSQLEIKDRLQPGNIVADADIDELPETVDPIQDAPQVLALKLMKRYLNLRYANRNEKRPISVYLSKVAAQIPPNSFGVCAQLEDLAAELDRQMKYALETGLRPEERNPAFPQENFNDRWPQNTRQMEMFRGDLRHLFDELQRARTSEVGQIQKIFDGLFGERISGNAVRTYMDSLSNFPQKSAYELGKGFVATPALLTPGPARAAATSKAPAHNFHAGELRKK

SEQ ID NO: 1153 - protein, 428 aa, Sulfitobacter sp.; identical to SEQ ID NO: 1152

SEQ ID NO: 1154 - protein, 414 aa, Thioclava sp.
MPLDHTSPGLDALLIATVLQMELSPRDNRVAEKRYKLIPSHIEREGSALRLHVDNALVYAQGSRAIGTTIVHGADEDRFDLDAILEFDTPLGWSPRRVLDELFKAFQGFPDVQEIERCTRCIQLRFAFMHLDVTPMDPALKPRAERVGDIYHSPDEGHDERHKVNPYGFAEWFKGQISPPSQMFQAQVRSLRKQLEIKDRLRPGIIVADADIDDLPETVDPIQDAPQVLALKLMKRYLNLRYANRNEKRPISVYLSKVAAQIPPNSFGICAQLEDLAAELDRRMKYALDTGRRPEERNPAFPQENFNDRWPQNTHQMEMFRGDLRHLSTELQRARMSDVAQIQKIFDGLFGERISGNAVRTYMDSLSNTPQKSTFELGKGFVAAPALLSPGAARAAATSKAPAHNFHVAELRKK

SEQ ID NO: 1155 - protein, 428 aa, Thioclava sp.
MREAIGNWVIEELSMPLDHTSPGLDALLIATVLQMELSPRDNRVAEKRYKLIPSHIEREGSALRLHVDNALVYAQGSRAIGTTIVHGADEDRFDLDAILEFDTPLGWSPRRVLDELFKAFQGFPDVQEIERCTRCIQLRFAFMHLDVTPMDPALKPRAERVGDIYHSPDEGHDERHKVNPYGFAEWFKGQISPPSQMFQAQVRSLRKQLEIKDRLRPGIIVADADIDDLPETVDPIQDAPQVLALKLMKRYLNLRYANRNEKRPISVYLSKVAAQIPPNSFGICAQLEDLAAELDRRMKYALDTGRRPEERNPAFPQENFNDRWPQNTHQMEMFRGDLRHLSTELQRARMSDVAQIQKIFDGLFGERISGNAVRTYMDSLSNTPQKSTFELGKGFVAAPALLSPGAARAAATSKAPAHNFHVAELRKK

SEQ ID NO: 1156 - protein, 413 aa, Sediminimonas qiaohouensis
MPLDDTAPQLDALLLGTVLEMELSARDNQVASKRYNLIPEHLQRLSSPMRRYMETALVYPQGSRAIGATIVHGADDDRFDLDAILEFPTPIGWTPRQVLDELHAAFEGFPDVKKVERCTRCIQLQFAFMHLDVTPMDPDRDPRRERVGEIYHSPDEGHDERFRVNPYGFAEDFKARITMPSRSFQDHVGEVRSKLQMKDRLVLGTIMVDADIDELPEPIDPIRDAPQVIALKLMKRYLNLRYANRDEKRPVSVYLSKVAAEVPLSPFGICAQLESYAAELDKRMAAALEKGRRPEERNPALWEENFNDRWPKHDREMKLFRMDLRHLGSELARARTSTLSDTRKIFDNLFGERVSEKAVRAYIDGLSSTAGAAHYEHNKGFVANPGLISPAPKRAAKVSKAPAHHFHPGFRSK

SEQ ID NO: 1157 - protein, 413 aa, Pseudooceanicola nitratireducens
MPLDDTAPQLDALLLGTVLEMELSPRDNQVASKRYNLIPEHLQRPNSPIRRYMETALVYPQGSRAIGATIVHGADDDRFDLDAILEFRTPIGWTPRQVLDELHAAFEGFPDVKKIERCTRCIQLQFAFMHLDVTPMDPDHDPRRERVGEIYHSPDEGPDERFRVNPYGFADDFRTRITMPSRGFQDHVHGVRSKLQMKDRLVPGTIMADTDIDALPEPIDPIRDAPQVIALKLMKRYLNLRYANRDEKRPVSVYLSKVAAEVPLSPFGICAQLENYAAELDRRMAVALESGRRPEERNPALWEENFNDRWPKHDREMKLFRMDLRHLGSELARARTSTLADTRKIFDDLFGERVSEKAVRAYIDGLSSSAGAAHYEHNKGFVANPGLISPAPKQAAKVSKAPAHHFHPGFRGK

SEQ ID NO: 1158 - protein, 413 aa, Pseudooceanicola atlanticus
MPLDDTAPQLDALLLGTVLEMELSPRDNQVASKRYNLIPEHLQRSNSPIRRYMETALVYPQGSRAIGATIVHGADDDRFDLDAILEFRTPAGWSPRRVLDELHAAFEGFPDVKKIERCTRCIQLQFAFMHLDVTPMDPDCDPRVERVGEIYHSPDEGRDERFRVNPYGFGQDFRARITMPSRSFQDHVRDVRSKLQMKDRLVPGNIMADADIDALPEPIDPIRDAPQVIALKLMKRYLNLRYANRDERRPVSVYLSKIAAEVPLSPFGICAQLESYAAELDKRMAAALETGRRPEERNPALWEENFNDRWPKHDREMKLFRMDLRHLVSELARARSSSLTETRKIFDGLFGERVSEKAVRAYIDGLSSTAGVAHYEHNKGFVANPALIAAAPKKATQVSKAPAHHFHPGFRDK

SEQ ID NO: 1159 - protein, 413 aa, Roseovarius atlanticus
MPLDDTAPQLDALLLGTVLEMELSPRDNQVASKRYNLIPEHLQRPNSPIRRYMETALVYPQGSRAIGATIVHGADDDRFDLDAILEFRTPVGWTPRKVLDELHAAFEGFPDVKKIERCTRCIQLQFAFMHLDVTPMDPDREPRRERVGEIYHSSDEGRDERFRVNPYGFAEDFRERITMPSRSFQDHVRDVRSKLQIKDRLVSGTIMADADIDALPEPIDPIRDAPQVIALKLMKRYLNLRYANRDEKRPVSVYLSKIAAEVPLSPFGICAQLESYAAELDRRMAVALENGRRPEERNPALWEENFNDRWPTHDREMKLFRMDLRHLIMELARARSSSLSDTRKIFDDLFGERVSEKAVRAYIDGLSSTAGVAHYEHNKGFVANPALIAAAPKKAAQVSKAPAHHFHPGFRDE

SEQ ID NO: 1160 - protein, 413 aa, Oceaniovalibus guishaninsula
MPLDDTAPGLDALLLGTALELELSDRDHRVSEKRYQLIPAHLQRTASRLSPYIGDALVYAQGSRAIGATIIDGATDDRFDLDAILEFRRPRGWSISDVLDELFAAFKGFPDVQEIERCTRCIQLKFAFMHLDVTPMDPYREPRPLRCGVIYHSPDDGDDLLFPANPYGFADWFRKQIVLPSRAFRDHVMAMRSNMGNKDRLVTNSIMADSDIDALPAPRNPLRDASQVIALKLMKRYLNLRYAKRSLRRPISIYLSKIAALVPPNENGLCAQLESYALDLERRVHTSMVTGVPLDEKNPAPPHEDFNDRWPTSNEDLRVFRDDLRHLVAELARARSSNFTDVRKVFDDLFGERVSEKAVRSYLDSHRGLSIPSAFEPAKGFVAAPALLTPAAAKAAPISKAPAHHFHSGRLPK

SEQ ID NO: 1161 - protein, 413 aa, Maliponia aquimaris
MPLDDTAPGLDALLLGTALELELSDRDHRVSEKRYQLIPEHLQRPASRLRPYMEDALVYAQGSRSIGATIIDGATDDRFDLDAILEFRRPCGWSISDVLDELFTAFQGFPDVQEIERCTRCIQLKFAFMHLDVTPMDPHREPRPLRSGVIYHSPDDGIDLLFPANPYGFADWFRKQVVLPSRAFRDHVMAMRSNMGIKDRLVTNSIMADADIDALPAPRNPLRDAPQVIALKLMKRYLNLRYAKRSLKRPISIYLSKIAALVPPNENGLYAQLESYALDLERRVHTSMVTGVPLDEKNPAPPHEDFNDRWPTSNEDLRVIRDDLRHLVAELARARSSNFTDVRKIFDDLFGERVSEKAVRSYLDSHRGLSIPSAFEPAKGFVVAPALLTPAAAKAAPISKVPAHHFHSGRLPK

SEQ ID NO: 1162 - protein, 412 aa, Maritimibacter alkaliphilus
MPLDATSPGLDALLLATALQLELSDRDLRVADKRYLHIPEHLQRPTSRLRKLMDSARVYPQGSRAIGATIVNGADEDRFDLDAILEFYRPQGWTPRDVLDELFIAFQGFPDVKKIERCTRCIQLQFAFMHLDVTPMDPHPEPRHERVGQIFHSPDRGSDETHDVNPFGFIQWFKANVGPANKVFLDQVAKTRSGLELTGRLEPGTLYADADIDDLPDPIDPIRDTPQVIALKLMKRYLNRRYANRDLKRPVSIYLSKIAALLPAHPYGLCAQLENYAGELNRRMTLAIETGQWPEERNPEFHPENFNDRWPPTVQDMRVFSSDLKHLIHELSRARHSELIDIQKIFDDLFGERITEKAVRSYADGLAGAAPTSSYERGKGFVASPGLLRPADTSQPTTSQARPHHFHPGKLK

SEQ ID NO: 1163 - protein, 413 aa, Rhodobacter sphaeroides
MPLDNTSPALDALLLGTVLELELSDRDRRVLRKRYDLIKPHLERQGSALAPYLNNALVYAQGSRAIGATIVHGADDDRFDLDGILEFPTPMGWGPAKVLDELYTSLEGFPDSTGIQRCTRCIQLKFAFMHLDLTPMDPASAPRVDRVGDIYHSPDKGEDLRVAANPYGFASWFRGRVAQPTVIFRDQVAKARTALGIRDRIALGSMIIKADTQVDDLPDEVDPIRDAPQVIALKLMKRYLNLRYANRKERRPPSVYLSKLAAMVPVNSTGLCSQLEDYANLVEQRMAYCLATGSRPEERNPALWEENFNDRWPKQVCEMQLLQNDMRHLRHELAKARISEAPEIRRIFSRLFGERATVASFKAYTDQLSSTAGKTRVEQGRGYIAAPAILPAAAALKVSAAPAHHFHCGVQDK

SEQ ID NO: 1164 - protein, 361 aa, Labrenzia aggregata
MDDAVVYAQGSRAIGATIVHGADEDRFDLDAVLEFPRPMGWSISRVLDELHAAFEGFPDVQHIERCTRCVQLQFAFMHLDVTPMDPATEPRIERVGAIYHSPDNGNDELFDVNPYGFATWFNGSVSPPTLAFQKQLKDMREQIVQRDRFISTTFRADAEIEDLPVETHPLRDAPQVISLKLMKRFLNLRYAKRKEKRPISVYLSKVAAQVPLNLNGLCSQLEDLAAALAQRMVNAIETGVWPAERNPALLTENFNDRWPTSIQEMVMFRDDLEHLVYELQRARRSEFVEIRNIFRGLFGETVTESAVRSYLSQASNPTGQSRFQPGKGFVAAPALISPARTGAANAPKAVPHSFHPGRLKK

SEQ ID NO: 1165 - protein, 413 aa, Labrenzia aggregata
MPLDKSSPNLDALLLATLLEIELSDRDRRVAKKRYHYIPEHLQRPSSPLRTYMDDAVVYAQGSRAIGATIVHGADEDRFDLDAVLEFPRPMGWSISRVLDELHAAFEGFPDVQHIERCTRCVQLQFAFMHLDVTPMDPATEPRIERVGAIYHSPDNGNDELFDVNPYGFATWFNGSVSPPTLAFQKQLKDMREQIVQRDRFISTTFRADAEIEDLPVETHPLRDAPQVISLKLMKRFLNLRYAKRKEKRPISVYLSKVAAQVPLNLNGLCSQLEDLAAALAQRMVNAIETGVWPAERNPALLTENFNDRWPTSIQEMVMFRDDLEHLVYELQRARRSEFVEIRNIFRGLFGETVTESAVRSYLSQASNPTGQSRFQPGKGFVAAPALISPARTGAANAPKAVPHSFHPGRLKK

SEQ ID NO: 1166 - protein, 428 aa, Ochrobactrum anthropi
MTYHDPFRQTAALDEVLLDVAAFIELSRRDRQVAENRYRVLKRHLERSASTLAPYLVDGVSLIYAQGSIATSTTIVSGTDDDRFDVDAIVEIDVPADWDNDKALDELEKSLQGFPGVTEIVRCTRCVQLRFPFMHMDVTIMDRSGRLAVPRAGQIFHSPDEGVSYRVDSNPWGFTGWFRGRVGIGQAAFAELLGRHREAAARSRLQFIDEQERLVVMKADQVALPPMIPSATDAQEAVALKLLKRNLNISYEKLALSRPPSIYLTKRAGDLGYIPQGLSAQLFALADSTAKIMRGHIAAGTRPAEENPSYPADRINDRWPRQGADGVTDMRVFAEKLEYLAERLEAMAEAPLADIAKAIDELFGERIGREQRAILAARHDRRATVTPILAAPRSGLIQAPAIVVAPERFREVPRHNFHPMRLDHPHDE

SEQ ID NO: 1167 - protein, 432 aa, Xanthobacter autotrophicus
MSAPDPFHKTDALDEVLLDVAALIELSPHDRKVAENRYRRLKTHLERRGSPLAPYLIDGISLIYAQGSIATSTTILSGTDDDRFDVDAIVEIEVPADWDNSRALDLLEESLQGFPGASKIVRCTRCVQLQFPFMHMDVTILDRRQRLAVERAGEIFHSPDTGPASRVPSNPWGFTNWFRGQVGIGQELFAEALRRHRGAVSRNRLRYLDEQERLVVAEAEQHELPPVIPSAIDAQEAVALKLLKRYLNLRYDNLPLSRPPSIYLTKRAGSLGYVPLGLTAQLYALADDTAKVMRQHLADGTRPREENPSYPPDRINDRWPRPDAAGLADMTALAEALEHLASRLEFMATASLTDIANTIDELFGERIGREQRAILMERYDRRDRVESVLSAPRTGGIYAPAVAAAPERLREVPRHNFHPFILRAPTDDADED

SEQ ID NO: 1168 - protein, 432 aa, Acidomonas methanolica
MSVPDPFHKTDALDEVLLDVAALIELSPHDRKVTENRYRRLKTHLERRGSPLAPYLIDGVSLIYAQGSIATSTTILSGTDDDRFDVDAIVEIDVPPDWDNSRALDLLEESLQGFPGVIKIVRCTRCVQLQFPFMHMDVTILDRRQRLAVERAGEIFHSPDTGPALRVPSNPWGFTNWFRGQVGVGQELFAEALRRHRGAVSKNRLRYLDEQERLVVAKAEQHELPPVIPSAIDAQEAVALKLLKRYLNLRYEGLPLSRPPSIYLTKRAGCVGYIPLGLTAQLYALADSTAKIMRQHLADDTRPREENPSYPPDRINDRWPRADAAGLADMKALAEALEHLAARLEFMARASLTDIANMIDELFGERIGREQRAILMERYDRRDRAAPVLSAPCTGGIYAPSIVAAPERLREVPRHNFHPFILDAPTDDPDED

SEQ ID NO: 1169 - protein, 334 aa, Erythrobacter sp.
MATAPAPELDTSTLDEILLDLAVLIELSPHDREIAENRYRRLKEYVERPTSPLRPYLVDGESLIYAQGSVATSTTILSGDNDDRFDVDAIVEIDVPLHWPESEPLDQLFETLKNFPGAVEVVRCTRCVQIRFAFMHMDVTVMDRRQRMGGERPGHIFHSPDTGPTYRVDSNPWGFTGWFRTQVGIGERLFEQRLKAARDAAGLSRLIVVDEAERRILADAEQVPLPPMIPSRIDAQEAVALKLLKRYLNLRYTHSRLKRPPSIWLTKLTGDMGLIQGGLTLQLYALSKFISDSLREHLARRTVPREVNPSYPPDKINDRWPRAWPEAESDMTVL

SEQ ID NO: 1170 - protein, 433 aa, Novosphingobium sp.
MATAPARELDTSTLDEILLDLAVLIELSPHDREIAENRYRRLKEHVERPTSPLRPYLVDGESLIYAQGSVATSTTILSGDNDDRFDVDAIVEIDVPLHWSESEPLDQLFDTLKNFPGAIGVVRCTRCVQVRFAFMHMDVTIMDRRQRLSGQRPGHIFHSPDTGSAYRVDSNPWGFTGWFRTVVGIGEHSFEKQLKAARDAAGVSRLIVLDEAERRILADAEQVPLPPMIPSRIDAQEAVALKLLKRYLNLCYARLRLKRPPSIWLTKLTGDMGLVRGGLTLQLYALSKFISNSLREHLARSTVPREANPSYPPDKINDRWPRPWPEAEADMSTAADHLDLLADAIEEMNSSSQSAILKKIDQLFGERFGQEERRILKDRYDRRNTSGDDLLIKPGSGTIYTPAIAASKPDTQPIPQHRFHPGRLPSKGDAPGG

SEQ ID NO: 1171 - protein, 421 aa, Sneathiella glossodoripedis
MRPFTTNLNLDDLLLDIATTIELSDNDRNVAASRYNMLKEHLERPSSPLKPYLSDNESQIYPQGSMAIGATIVSGTDDDRFDVDAIVEINVPSDWSPSDALDILEESLQGFPNVRKIERCTRCIQLQFAFMHMDVSILDPTQFRTVPRQGDIFHSPDAGTEYRVPSNPYGFSAWVRTSAELPENENKDFREMLDKRRAKYSIDRLSPDQKAAEQEKLPTSIPPRIDSPQIVALKLLKRYLNLKYVNRDLKKPPSVYLTKAAIDCGVTHEGLCAQLERLASYLQSEMEKSIQISDGPDERNPSYQEDRLNDRWPNLQIDRQVLKDDMTDLINNIEETKSASFEEIINLFTRLFGERVSRNAAKALMDRATSATRSTETRYEKKSGTILTSGALLSPGLSKNISTVQNHNFHISTLEYEKTHN

SEQ ID NO: 1172 - protein, 412 aa, Bradyrhizobium embrapense
MLAPNTAPILDDLLLDVVTIIELSDHDREVAENRYRRLKPHLERPISPLREALMNSVSMLYAQGSMAIGATIVSGTDEDRFDVDALVDMTTPADWSDDDALNHLFDALQGFPDVRKIVRCTRCVQMQFAFMHMDVTILDAAKLPRPERVGEIFHSPDTGTGYRVPSNPFGFSNWFRNEVTKPTYEFEKSLQSRRRLYGVDRLQQSPIKAELEQENLPDVIPPRLDSQQVLALKLMKRFLNLRYERRSIRKPPSIYLTKLAVTCGYEPAGLTAQLERLAAKVKVEMDAALAANSGPDERNPSYTPDRLNDRWPSVQADRKTLSDDMDYLINALRIARTAEMKDIAAIFDTLFGERVSRRTMETFAKRLDKSSGRETFRYERGSGTIIPVTASAAAAVASTAVAAPSHRFHVEE

SEQ ID NO: 1173 - protein, 412 aa, Bradyrhizobium sp.
MLAPTTAPFLDDVLLDVVTVIELSDHDRQVAENRYRRLKPHLERPSSPLREALLNSVSLIYPQGSMAIGATIVSGTDDDRFDVDALVDMTTPAHWSDDDVLDKLFEALQGFPDALKIVRRTRCVQMQFAFMHFDVTILDAARLPRAERVGEIFHSPDEGNGYRVPSNPFGFSSWFRGNVTKPTYDFEKALQSRRRSYGVDRLPSSTIKAEVDQEDLPDVIPTRLDAQQVLALKLMKRFLNLRYEKRSIGKPPSIYVTKLAVTAGYNPDGLTSQLERFAAKVKFEMDTALAANNGPDERNPSYEPDCINDRWPTSQADRKTLSGDMDYLINAIKIARAAEIQDIAKVFDDLFGERVSKRSMETYAKRVDQTSGREKFKSERGSGTIIPAVATAAVAVVREAVATPANRFHCEE

SEQ ID NO: 1174 - protein, 383 aa, Sphingomonas sp.
MLHSTPVDRYYDDLLADVAHRIQLTPTAYKEAVAHFDAVSQYLDAHESGFPELSPVIYPQGSFRMGSTISAYDDREDYDIDLILELAIDRFNDPEVVLHRVARALSDGKGRLKFTTCEIKKRCVTLGYANMHLDVTPAVLMPGRDPRVISIFDRHPERPDNALANPEGFARWFDARVRPRAVIAKREVRAAVVPVPEQTPADHKPDRLLAIQLLKRFRDIQCDRGGYDRCPSVLLSRIAADAPQGAGLVTDLRLAASHLAREVSVQDLYVENPACPEDVLSDRWPKAVGSNFRFAQDLGVLVLRLDELVRADGTQVRKLDILKDLFGENAARDGFRQTVDRASAQSRNGQFSASTTGAVGFAGFVPAGSVAAPAHRFFGGPVR

SEQ ID NO: 1175 - protein, 377 aa, Sphingopyxis witflariensis
MIHGDVLRRFYDDLLSDVARKIQISPTAYKEAVRHFDVVAAYIHEELSGLAHLDPVIYPQGSFRMASTISAYDDREDYDIDLLLELHINQFASPEAVLETVAKALRKGQGRLQFQSLEVKKRCVTLWYANMHLDVTPAVLIPGRQARVIGIFDTHPDRPDHALANPEGFAQWFDKMVRPQVVMDTREVQASTVPVPQQKPAELKTTRLLTVQLLKRFRDIRCDARDYDRMPSVLLSKIAAEAPQGHGLLADLRAAASYMAPIVARSLDVPNPACPEDLLSDRWPKKVSSQLMLYEDLNDLVSKLDELLQEGTQVEKKQIIRSLFGENAAAEGYRRAGERASAKSREGTFAIAAGGGVAGTSASAKQVVAPTHRFYGD

SEQ ID NO: 1176 - protein, 453 aa, Thiobacimonas profunda
MNIRTNLEDFARGLEIDPVEAALMDVARALQITRTMHDEADRHFRGLAQHVDRPGSPLEDLVLEIYPSGSFAIHAATRSRLKTDQHDVDAVLEIAIAPGTDPAWVLEQLYKAIKGEKGSKYYDYLIEKNSRCVTVTYPDGVTVDLMPVVRIDGAPERVATLFHYKPETDERYHKEINPKGFADHFNARVEISEAFQKRFDARRYLVDGETYTELATRLSNETSGLALQKADTQPMPVHVPLDQKSPRVVALQLIKRFRDKRYRKHDDHRGKRKPPAVIIAAIAIDAGPANDSLVDEVIAIAKRMRWQIRNAEQNLRLLEVRNPAHYPDLFTDRWPAQRSDQQLWAADLLTLIERFENLKRVGFDPAVIQSTFDDLFGEKAGETALQAYHRAQTVQLEHGALGMTPSGHLKPAAPVSSLAAPALGAGIASAPGLVRPARANTNMGGTVPDDNCW

SEQ ID NO: 1177 - protein, 455 aa, Thiobacimonas profunda
MKMNIRTNLEDFARGLEIDPVEAALMDVARALQITRTMHDEADRHFRGLAQHVDRPGSPLEDLVLEIYPSGSFAIHAATRSRLKTDQHDVDAVLEIAIAPGTDPAWVLEQLYKAIKGEKGSKYYDYLIEKNSRCVTVTYPDGVTVDLMPVVRIDGAPERVATLFHYKPETDERYHKEINPKGFADHFNARVEISEAFQKRFDARRYLVDGETYTELATRLSNETSGLALQKADTQPMPVHVPLDQKSPRVVALQLIKRFRDKRYRKHDDHRGKRKPPAVIIAAIAIDAGPANDSLVDEVIAIAKRMRWQIRNAEQNLRLLEVRNPAHYPDLFTDRWPAQRSDQQLWAADLLTLIERFENLKRVGFDPAVIQSTFDDLFGEKAGETALQAYHRAQTVQLEHGALGMTPSGHLKPAAPVSSLAAPALGAGIASAPGLVRPARANTNMGGTVPDDNCW

SEQ ID NO: 1178 - protein, 455 aa, Pseudooceanicola atlanticus
MKMNIRTNLEDFARSLEIDPVEAALMDVARAIQITRTMHDEADRHFRGLAQHVDRPGSPLEDLVLEIYPSGSFAIHAATRSRLKTDQHDVDAVLEIAIAPGTDPAWVLEQLYKAIKGEKGSKYYDYLIEKNSRCVTVTYPDGVTVDLMPVVRIDGAPERVATLFHHKPETDERYHKEINPKGFADHFNARVEISEAFQKRFDARRYLVDGETYTELATRLSNETSGLALQKADTQPMPVHVPLDQKSPRVVALQLIKRFRDKRYRKHDDHRGKRKPPAVIIAAIAIDASPANDSLVDEVIAIAKRMRWQIRNAEQNLRLLEVRNPAHYPDLFTDRWPAQRSDQQLWAADLLTLIERLENLKRVGFDPAVIQSTFDDLFGEKAGETALQAYHRAQTVQLEHGALGMTPSGHLKPAAPVSSLAAPALGAGIASAPGLVRPARANTNMGGTVPDDNCW

SEQ ID NO: 1179 - protein, 453 aa, Roseovarius mucosus
MNIRTNLEDFARSLEIDPVEAALMDVARAVQITRSMHDEADRHFRGLAQHVDRPGSPLEDLVLEVYPSGSFAIHAATRSRLKTDQHDVDAVLEIAIPPRTDPAWVLEQLYKAIKGENGSTYYDYLIEKNSRCITVTYPDGVTVDLMPVVRIDGTPERVATLFHYKPETDERYQKEVNPKGFANHFNAHVEISETFQKRFDARRYLVDGETYTELATRLSNETSGLALQKADTHPMPGHVPLDQKSPRVVALQLIKRFRDKRYRKHDDHRGKRKPPAAIIAAIAIDGGPGNDSLVDEVIAIAKRMRWQIRNAEQNLRLLEVRNPAHYPDLFTDRWPTQRSDQQLWAADLLTLIERLENLKRVGFDPAVIQSTFDDLFGEKAGETALQAYHRAQTVQLEHGALGMTSSGHLKPAAPVSSLAAPALGAGIASAPGLVRPARANTNMGGNVPDDNCW

SEQ ID NO: 1180 - protein, 453 aa, Jannaschia helgolandensis
MNIRASLEDFARSLEIDPAEAALMDVARAVQITRSMHDEADRHFRGLAQHVDRPGSPLEDLVLEVYPSGSFAIHAATRSRLKTDQHDVDAVLEIAIPPRTDPAWVLEQLYKAIKGEKGSKYYDYLIEKNSRCITVTYPDGVTVDLMPVVRIDGTPERVATLFHYKPETDERYHKEVNPKGFANHFNAHVEISETFQKRFDARRYLVDGETYTELATRLSNETSGLALQKADTQPMPVHVPLDQKSPRVVALQLIKRFRDKRYRKHDDHRGKRKPPAVIIAAIAIDGGPGNDSLVDEVIAIAKRMRWQIRNAEQNLRLLEVRNPAHYPDLFTDRWPTQRSDQQLWAADLLTLIERLENLKRVGFDPAVIQSTFDDLFGEKAGETALQAYHRAQTVQLEHGALGMTSSGHLKPAAPVSSLAAPALGAGIASAPGLVRPARANTNMGGNVPDDNCW

SEQ ID NO: 1181 - protein, 453 aa, Puniceibacterium sp.
MNIRTNLEDFARSLEIDPVEAALMDVARAIQITRSMHDEADRHFRGLAQHVDRPGSPLEDLVLEVYPSGSFAIHAATRSRLKTDQHDVDAVLEIAIPPRTDPAWVLEQLYKAIKGEKGSKYYDYLIEKNSRCITVTYPDGVTVDLMPVVRIDGTPERVATLFHYKPETDERYHKEINPKGFADHFNAHVEISETFQKRFDARRYLVDGETYTELATRLSNETSGLALQKADTQPMPVHVPLDQKSPRVVALQLIKRFRDKRYRKHDDHRGKRKPPAVIIAAIAIDASPATDSLVDEVIAIAKRMRWQIRNAEQNLRLLEVRNPAHYPDLFTDRWPAQRSDQQLWAADLLTLIERLENLKRVGFDPAVIQSTFDDLFGEKAGETALQAYHRAQTVQLEHGALGMTPSGHLKPAAPVSSLAAPALGAGIASAPGLVRPARANTNMGGTVPDDNCW

SEQ ID NO: 1182 - protein, 453 aa, Thioclava sp.
MNIRTNLEDFARSLEIDPVEAALMDVARAIQITRTMHDEADRHFRGLAQHVDRPGSPLEDLVLEIYPSGSFAIHAATRSRLKTDQHDVDAVLEIAIAPGTDPAWVLEQLYKAIRGKEGSRYYDYLIEKNSRCVTVTYPDGVTVDLMPVVRIDGAPERVATLFHYKPEKDERYHKEINPKGFADHFNARVEISEAFQKRFDARRYLVDGETYTELATRLSNETSGLALQKADTQPMPVHVPLDQKSPRVVALQLIKRFRDKRYRKHDDHRGKRKPPAVIIAAIAIDAGPANDSLVDEVIAIAKRMRWQIRNAEQNLRLLEVRNPAHYPDLFTDRWPAQRSDQQLWAADLLTLIERLENLKRVGFDPAVIQSTFDDLFGEKAGETALQAYHRAQTVQLEHGALGMTPSGLLKPAAPLSSLAAPTLGAGIASAPGLVRPARANTNMGGTVRDDNCW

SEQ ID NO: 1183 - protein, 453 aa, Mameliella alba
MNIRTNLEDFARSLEIDPVEAALMDVARAIQITRTMHDEADRHFRGLAQHVDRPGSPLEDLVLEIYPSGSFAIHAATRSRLKTDQHDVDAVLEIAIAPGTDPAWVLEQLYKAIKGEEGSKYYDFLIEKNSRCVTVTYPDGVTVDLMPVVRIDGAPERVATLFHYKPETDERYHKEINPKGFADHFNARVEISEAFQKRFDARRYLVDGETYIELATRLSNETSGLALQKADTQPMPVHVPLDQKSPRVVALQLIKRFRDKRYRKHDDHRGKRKPPAVIIAAIAIDAGPANDSLVDEVIAIAKRMRWQIRNAEQKLRLQEVRNPAHYPDLFTDRWPAQRSDQQLWAADLLTLIERLEKLKRVGFDPTVIQSTFDDLFGEKAGETALQAYHRAQTVQLEHGALGMTPSGHLKPAAPVSSLAAPAMGAGIASAPGLVRPARANTNMGGTVPDDNCW

SEQ ID NO: 1184 - protein, 453 aa, Loktanella cinnabarina
MNIRTSLEDFARSLEVDPVEAALMDVARAIQITRSMHDEADRHFRGLAQHVDRPGSPLEDLVLEIYPSGSFAIHAPTRSRLKADQHDVDAVLEIAIAPGTDPAWVLEQLYKAIKGEKGSKYFDYLIEKNSRCVTVTYPDGVTVDLMPVVRIDGAPERVATLFHYKPETDERYHKEINPKGFADHFNARVEISEAFQKRFDARRYLVEGETYAELATRLLNETSGLALQKADTQPLPVHVPHDQKSPRVVALQLIKRFRDKRYRKHDDHRGKRKPPAVIIAAVAIDAGPANDSLVDEVIAIAKRMRWQIRNAEQSLRLLEVRNPAHYPDLFTDRWPAQRGDQQLWAADLLTLIERLENLKRVGFDPAVIQSTFDDLFGEKAGETALQAYHHAQTIQLEHGALGMTPSGHLKPAAPVSSLAAPALGAGIASAPGLVRPARANTNMGGTVPDDNCW

SEQ ID NO: 1185 - protein, 453 aa, Roseovarius sp.
MNIRTNLEDFARSLEIDPVEAALMDVARAIQISSTMHDEADRHFRGLAQHVDCPGSPLEDLVLEIYPSGSFAIHAATRSRLKTDQHDVDAVLEIAIAPGAEPAWVLEQLYKAIKGEKGSKYYDYLIEKNSRCVTVTYPDGVTVDLMPVVRIDGTPERVATLFHHKPETVERYHKEINPKGFANHFNAHVEISETFQKRFDARRYLVDGETYTELAIRLSNETSGLALQKADTQPMPVHVPLDQKSPRVVALQLIKRFRDKRYRKHDDHRGKRKPPAVIIAAIAIDAGPATVSLVGEVIAIAKRMRWQIRNAEQNLRLLEVRNPAHYPDLFTDRWPAQRSDQQLWAADLLTLIERLENLKRVGFDPAVIQSTFDDLFGEKAGETALQAYHRAQTVQLEHGALGMTPSGQLKPAAPVSSLAAPALGAGITSAPGLVKPARANTNMGGTVPDDNCW

SEQ ID NO: 1186 - protein, 340 aa, Roseovarius sp.
MNIRTNLEDFARSLEIDPVEAALMDVARAIQISSTMHDEADRHFRGLAQHVDCPGSPPEDLVLEIHPSGSFAIHAATRSRLKTDQHDVDAVLEIAIAPGAEPAWVLEQLYKAIKGEKGSKYYDYLIEKNSRCVTVTYPDGVTVDLMPVVRIDGTPERVATLFHHKPETVERYHKEINPKGFANHFNAHVEISETFQKRFDARRYLVDGETYTELAIRLSNETSGLALQKADTQPMPVHVPLDQKSPRVVALQLIKRFRDKRYRKHDDHRGKRKPPAVIIAAIAIDAGPATVSLVGEVIAIAKRMRWQIRNAEQNLRLLEVRNPAHYPDLFTDRWPAQRSD

SEQ ID NO: 1187 - protein, 448 aa, Roseovarius atlanticus
MNIRTNLEDFARSLEIDPVEAALMDIARAIQITRTMHDEADRHFRGLAQHVDRPGSPLEDLVLEIYPSGSFAIHAATRSRLKADQHDVDAVLEIAIARGTDPAWVLEQLYKAIRGEEDSKYYDYLIEKNSRCVTVTYPDGVTVDLMPVVRIDEAPERVATLFHYKPETDERYHKEINPKGFADHFNARVEISEAFQKRFDARRYLVDGETYTELAMRLSNETSGLALQKADTQPMPVHVPLDQKSPRVVALQLIKRFRDKRYRKHDDHRGKRKPPAVIIAAIAIDAGPANDSLVDEVIAIAKRMRWQIRNAEQNLRLLEVRNPAHYPDFFTDRWPAQRSDQQLWAADLLTLIERLENLKRVGFDPVVIQSTFDDLFGEKAGETALQAYHRAQTVQLEHGALGMTPSGHLKPAAPVSSLAAPALGGGIASAPGLVRPARANTNMGGHRT

SEQ ID NO: 1188 - protein, 443 aa, Rhodobacterales bacterium
MNIRTNFEDFARSLHIDPVEAALMDVARAIQITVTMHREAEAHYRGLASHVDRPGSPFEDLVHEIYASGSFAIHAPTRSRLKRDQHDVDAVIELNVLPGSDPEWVLTTLYKAIKGDPGSKYHSYLIEKNSRCVTVTYPDGVTVDLMPVVRLAGTPDRVATLFHHKPETGTCYHKEVNPKGFADHFNGHIETSAVFQDRFDARRFLVDGETYETMAKRMTPDGSMIKADTQPMPVHVPLDQKSPRVVALQLIKRFRDKRFRKHDDHRGKRKPPSIIMAAIALEAGPVQDSLVDEVIALATRMRRRIQDAESCLRLLKVRNPAHTPDIFTDRWPEQRSDQQLWARDLQTLIDRLKTLQRVGFNPAVIQSTFDDLFGEKAGETALQAFHQARMVQLEHGTIGMKPGGEFKPAAPALGAGVAAASGLISPARANTNMGGVVPDDNCW

SEQ ID NO: 1189 - protein, 417 aa, Rhizobium rubi
MGILINLDLAATIDPLDGILIDVARRIQVPKTKHEEAADHFMGLCAHVDRKRSPLEGKVLECYPSGSFSIAAAIYSHVRSMQHDVDVVIEVDYPIGTDPAWMLDQLFKAVKGEPGSRYYEFKVIRNSRCVTVTYPDGVTVDLMPVARILGGPERSGVLFHHNPKLDEKYAKEVNPKAFTLHFNARIKSSDVFASRYRTRRLLSDGMLQERAETQPMPDHVPIEEKSPRLVAIQLLKRFRDIQFRDREGRWPPSVIIAAMALDAGQMSDSLTDELIAIATHMQGEIEQAERNLMTLVIVNPAHPADIFSDRWPENRTAQRLWRDDLVRLVRNLRLLRGREWDPRQLKNILKELFGETPAERAFEDHYRGQGTLAKQNLLGIAKSGAVRSALAAPALAGLTVPLRANTDMGGFLDDPVD

SEQ ID NO: 1190 - protein, 417 aa, Agrobacterium rubi; identical to SEQ ID NO: 1189

SEQ ID NO: 1191 - protein, 440 aa, Sinorhizobium medicae
MIRRGDSRNEVERERSIEGDNGMGILINLDLAATIDPLDGILIDIARRIQVPKTKHEDAADHFLGLCAHVDRQGSPLEGKVIECYPSGSFSIAAAIYSRVKSMQHDVDVVVEVDFPIGTDPEWMLDKLYEAVKGDAGSRYYDFKVARNSRCVTVTYPDGVTVDLMPVARILGGPERSGVLFHHNAKRAEKYRKEVNPKAFTLHFNARIKSSDVFASRYRTRRLLSDGLLQERAETQPMPEHVPIEEKSPRLVAIQLLKRFRDIQFRGRDGRCPPSVVIAAMALDAGQMSDSLCDELIAIATHMQREIEEAERDLSKLVVANPAHPVDIFTDRWPEDRSAQRLWRDDLIRLVRHLRTLRGRDWDPRQLKNVLQELFGETPAERAFEDHYRGQSALAKQNMLGITRSGAVRSAIATPAISSGLIVPARANTDMGGYIEDPVD

SEQ ID NO: 1192 - protein, 455 aa, Rhizobium sp.
MAGKDRKQAGNEAWGDDKRGDSRNEVERERSIEGDNGMGILINLDLAATIDPLDGILIDIARRIQVPKTKHEDAADHFLGLCAHVDRQGSPLEGKVLESYPSGSFSIAAAIYSRVKSMQHDVDVVVEVDFPIGTDPEWMLDKLYEAVKGDPGSRYYDFKAVRNSRCVTVTYPDGVTVDLMPVARVPGGPERSGVLFHHNAKRAEKYRKEVNPKAFTLHFNARIKSSDVFASRYRTRRLLSDGLLQERAETQPMPEHVPIEEKSPRLVAIQLLKRFRDIQFRGRDGRCPPSVVIAAMALEAGQMSDSLCDELIAIATHMQREIEEAERDLRKLVVENPAHQADIFTDRWPEDRSAQRLWRDDLMRLVRHLRTLRGREWDPQQLKNILQELFGETPAERAFEDHYRGQRALAKQNMLGITRSGAVKSAIATPAISSGLIVPARANTDMGGYIEDPVD

SEQ ID NO: 1193 - protein, 418 aa, Sinorhizobium fredii
MGILINLDLAATIDPLDGILIDIARRIQVPKTKHVEAADHFMGLCAHVDRKGSPLEGKVLESYPSGSFSIAAAIYSRVKSMQHDVDVVVEVDFPIGTDPEWMLDKLYEAVKGDPGSRYYDFKVVRNSRCVTVTYPDGVTVDLMPVARIPSGPERSGMLFHHNAKRDEKYRKEVNPKAFTLHFNARIQASDVFASRYRTRRLLADGLLQERAETQPMPDHVPIEEKSPRLVAIQLLKRFRDIQFRSREGRCPPSVVIAAMALDAGQMSDSLCEELIAIATHMHRQIEEAERNLRKLVVANPAHPADIFTDRWPEDRGAQRLWRDDLIRLVRHLRTLLGREWDPQQLKNILRELFGETPADRAFEDHYRGQATLSRQNMLGITRSGAVKSALATPAISSGLIIPARANTDMGGYIEDPVD

SEQ ID NO: 1194 - protein, 424 aa, Sinorhizobium fredii
MEGDNGMGILINLDLAATIDPLDGILIDIARRIQVPKTKHVEAADHFMGLCAHVDRKGSPLEGKVLESYPSGSFSIAAAIYSRVKSMQHDVDVVVEVDFPIGTDPEWMLDKLYEAVKGDPGSRYYDFKVVRNSRCVTVTYPDGVTVDLMPVARIPSGPERSGMLFHHNAKRDEKYRKEVNPKAFTLHFNARIQASDVFASRYRTRRLLADGLLQERAETQPMPDHVPIEEKSPRLVAIQLLKRFRDIQFRSREGRCPPSVVIAAMALDAGQMSDSLCEELIAIATHMHRQIEEAERNLRKLVVANPAHPADIFTDRWPEDRGAQRLWRDDLIRLVRHLRTLLGREWDPQQLKNILRELFGETPADRAFEDHYRGQATLSRQNMLGITRSGAVKSALATPAISSGLIIPARANTDMGGYIEDPVD

SEQ ID NO: 1195 - protein, 417 aa, Rhizobium phaseoli
MGILISLDLAATIDPLDGILIDIARRIQVPKTKHEEAADHFLGLCAHVDRTGSPLEGKILESYPSGSFSIAAAIYSRVRTMQHDVDVVVEVDFPIGTDPEWMLDKLFEAVKGDPGSRYYDFKVERNSRCVTVTYPDGVTVDLMPVARIPGGPERSGVLFHHNAKRAEKYRKEVNPKAFTLHFNARIKSSDVFASRYRTRRLLADGLLQERAETQPMPDHVPIEEKSPRLVAIQLLKRFRDVQFRRRDARCPPSVVIAAMALDAGQMSDSLCDELITIATHMQREIETAERELRKLVVANPAHQADIFTDRWPEDRSAQVLWRDDLVRLVRHLRTLRGPWDPEQLKSILRELFGETPADRAFEDHYRGQGTLSKQNMLGITKSGAVKSALAAPALSTGLIVPARANTDMGGFIEDPID

SEQ ID NO: 1196 - protein, 422 aa, Mesorhizobium sp.
MGIIFNIEDAMHIARADGLLMDVARRAQLPLSKHIDAIEHFDGLSAHVDRAESPLGGKVVMIYPSGSFSIHCAIYSKIRSVQHDVDVVVELDLPGNTDPAWMLDKLYDAIKGEPGSKYHSYNIEKNSRCVTVTYPDGVTVDLMPVTRIPNGPERSALLFHHKPESGEKYRKEVNPKGFTNYFNANISSSEAFAKQYWQRKMLVEGMLVEKAETQPMPDHVPIEEKSPRVLAIQLIKRFRDVQYRQEGRRSRRLKKPPSVVIAAMALDVGPMSDSLATEVKAVARHFARAIRDADAAGGRFQVMNPAHPADEFTDRWPEDRETQRLWQRDLEHLARAIDTIGNSIFDPAEANELLEDLFGEALAEYAIEKHFAGQNEIAKRNKLGIGPSGSIRTTAAAVAAPALILPAHASTNMAGVLDDIDD

SEQ ID NO: 1197 - protein, 448 aa, Sphingobium fuliginis
MTPIAVRYILRSCKVKSADLGLCHSHQIGGRMTIFDPTRPRPERLPSPSFADAMLMDVARRVQLSPTKHDEAQQHFEALCSYVDRPGSPLEDKVIACYPGGSFATGTAIASSVSKDQHDVDVVMELDVPTNSNPETILNLLFEAINAEPGSRYHGRVVRNSRCVTVEYDDGVRVDLMPIARLDAAPEKAGHLFHFKRQPPESYHKPVNPWGFADHFNAQTAYDPVFAAIFESRSLADGRTVAKADVDPLPDRVPLSEKAARVVALQLIKRNRDVRYRNRSKRKPPSVVLAALALEVPPTGAGLLEEVVSISRYIARRLQEQSAHNLCIDVRNPAYVPDVFTDRWPTALPDQNEYVRDLEYLVRQLVRLRTENISLTETNTILDDLFGETAAKYAIKEHMDRSRAAMEKGAMRFGPTGRVHAGVTAAAVATYCTPARASTNMGGEWFLD

SEQ ID NO: 1198 - protein, 410 aa, Altererythrobacter atlanticus
MTYQTPILPPSTADALLMDVARRIQLSPTKHDEAEQHYQALCAHVDRPDSPLHGKVIACYPGGSFATGTAIASRVSKDQHDVDVVIELDISPYSEPSGVLATLFVAINGDEGSRYHGRVTLNSRCVTVTYEDGTRVDLMPIARLAHTPLKAGHLFHWRRESVETYHKPVNPWGFADHFNREVAFDPVFATMFDARRQIADGVVAKAETDPLPGRVPLSEKSSRVVALQLLKRNRDVRYRSREGRKPPSVVLAAMALDIGPARSGLVDEVINIASHISGQLQDHIRRFGTLVVRNPSFPEDIFTDRWPGDVAAQNVYMRDLDHLQRQLGRLRSDNTNLTEMRTILDDLFGETAAGFAVERFLDASRREAERGTMRFGTTGRILTGAPAILGAATSTTARASTNMGGGCIPD

SEQ ID NO: 1199 - protein, 415 aa, Bradyrhizobium japonicum
MNVRYPGPWPTVAEYDALLMDIARRIQLTKTKHEIAETNFRALCQHVDREDGPLANKVIECYPSGSFATGTAVASRVAKNQHDVDVVIELDVPPNSTPRDILGLLFKAINGEPGSRYYGKVTQNSRCVTVEYGDGTTVDLMPIARIMGPERAGNLFHYKRETGESRHKLVNPWGFAKHFNDHVDFDPVFHDLFEGRRLLVEGKIVEKAETQPMPDHVPVEEKSARVVALQLLKRNRDIAWRSPSRTGRKPPSVALAAMALDAGPVHPSLLDEVIAIATYIRTRLQETNGSRGTVCVVNPSYPPDEFTDRWPENKAAQDLYDGDLRRLIVELYRLRNEDLSLAEQLELLKRLFGETAATYAIESKLEAGRREMDANRMHLTSTGKVVGVAAPAVIGSASSTAARAATREGGGELSE

SEQ ID NO: 1200 - protein, 414 aa, Bradyrhizobium sp.
MNVAYPGPWPLLTDYDALLMDVARRVQLTRTKHEQAETNFRALCQHVDREGSPLEHKVIECYPGGSFATGTAIASRVAEDQHDVDVVIELDVARDSAPSEILALLFDAINGDEGSRYHGKVRQNSRCVTVEYGDGTTVDLMPIARIGGPERAGQLFHYKGDTAESYHKQVNPWGFAKHFNDQIEYDPAFHDLFKGRRLLVEGEIVEKAETQPMPQHVPIEEKSARVVALQLLKRNRDIVWRSPSRKGRKPPSVALAAMALDAGAVQPSLLDEVVAIASHIRARLKETDGPRGTLRVFNPAYKVDEFTDRWPENRTAQDLYDGDLRRLIVELYRLRNESLSLAQQLELLKRLFGETAASYAIESNLEARRREMDANRMHLSKTGKVAGMAAPAVAGATSTAAKAATREGGGELSE

SEQ ID NO: 1201 - protein, 414 aa, Bradyrhizobium sp.
MNVLHPGPWPTIAEYDALLMDIARRIQLTRTKHETAERNFGALCNHVDRKGSPLEDCVIECYPSGSFATGTAIASRVKKAQHDVDVVMELKVDPTTSPQRILQLLFEAINGEPGSSYHGMVTLNSRCVTVKYADGTTVDLMPIARINGPDRAGHLFHHKKETGESYHKKVNPWGFATHFNNHVDFDPAFHDLFEGRRLLVEGKIVEKADTQPMPDHVPIEEKSARVVALQLIKRARDIAYRSSSRNGLRKPPSVVLAAMALGAGPVKPSLLDEVIGIATHIRLRLTETNGVRGTVQVLNPAYPLDEFTDRWPENKTAQDLLDGDLRRLIVNLHKLRNDNLSLEEKRDLLKQLFGETAATYAIESSLDASRREMEANKLRMGNNGKVFSAAAPAVLATSTAARSATREGGGALSE

SEQ ID NO: 1202 - protein, 404 aa, Hyphomonas oceanitis
MPLDFLWLNDSKEVAERLLLDTASRIQLTPTQHEEAVRNYDALSEWVDEGDHELSGLVTDIYPSGSFGIGAAILGQVRKDQHDVDVVLELDLPLNSDPEFVLTSLYEAVRREPGTRYYDMTTLQSRCVTVTYKDGRTVDLMPAVRIQGRPERVVQIFHWNAEKRESYHKEVNPKGFATHFKDSLVYSKTFEMRFSDRMTVLAKAETQPMPNFEPLEAKAPRQVALQLIKRKRNLVWRSSERKGMFRQPPSVVKAALAIPQGCASDYLIDETIDLAETIRNTIVAADKQGTVLEVRNPAWHPDVFTDRWPESREAQRMFAADLHNLTLDLRRLRDHDLAPAEKLRILKEHFGETPANYAFNTYGKAQELAKAQGRTQVSSLGKIGIVSAGAASLPKRTNFGGDPV

SEQ ID NO: 1203 - protein, 430 aa, Hyphomonas oceanitis
MAGWVKENQDRKKQPTYIIEIRRTKYMPLDFLWLNDSKEVAERLLLDTASRIQLTPTQHEEAVRNYDALSEWVDEGDHELSGLVTDIYPSGSFGIGAAILGQVRKDQHDVDVVLELDLPLNSDPEFVLTSLYEAVRREPGTRYYDMTTLQSRCVTVTYKDGRTVDLMPAVRIQGRPERVVQIFHWNAEKRESYHKEVNPKGFATHFKDSLVYSKTFEMRFSDRMTVLAKAETQPMPNFEPLEAKAPRQVALQLIKRKRNLVWRSSERKGMFRQPPSVVKAALAIPQGCASDYLIDETIDLAETIRNTIVAADKQGTVLEVRNPAWHPDVFTDRWPESREAQRMFAADLHNLTLDLRRLRDHDLAPAEKLRILKEHFGETPANYAFNTYGKAQELAKAQGRTQVSSLGKIGIVSAGAASLPKRTNFGGDPV

SEQ ID NO: 1204 - protein, 403 aa, Robiginitomaculum sp.
MGFENFDFSTYASIADQLLMDVAFKIQLTPSDYKEATQNYEAVSSYVDGSGSLLEGKVIIIYPSGSFGIGAPILGKIKAHKHDIDVVIELDLPENSDPEWVLTILERSLDRGPGSRYHKMVKRNSRCITITYADGHTLDVMPVVRRANILTERVSQLFHWKKETRESYHKDVNPKGFTKHFKSRVGTNDIFMERFGSHRLALLAKAETEDFPEFESLDRKSPRIVALQLIKRARDVSYRSNKSSRKRKPPSVIKAGLALEAGPILSPSLSQELLNVATHIRDTILQCERTGVLLDVRNVSYRPDCFTDRWPSNNSDQSTFRKDLDSLIMDINVLRSTTDVEKQNEILVRLFGETAATHAIKTYSKRLGEARAAGRTIVGVGGSVSVAPNVYPSVPKRTNFGSQ

SEQ ID NO: 1205 - protein, 413 aa, Hirschia baltica
MSSNTNSEALSEQDQLLIDVAQQLQLTNTEYKNNVFRYEALANFIDADGSVLKDQVLGIYPSGSMAIGAAIRGQIKRDVPDVDVVLVLDIAADSSPIDVLTLVKEAITRGGDDDTYRNCKVEVNSRCVTVEYADGSTVDLMPVVVIKDDPTIPIWQLFHYKNDVTPIESYYKKISPIGFKNAVKKAIEEEGGSILFERVSRAMQDRYTVLAEKAEVEEFPKNDDFEEKSPRIIVLQLLKRFRDLRFRRADRNGKRKPPSIVLAALAIEAPFGRCHSFTDELRSVTESIVTELSSQINQPIEVRNPSYWEDVFTDRWPETDSYDQELWCNDLKKLLAELNKLKSERRPLEQIKILESLFGEEIAKTAVAAFAQRTEQARKSGKLAVAASGQAVISSTVSRFSSASSGRFGGDTH

SEQ ID NO: 1206 - protein, 371 aa, Unknown
  Description of Unknown: uncultured Butyricicoccus sp. sequence
MKQTNYSESILLGICEKLQLSPSLYRQATERYETIAHTIQSDPVFKEIELKMYPQGSFRLKTTVKPLSEEEYDIDFVVELPTNSTMSPRQLYDHIVRILRHDGTHNDMVELKKRCVRVNYANDFHMDIMPGMSVNPVTHEIIVPDRELAAWYHHSNPIGFAEWFEQQAKTQIINERSHLGKFCCEVEKVTEQEVASRLEPLRRTVQLVKRYRDIYCEKYNTEPVRSIIICTLMGQITSYAGDTLQVLDRFCTYVTALIRANGDQPFEVRNPVVNEKLTEKWEEGNNYRDFVDMMKALTADVTLLKQKTLNSEINPILKKMFGEVVTDYAITKFAKATTAARVNGTLSMDRNGTLNTNGLGAQVKKNTFYGN

SEQ ID NO: 1207 - protein, 372 aa, Coprococcus comes
MNKYVDKILLTICSKLQLPEYLYKLADERYHTIATIIESDSVFKNVELNMYAHGSFRLKTTVKPLNGEDYDLDFVVEISAETAGKMTPVELYDHIFRILSTDGIHNKMIEKKSRCIRINYANDFHMDIMPGKQINVISREIIVPDKELKNWYHHSNPIRYAEWFEEQAKTHIISEIQQMRKVQCSAEPIEEREIVTRLEPLRRAVQLIKRYRDIYCDEHETVPVRSIIICTLMGHITSTYSDTLQIIQDFCSYVNQCILESGQTPFVVKNPVVDETLSEKWEEDIQNYRDFVSMIDSLKQDVAKLRTLTINSDMNALMKKMFGETVTNEAIMEYAKKMNENRSEGVLSVDSAGRLNTKGVGASVRKNTFYGE

SEQ ID NO: 1208 - protein, 294 aa, Lactobacillus versmoldensis
MNRISLSKTSEKIIQEEYQSISNLLNNNLNDEYEVFIFPQGSYNLGTTIRPLSGKGEFDVDIVAEITNKNVSNIKAISLKCLIGNVFKKNIRYGNERMDEKNRAWRINYENNSHVDVVPAIVSENRNSDILITNKIKGKYNYLYSSPMKYKDWFISMSNEITNKDYLENNFRNTVKNLPKYMKGTILQRAVRLIKYHRNKYFQDVIDEKIKPISIIMTTLAAESYGDETDLSSAVTSIVRKMRTNIVSRNGKTIISNPVDLNENFADKWEEYPERKKVFLSGLVNLKKIFQRIH

SEQ ID NO: 1209 - protein, 366 aa, Lactobacillus rhamnosus
MKDNTVILQRLCQQISLSETAKSTVVREYNSLGELLTESDLLDSKVNVKPQGSYNLGTAIQPLRGSEDDFDIDLVAILDSSDDAEHTKKDVGKVLESSPRYSAKLAKEKKRAWTIEYNNSHVDIVPAIRSQVADIQITNKVTDNRYEYRQSSPFAFKDWFLQQGRGIYQALDEKGYRARSEVEKPADYQKYTILQQIVQLLKFHRNKMFDGQDPKLKPISMILTILAGKAYSGQDDLSTALAEVTSGLRQQIEIGTDGTPHIFNPVNSDEDFADKWIEHPERMRAFYNWLELVEKDLGISSNRERIAWSKTLTGIFGADRVRSAFETLGELRSISQKQSEVPIELIGQTGGKSRDEKVRPHTFWGD

SEQ ID NO: 1210 - protein, 366 aa, Lactobacillus rhamnosus
MKDNTVILQRLCQQISLSETAKSTVVREYNSLGELLTESDLLDSKVNVKPQGSYNLGTAIQPLRGSEDDFDIDLVAILDSSDDAEHTKKDVGKVLESSPRYSAKLAKEKKRAWTIEYNNSHVDIVPAIRSQVADIQITNKVTDNRYEYRQSSPFAFKDWFLQQGRGIYQALDEKGYRARSEVEKPADYQKYTILQQIVQLLKFHRNKMFDGRDPKLKPISMILTILAGKAYSGQDDLSTALAEVTSGLRQQIEIGTDGTPHIFNPVNSDEDFADKWIEHPERMRAFYNWLELVEKDLGISSNRERIAWSKTLTGIFGADRVRSAFETLGELRSISQKQSEVPIELIGQTGGKSRDEKVRPHTFWGD

SEQ ID NO: 1211 - protein, 366 aa, Unknown
  Description of Unknown: Lactobacillus sequence
MKDNTVILQRLCQQISLSETAKSTVVREYNSLGELLTESDLLDSKVNVKPQGSYNLGTAIQPLRGSEDDFDIDLVAILDSSDDAEHTKKDVGKVLESSPRYSAKLAKEKKRAWTIEYNNSHVDIVPAIRSQVADIQITNKVTDNRYEYRQSSPFAFKDWFLQQGRGIYQALDEKEYRARSEVEKPADYQKYTILQQIVQLLKFHRNKMFDGRDPKLKPISMILTILAGKAYSGQDDLSTALAEVTSGLRQQIEIGTDGTPHIFNPVNSDEDFADKWIEHPERMRAFYNWLELVEKDLGISSNRERIAWSKTLTGIFGADRVRSAFETLGELRSISQKQSEVPIELIGQTGGKSRDEKVRPHTFWGD

SEQ ID NO: 1212 - protein, 366 aa, Lactobacillus casei
MEDNTIILQRLCQQISLSETAKATVVREYNSLGKLLSDSELLDSEVTVKPQGSYNLGTAIQPLRGSEDDFDIDLVAILNFSSNAEHTKKSVGKVLKSSQLYSAKLSEEKKRAWTIEYDNSHVDIVPAIESQVADIAITNKVGDSRYEYRQSSPFAFKDWFIQRGQGIYQALDKNGYDIRSEVETPADYQEYTILQQVVKLLKYHRNKMFDGQDPELKPISMIITILAGKAYFGQDDLDKALLEVTRGLRQQIEVGLAGTPHILNPINPNEDFADKWIEHPERKRAFYDWLESVERDFGTSSNRERIAWSQTLARIYGEDRVRSAFETLGELRSTSQKQSKVPIEPIGQIGGKVYDKKTRAHTFWGD

SEQ ID NO: 1213 - protein, 376 aa, Lactobacillus mucosae
MKEYSYILNKICSFIVLSDSAKEAIKTHYLAISKLLANSNLIDCPTNIKPQGSYNLGTAIRPLNGSDDYDIDLVVILMYKYQPQYVKESIGKIIEESKTYHNKLLPEKRRAWTIEYANSHVDVVPAIAGKFSDDNSDILITDKSDENIYTFLESSPFKFKDWFEKKGMGIYQENTIEKRSTFSKIEQPKEYNQYTILQKVVQLLKFHRNKMFEDRDQEIKPISMVITILAGKAYRGQKDLSIALLEVVNNLRSQMDYDLYGTPHIFNPINHEEDFADKWNDHPERKKAFFEWLDTLEKDFGTIEKQSRLEFSNTLSQIFGTDRIKNAYNALGRINQQLQKEGQVSINHDGVFEGGTNDKTARPHTFWGDCKKKPSN

SEQ ID NO: 1214 - protein, 369 aa, Lactobacillus reuteri
MLKEQSYVLQELCKKISLSDTAKKAVKQHYKAIGSLVTESDLIEGDVNVKPQGSYNLGTAIRPLNGSEDDYDIDLVAIFENKNDPQYIKETIGEVLKQSKRYSEKLLPEKKRAWTIDYEGSHVDVVPVLDGIFSDEDTDIMITNKVSNNQYEFRNSSPFKFKDWFIERGKNIYQTVIEKRSIFGDVEEPEDYQEYTILQQVVQLLKYHRNKMFENRDNEVKPISMIITILAGKAYAGQNDLSTALAEVVKELRNQIDYDELGIPHIFNPINKDEDFTDKWEEHPERETAFFEWLDAVEKEFSAVNDAPRLELAKSLTLTFGDSVAEVYNSLGNRSQKLQKSGNVYLSKNGVFEEDDNGKKAKPHTFWGE

SEQ ID NO: 1215 - protein, 373 aa, Lactobacillus paracasei
MLEKEELVSLYDDLAKKICLSDTACKQVETHFDTIKDLINSNLIEYFGEQAEIKTFPQGSWSLGTTIKPLRGSDDDYDVDLVVALSNVNITASELKANIGAILKSTKEYVGKVEEKGRAWCINYANSHIDIVPSINNLDGSICITDKESNGSYTYLKSYPKDLVEWFKNKSNDNSSEYDSDLKTKPIHSYQRFTKLQKVVRILKQHRNSTCKDINEKERPISILITIIAAELYDEHDKTLLDALTTVTSKLETYLSNHRNTDGKYVIVNPVNKKEIFTDKWTDHPERQAVFLKWADQVYYDLILQAQTLDRVEYATKMEPIFGQYVSDFYEQLGKKHEDAQAMGCMRYSKADGVSFENNDKGEKFVRNTFWGN

SEQ ID NO: 1216 - protein, 365 aa, Lactobacillus plantarum
MPESQELSLFYDQLAKEIQLSQTACSTAEREFNSLTSLFDNEYDNVKMFPQGSYSLGTTIRPLNADRDDFDVDFVIAFMDDDIGPSDVKENIGDVLSNSNRYKDKFSEKGRAWTVNYNNSHIDIVPAKINSAEDLYITDKNDQGYFFIKSNPKAFKKWFQNQGIIDKTVHEKITESIEPIHSYQRRTILQKTVQILKYHRNKFFQTRPDKEKPISMLITTIAATLYNGESDLFQSVSNISAAIPQFMESSKGLDGNYHIYNPIETSEEFTDKWIDHPERKEAFIKWGKAVYQDLVKASLCESRIQFSQRLGDVLGQPVASAYEHIGQINQSDQKLGNMSFDKESGFVIGSKEHTSIPQNNFFGEN

SEQ ID NO: 1217 - protein, 365 aa, Unknown
  Description of Unknown: Lactobacillus sequence
MPESQELSLFYDQLVKEIQLSQTACSTAEREFNSLTSLFDDEYDNVKMFPQGSYSLGTTIRPLNADRDDFDVDFVIAFVDDDIGPSDVKENIGDVLSNSNRYKDKFSEKGRAWTVNYNNSHIDIVPAKINSAEDLYITDKNDQGYFFIKSNPKAFKKWFQNQGIIDKTVHEKITESIEPIHSYQRRTILQKTVQILKYHRNKFFQTRPEKEKPISMLITTIAATLYNGESDLFQSVSNISAAIPQFMESSKGLDGNYHIYNPIETSEEFTDKWIDHPERKEAFIKWGNAVYQDLVKASLCESRIQFSQRLGDVLGQPVVSAYEHIGQRNQSDQKLGNMSFDKESGFVIGSKEHTSIPQNNFFGEN

SEQ ID NO: 1218 - protein, 168 aa, Lactobacillus equigenerosi
MNDTNLVLQILVNNISLSDTAKERIAKEYEALAKLFDASDLDVDIKYQGSYALGTSIRPLNHDDDYDIDLVCILNNGLNNKPEEIKHSVGDVLLNSERYKDKVEENRRSWTVEYFNSHVDVLPSILDPDNNSDLLITDNKNGYNLINSSPFKFRDWFIRMSNYVPKKC

SEQ ID NO: 1219 - protein, 352 aa, Lactobacillus equigenerosi
MNDTNLVLQILVNNISLSDTAKERIAKEYEALAKLFDASDLDVDIKYQGSYALGTSIRPLNHDDDYDIDLVCILNNGLNNKPEEIKHSVGDVLLNSERYKDKVEENRRSWTVEYFNSHVDVLPSILDPDNNSDLLITDNKNGYNLINSSPFKFRDWFIRMSNYVPKSVDYANSIEEPVDQDDNDDKLKSIVKLLKFHRDKYFDKKDSELKPISMLLTIFAAQLYDNSLDLEHALQKVVCGIRGFLEENNNKVINPVDSKENFTDKWEEYPERKEAFFDWLSDIEKSYSCINLSKLKNVFGESRVQNAVKQLGEIRGKQRDNNLFGLNKDTGLELRDNKYSNSGYKRHTFYGD

SEQ ID NO: 1220 - protein, 371 aa, Leuconostoc carnosum
MNKPEANVILNLLVADAQLSQTARDEIEKHYNTLTNYLSNNSTFDSTTYVQGSVNLGTSIKPITGGTDDYDVDFAVVIPHNSDDNAEVIKTEIGSVLHNSDRYNERLEEKKRAWRINYSQSHVDIVPAKAETSEAEGIIKVTKKNDTNYTFILSAPEPFAKWFHSKETMDTDTLYSKSIAHREVNKIKDFPKQTRGSILSRTVQLLKLHRDYMFKDNDQDLKPISMIITILAAKSYQSETNLIDSLQGFFTRVMYQFSEDNEGHLLLENPVLSTENFTDKWSEYPERKEAFFNWIKQAKEDIMFYDTLSQKDYLEKISQKFTNNGENVAKSYGQYFQSIQKSGNFSYNTSNGFHVKEQGEKKIPKNTFYGM

SEQ ID NO: 1221 - protein, 434 aa, Candidatus Saccharibacteria bacterium
MNLSRYDTLFEEYLTKIVLTRSQANSIDQMLVETLSLFATEYEGDVEIYSQGSYAMGTTVRPLTALQSLDGTAGEYDVDIVLERATWTDAASALKDVRNVLSDEYSAKLDTKPRESCERVLHSTDANTEVAFHVDYVPIKSKHPTRYASRRSANEWFPSDTKKLIEWFQDIAEENTFLPSLILIIKRMRDNAGLTSTLSSICITALVCRLYENKSSYADDLLNIINGIIRVFNVPHVLLSITLEPLEDDLANRISEAQQKDILKFFINARAELGEGFVNEDIAKLRSVLSASFPADINEFPVELEPLRQRQWGIETDGSLRMTGIGEYQSKGTVITRQWRKFAGVGESLEFRANEYNKRQYGIRWQVLNAQGSPRIRGDLFEARGAGGGKNSNEYINHETEQYSGKHWVKYYVYDKLSKRVVEIGEKFVVEVNK

SEQ ID NO: 1222 - protein, 320 aa, Unknown
  Description of Unknown: Listeria sequence
MKLLEILEEISIGSNQQDKNSRILSEYVSEVKAVLEKPDAVFENRAIVFNFSDDVSERITTQSQIFYQGSYAIHTAIKHRDHDVDVDIAFYIDDIADTNLRNRIYTQLQTHLGSKYTVEIKKPCITISFDDDYKVDVAVYSQSTTEGTMMFHNSIKGIEEKVTSVPKLIVKSFSDYLKDDNLKRPTVRLVKYFAKNAGHDLGISDDNKIPSISFMLLATKYLSPTNLILSEENLLNELTTFTAECIDFFEKYTVLDAPQLMIGNTLYKIKDMQQVIMTLKTVNSQLKVKNYGQLTSTKTFESIQKRSRDISTPSLIGTMG

SEQ ID NO: 1223 - protein, 292 aa, Candidatus Magasanikbacteria bacterium
MPHLIPIELIEKISKGPSDTKIESVSNLQNYIQDLLGDSHHTFLQGSYRNHTAISDINDVDIVAVRKSTYSGTHSPHKFDSVIFWDQIFSEVENKLNNQNKYNWQITRDSKCIKISGAFSVDVVPAVKIDHDESEDPICIHSFKDGKEMASYPRTHIKNGESKHSSTNNNFKPLVRMFKNWKFNHFGDEKIISSHRIESLVHSCTNDAFKNDRALSFTLVGKQIFDKLNLSVVLPSNICSVCGYENVINNWDITDKKRFNDQLIKSLGYVVKAISAQNLSEAETNWKLAFNI

SEQ ID NO: 1224 - protein, 295 aa, Unknown
  Description of Unknown: Parcubacteria group bacterium sequence
MPHNIPTVHIQKHTRGISDTKRTEVANLQKYIQELLGDTHHTFLQGSYANDTSTSDINDVDIVAIRKTTYSSVHTGLSFPTSIPWETIFSEIETKLKNQNRYTWTVERSEGGKCIEVRTSGFKADVVPAVQINEDVKSDPIAIYSFKTGIEKVNRPRTHIENGVAKHNATNQNYKPIVRMFKNWVKNHFDNTDIISSYQVESLVYNTPNENFHNDHAYSFLFVGNHIAELLSQRDILPIKINSVCGTDDITTNWNIVARQSFKNKLKESVSHGLSAYKATTIQEAQNYWDKTFNI

SEQ ID NO: 1225 - protein, 294 aa, Candidatus Adlerbacteria bacterium
MATHKVSDSATTPLTKGPSASKITEVAAMQNFIQDLLGDTHHTFLQGSYKNDTARSDINDVDIVAIRLNTYSSVHTGRSFPTSIPWENIFAEIEQKLRSQGRYSSWTVTRGDKCIKVRGAFNADVIPAVQVGSHLEDPIVVYSFRTFTEKLNHPRLHYENGVAKNKATFGRYKPAVRMFKNWAYNHFGDDRDVFSSFKVEALVHSMPTEHFYDDPVKTFIVGADGILKKLNPRALVALGIPSVCGKEDIAHNWDANGKSRFAAQLSTSLGLALDAYKAGSIADADSKWRDTFNL

SEQ ID NO: 1226 - protein, 293 aa, Candidatus Magasanikbacteria bacterium
MPIHNIPSDLIEPLVKGPSPTKTTQVANLQNYIQELLSNTHHTFLQGSYKNDTAISDINDVDIVAVRLTTYSGTFSSMHFEQSIPWEDIFSEIERKLRSQTRYTWTVTRGDKCIKIRGTFNADVVPAVQIGQDHLVDPIAVYSFRDGREKINYPRDHYENGIQKNDLTDGKYKPVVRMFKNWVKNHFPDNNIISSFKTEALVHDVETSNFRDDYGIGFYIIADAIIQKLCQCNVLPMRLPSVCRQEDIGANWGTSERNQFLQRLQESNNYVLHALRETTVIGATENWKRAFNI

SEQ ID NO: 1227 - protein, 292 aa, Mycobacterium kansasii
MPVQISRHLIEHYAAGPSTARTTAVKSLQENVRAALAAAGGNNFDTFLQGSYRNNTAIADINDVDIVALYDPWRTPATRSDWERLFTAIANILTNSPRVTGTVTLGDKCVKLAGTLHADIVPAISPRPHSSPDPITIYSRNAWQERPNYPRTHYQHGVDKQAATDDAFKATVRLFKRWVRQYPSLNAPSFYIECAVHNVSDDAFGTYLPLSFAGVAVKIIERSPHSVIKSVAGDKDILVTEEWPSQDFAEFQRHLRSDMKYVLGAIQADTQVEADRLWKRAFGDRALPRSCA

SEQ ID NO: 1228 - protein, 298 aa, Stackebrandtia nassauensis
MTLEQKLSGWTAPSSVTEKEKQDRTERLIKRAMEKHEPLSESKWRVFAKGSYANNTNVKLDSDVDIAVECTDCFYSDGDSGESDDTGPYSGIWTPSKFRTEVQAALEAEFAGRVDCSGSTAFRVNPNSSSVDADVVPCFSYRYYYSPGNFREGTKVFKKDGSSLVNYPKQQLDIGRDKNNRTGHAYKKAVRIMKRVENAMVEEDKYKEVPSYLVECLVYNCPDDVLLRSTWVDTIRGVIAHIYNELGGEEPFDDSLRWCEPNDIKYLFHHSQPWGRNDGRRFARGFADAAWDYLGYEP

SEQ ID NO: 1229 - protein, 298 aa, Stackebrandtia nassauensis; identical to SEQ ID NO: 1228

SEQ ID NO: 1230 - protein, 296 aa, Acidithrix ferrooxidans
MTALEDKLSGWTGPSSDTEQEKQDRTERMIREAVRNHAEFANCSLKVYAKGSYANNTNVRSDSDVDIAVQCTNALYWNEVTPGVKPVGTPYTGPWTPARLRSELKTALEAKFPGQVDSSGSTAFTIKSGSARVDADVVPCFDHRYYFSPDNFLEGTKVFKTDNSSLLNYPDQQKANGNLKNQRTNQRYKKAVRIMKRLENAMVTAGVHREVPSFFVECLVYNIPDAVLNLSTWTELVRGTLGHIYNQLEGSESIAVDGRWREVNECKYLFDASQKWTRSDGRDFALAGWNYLGYKS

SEQ ID NO: 1231 - protein, 296 aa, Acidithrix ferrooxidans; identical to SEQ ID NO: 1230

SEQ ID NO: 1232 - protein, 295 aa, Streptomyces pluripotens
MILEEKLSGWTGPSSATEQDKQDRTERMIREAIKEHAAFHGCDLSVYAKGSYANNTNVKADSDVDIAVQCGEAVYWDEATEGAHPPSGSYTGIWTPAKLRSELEAALRAKFPGQVDSSGSTAFRIHSSSARVDADVVPCFEYEYHFSSTSYRKGAKVFKKNGASLVNYPKQQLENGRAKNTRTRQYYKKAVRIMKRVENAMVAEDVHREVPSFFVESLVYNCPDSVFLEPTWTKTIEGIIVHIWQELEGAEPSEESERWFEVNDCKFLFHGTQDWSRQDARDFVKAAWNYLGYAS

SEQ ID NO: 1233 - protein, 295 aa, Streptomyces diastatochromogenes
MALEEKLSGWTGPSSSTEQDKQDRTERMIREAIKEHVAFDGCDLSVYAKGSYANNTNVKADSDVDIAVQCGEAVYWDEATKGAHPPSGSYTGIWTPAKLRSELEAALKAKFPGQVDSSGSTAFRIHSGSARVDADVVPCFDYRYHFSSNNYREGAKVFKKNGTSLKNYPKQQLENGRAKNTRTKQYYKKTVRIMKRVENVMVAEGVHREVPSFFVECLVYNCPDSVFLEPTWTKTVEGAIVHIWQQLEGDEPSVESERWLEVSECKYLFNSAQDWSRQNGRDFVKAAWNYLGYAS

SEQ ID NO: 1234 - protein, 295 aa, Streptomyces sp.
MALEEKLSSWTGPSSATEQDKQERTERMIREAIKGHAAFDGCDLSVYAKGSYANNTNVKADSDVDIAVQCGEAVYWDEATEGAHPPSGPYTGIWTPARLRAELETALKSKFPGQVDSSGSTAFRIHSSSARVDADVVPCFDYQYYFSSSNFREGAKVFKKNGRSLENYPKQQLENGRGKNTRTRQYYKKAVRIMKRVENAMVAEGVHREVPSFFVECLVYNCPDSVFMESTWTKTVEGIILHIWQELAGDEPAVDSERWLEVSECKYLFHGAQDWNRQDGRDFVKAAWNHLGYAS

SEQ ID NO: 1235 - protein, 296 aa, Nocardioides sp.
MSLEAKLQGWTGPSSTTEQEKQERAERMVRQAVTSHPAFDGYAFRVYAKGSYANNTNVRSDSDVDIAVQCTEATYSREHESGVGPKGGADYEGPWTPAKFRKELAAAMEAKFPGQVDTSGSTAIRIDANSARVDADVVPCFNFRYYFSPSNFRPGAMIIKKDGTRVHNYAEEQLKKGRAKNVVTNMAFKQAVRILKRVENNMVVAGKHREVPSYFIECLVYNVPDDVLKRSTWESTIRGVLNHLWSNLDGDEPEDAARRWHEVSEWKYLFTNQQPWSRKDGRDFTKAAWNYLELGK

SEQ ID NO: 1236 - protein, 295 aa, Curtobacterium sp.
MVSEEQLGRWTGPSSPTEKEKQDRTERMIREAIDAHDAFSGVSLAIYAKGSYANNTNVKADSDVDIAVECQEVVYYRDRDPNADHSGVPYTGIWTPQYLRSEIESALRAKFPGSVDATGSTALRVNSNTARVDADVVPCFRYVEYFANGRTREGARVFKNDHTFTENYSKLQLLHGTQKNTRTNHYYKKTVRILKRLENVLVTAGLAEEMPSYLMECLIYNCPDEYFLRSTWRSVMQGCLADIYNYTMTAEPSEESDRWMEVNDVKFLFHSSQKWTREDVHAFASAAWEYMEFDA

SEQ ID NO: 1237 - protein, 295 aa, Actinomadura formosensis
MTLEEKFAGWTDVSSPTEQDKQDRTERMIRDAVDAHPAFEGYDIEVYVKGSYANKTNVRADSDVDVAVQCNEALYSDEAKPGTKPAGTPYNGIWTPTRLRSELKEALEAKFDSQVDDSGSTAFRINSSSARVDADVVPCFDYRYYLSSGEIRDGAKVFKKDGTSLVNYSRQQLENGEAKDCRTGDDYKSAVRIMKRVENLMVENGVHRVVPSFFVECLVYNCLDDLFRRSTWTSAIKGIIYHIWSNLEGTEPTDVTERWLEVSECKYLFQSTQDWTRKDGRDFAHAAWNYLELGK

SEQ ID NO: 1238 - protein, 298 aa, Corynebacterium jeikeium
MTNLELKLAGWTGPSSPTEQEKQDRTERMIREAIEAHPAFDGMSSKIYAKGSYANNTNVKADSDVDIAFECQDLFYWDEHTSGAHPASNGIYEGIWTPEKLRHELTIALRARFSTSVDTSESTTIQVNSNSARVEADVVPCFSYRYYFSPTSYREGAKIFKTDGNSIVNYSALQLENGRNKNNRTNYRFKKSVRIIKRLENAMAEEGYHQEVPSFFIECLVYNCPNTVFQRLTWIETVKGILAHIYTSLEGAEPTDSENRWLEVNGAKYLFHGSQKWSREDGRNFAYAGWNYLGLGGA

SEQ ID NO: 1239 - protein, 298 aa, Corynebacterium striatum
MTNLELKLAGWTGPSSPTEQEKQDRTERMIREAIEAHPAFDGMSCKIYAKGSYANNTNVKADSDVDIAVECQDLFYWDEHTPGAHPASNGIYEGIWTPEKLRHELTIALRARFSTSVDTSGSTAIQINSNSARVEADVVPCFSYRYYFSPTSYREGAKIFKTDGNSIVNYSALQLENGRNKNNRTNYRFKKSVRIIKRLENAMAEEGYHQEVPSFFIECLVYNCPDTVFQRLTWIETVKGILAHIYTSLEGAEPTDSENRWLEVNGAKYLFHGSQKWSREDGRNFAYAGWNYLGLGGA

SEQ ID NO: 1240 - protein, 294 aa, Plantactinospora sp.
MGLEEKLAGWTGPSSSTEQDKQERTERMIREAIKEHAAFDSCDLRIYAKGSYANNTNVKTDSDVDIAVQCRDVMYWDEARPRIHTPSPYQGIWTPAKLRSELRNALLNKFPGQVDTSGSTAFRIHSGSARVDADVVPCFNYRYYFVGGGHRDGAKVFKKDGSNLINYPDQQLTNGRDKNNRTSQYYKKTVRIMKRVENAMVHDGKHREVPSFFIECLVYHCPDDIFLRSTWEGTVRGVISHIFHGLEGAEPEDNSKRWLEVSGCKYLFQPGQAWTRADGWAFAKAAWNYLGLKS

SEQ ID NO: 1241 - protein, 295 aa, Arthrobacter sp.
MSIEATLSGWVGPSSVTEQDKQDRTERMIRDAINSHPAFADCDLKIYAKGSYANNTNVRTDSDVDIAVQCMNVIYWDEATAGAHPVSSSYTGIWTPSQLRGELVKALKEKFPDHTDDSGSTAIRINSSSARVEADVVPAFDYKYYFKDGSSRRGSRVFKKDGSKIANYPDQQLANGKSKNVATMHRYKKAVRVMKRVENAMVSAGHHREVQSFFVESLVYNCPNNVLMQNSWTDTIKGVIVHIWDTLEGDEPTDASKRWLEPNECKYLFYNAQPWSRQDGRDFAKAAWNYLGFST

SEQ ID NO: 1242 - protein, 296 aa, Arthrobacter globiformis
MSLETKLAGWTGPSSDSEQDKQDRTERMIRAAIEAHPAFEECTLKVYAKGSYANNTNVKSDSDVDIVVQCNDVTYWEEASPGAHPATFTPYSGIWTPDKLRTELIAALRSKFPDHVDTSGSTAIRIDSNTARVEADVVPAFNFKYYFASGSHREGSRVFKKDGTFLTNYPEQQLINGRTKNNATGGRYKKAVRIMKRVENAMVDTNYHREVPSFFMECLVYNCPDEVLTRATWTDIIRGVIVHVWDQLQGPEPTEESNRWLEPNRCKYLFHSSQPWTRADGRDFVKAAWNHLGLTS

SEQ ID NO: 1243 - protein, 298 aa, Mycobacterium tusciae
MASLEEKLAGWTGPSSPTEQDKQERTERMIKEAVRDYPGFKDCSLTVYAKGSYANDTNVRADSDVDIAVECSDVLYWDEAEPGAKTSKGEPYTGPWTPSKLRSELHSALEKKFPGEVDSSGTTAFQVNSSSARVDGDVLPCFDYRYYFSSGAYRDGSKAFKTDGTSITNYPQQQLDNGRTKNARTSLRFKKAVRVMKRVENAMVEDSIIEELPSYFIECLVYNVADDILVRSSWVEVVRGILVHIYEELEGPEPTDEQSRWLEVNECKYLFHSAQKWTRQDGRDFAQAAWSYLGYPNP

SEQ ID NO: 1244 - protein, 299 aa, Mycobacterium avium
MTSLEDKLISWTGPSSATEQDKQDRTERMVSEAVRTHPGLKDCTFTVYTKGSYPNRTNVKADSDVDVAVQCSDVFYWDAAEPGAKRSTTTPYTGVWTPSKLRTEVLLALEQKFPGQVDASGSTAIKVNSSTARVDADVLPCFDYRYYLSSGAIREGARAFKTNGNAITNYPEQQLKKGIAKNEASATRFKKAVRVLKRIENAMVEDSLMDELPSYFMECLVYNVPNSILTRAAWVEVVRGILGHIYVSLEGPEPEEESVRWLEVNECKFLFHQAQKWSRADGRALAQSAWSYLGYPNPT

SEQ ID NO: 1245 - protein, 260 aa, Clostridium sp.
PFPVRQLPVRGYAKGSYPNNTNVRADSDVDIAVECTEVEYWDEAAPGAAGGGSGSPYVGGWTPDRLRAELLAALTRKFPGDVDSSGSTAILVQSSSARVDSDVVPCFTYRYYLSPDSSRIGTRIFRKDGGQIDNFPEQQLSLGRVKNLRTQYAYKKTVRILKRIENAMRTTGEFRALPSYFVECLTYNCPDSVFLAATWTDTVRGVLSHVWESLQGDEPVHEASRWVEVNECFYLFHPAQAWTRADGRDFAQAAWAHLGL

SEQ ID NO: 1246 - protein, 295 aa, Lysobacter enzymogenes
MTLERKLSNWTSPSSDAEQEKQERTERMVRAAVADHSPFATCQLRVYAKGSYPNNTNVRADSDVDIAVECTEVEYWDEAAPGAAGGGSGSPYVGGWTPDRLRAELLAALTRKFPGDVDSSGSTAILVQSSSARVDSDVVPCFTYRYYLSPDSSRIGTRIFRKDGGQIDNFPEQQLSLGRVKNLRTQYAYKKTVRILKRIENAMRTTGEFRALPSYFVECLTYNCPDSVFLAATWTDTVRGVLSHVWESLQGDEPVHEASRWVEVNECFYLFHPAQAWTRADGRDFAQAAWAHLGL

SEQ ID NO: 1247 - protein, 291 aa, Yersinia kristensenii
MSLEDKLSGWTGPSSSTEQDKQDRTERMIREAIYSHAPFNNCSLKVYAKGSYANNTNVRSDSDVDIAVECTEVLYWEKTEESIHTPGEPYKGIWTPAKLRTELITAMETKFSGQVDSSGSTAIQINSSSARVDADVVPCFSYKYYMENETRDGTKIFKTDGNNIVNYPAQQLKNGIAKNNRTNYAYKRGARLLKRIENVMTKDETFRELPSFFMECLAYNCPDIVFAHSTWTKCLRAMLIHIWENLQGDEPTSERWVEVNECFYLFHSNQKWARKDGREFAKAAWNYLEFK

SEQ ID NO: 1248 - protein, 292 aa, Methylobacter tundripaludum
MSLEDKLSGWTGPSSNMEQDKQDRTERMIRQAINSHEPFNNCLLKVYAKGSYANNTNVRSDSDVDIAVECTEVLYWEESEKGSHTSGRKPYEGIWTPAKLRAELLSAMETKFPGQVDSSGSTAIQINSNSARVDADVVPSFSFRYYMKYGSRDGTKIFKTDGSSIVNYPAQQLDNGIAQNNRTGYAYKKGTRLLKRIENAMAEDGTFRELPSFFMECLAYNCPDNVFAHPTWTECLRAMLLHIWNNLQGDEPTTGRWLEVNECFFLFHSNQKWTREDGREFAKAAWNYCGFK

SEQ ID NO: 1249 - protein, 291 aa, Pseudomonas brassicacearum
MSLEEKLIGWTGPSSSTEQEKQDRTERMIRQAINSHDPFNNCSLNIYAKGSYANNTNVRSDSDVDIAVECTDVLYWEESEKGIYTPGTAYKGIWSPAKFRSELISAMRATFPGQIDTSGSTAIQINSGSARVDADVVPCFSFQYHMIDETRDGTKIFKTDGSSIVNYPAQQMANGIAKNNRTGYAYKKGARILKRIENAMAEDGYFPELPSFFMECLAYNCPDTAFTHSTWTECIKEMLVHIWTNLQGDEPKTARWVEVNECFYLFHPDQKWTRKDGREFSKAAWNYLGIK

SEQ ID NO: 1250 - protein, 291 aa, Pseudomonas sp.
MSLEEKLIGWTGPSSSTEQEKQDRTERMIRQAINSHEPFNNCSLNIYAKGSYANNTNVRSDSDVDIAVECTDVLYWEESETGIYTPGTAYKGIWTPAKFRSELISAMRATFPGQIDTSGSTAIQINSGSARVDADVVPCFSFQYHMINETRDGTKIFKTDGSSIVNYPAQQMTNGIAKNNRTGYAYKKGARILKRIENAMAEDGYFSELPSFFMECLAYNCPDTAFAHSRWTECIKDMLVYIWTNLQGDEPKTARWVEVNECFYLFHSDQKWTRKDGREFSKAAWNYLGIK

SEQ ID NO: 1251 - protein, 291 aa, Pseudomonas aeruginosa
MSLEEKLTGWTGPSSSTEQEKQDRTERMIRQAINSHTPFNSCSLKIYAKGSYANNTNVRSDSDVDIAVECTDVLYWEESEKGIYTPGSAYKGIWTPEKFRSELISAMRATFPGQIDTSGSTAIQINSGSARVDADVVPCFSFQYHMINETRDGTKIFKTDGSSIVNYPAQQMANGIAKNNRTGYAYKKGVRILKRIENAMAEDGYFSELPSFFMECLAYNCPDTAFAHSTWTECIKDMLIHIWTNLQGDEPKAARWVEVNECFYLFHSDQKWTRKDGREFSKAAWNYLGIK

SEQ ID NO: 1252 - protein, 291 aa, Pseudomonas sp.
MSLENKLSGWTGPSSDTEQDKQDRTERMIRQAIGAHEPFNNCSLKVYAKGSYANNTNVRSDSDVDIAVECTEVLYWEESEKGNYTPGEPYVGIWTPANLRAELLSAMMAKFPGQVDSTGTTAIKINSNSSRVDADVVPCFSYQYHLSHETRDGTRIFKTDGSSIVNYPAQQMENGIAKNKRTGGSYKKGARLLKRIENAMAEDRIFRELPSFFMECLAYNCPDAVFSHSTWTECLRSMLFHIWDNLQGDEPDSGRWVEVNECFYLFHSGQKWTREDGREFSKAAWNYFGFK

SEQ ID NO: 1253 - protein, 291 aa, Pseudomonas fluorescens
MSLENKLSGWTGPSSDTEQDKQDRTERMIRQAINSHEPFNNCSLKVYAKGSYANNTNVRSDSDVDIAVECTEVLYWEEHEKGNYTPGKPYEGIWTPAKLRAELLSAMNAKFPDQVDSMGSTAIQINSSSARVDADVVPCFSFQYHLSHETRNGTKIFKTDGTSIVNYPAQQMENGTAKNRRTGNAYKKGARLLKRVENAMAGDEMFRELPSFFMECLAYNCPDTVFAHSTWTECFRAMLLHIWDSLQGEEPDSGRWVEVNECFFLFHPNQKWTREDGREFSKAAWNYFGFK

SEQ ID NO: 1254 - protein, 291 aa, Escherichia coli
MSLEDKLSKWTGPSSDTEQDKQDRTERMIRQAIDSHEPFRDCSLKVYAKGSYANNTNVRSDSDVDVAVECTEVQYWEESVKGNHTPGRSYEGIWTPAKLRAELLSALKAKFPEQVDSSGSTAIQINSNSARVDADVVPCFSYRYYMKSETRDGTKIFKTDGGSIVNYPAQQMENGTAKNKRTGYAYKKGVRLLKRIENAMAEDGTFRELPSFFMECLAYNCPDTVFTHSTWTDCLRAMLFHIWDKLQGDEPDFGRWVEVNECFFLFHANQKWTREDGREFAKAAWNYFGFK

SEQ ID NO: 1255 - protein, 291 aa, Unknown
  Description of Unknown: Pseudomonas sequence
MSLEDKLSGWTGPSSDTEQDKQDRTERMIRQAIDSHEPFNNCSLKVYAKGSYANNTNVRSDSDVDISVKCTEVLYWEEHEKGIYTPGKPYEGIWTPAKLRAELLSAMKAKFSGHVDSTGSTAIQINSNSARVDADVVPCFSYQYHLSNGTRDGTKIFKTDGSSIVNYPDQQMENGIAKNKRTGNAYKKGVRLLKRIENAMAEDGVFRELPSFFMECLAYNCPDTVFAHSTWTECLRAMLFHIWDNLQGDEPDSERWVEVNECFYLFHSSQKWTREDGREFSKAAWNYFGYR

SEQ ID NO: 1256 - protein, 292 aa, Acinetobacter tandoii
MSLEDKLIRWTGPSSDTEQDKQDRTERMIRQAISAHENFNNCSLKIYAKGSYANNTNVRSDSDVDIAVECTEVQYWKESEKGNRQSGKPYEGIWTPAKLRAELILALEKKFPDQVDATGSTAIQINANSARINADVVPCFSYRYYMKNGSRDGTKIFKTDGTSIVNYPFQQKENGIAKNNRTGYAYKKGVRILKRIENAMEVDHVFHELPSFFIECLAYNCPDEVFLHSTWTKCLREMLLHIWNSLQGDEPEINRWMEVNECIYLFHSKQKWTRKDGREFAKTAWNYMGFNS

SEQ ID NO: 1257 - protein, 292 aa, Oblitimonas alkaliphila
MSLEDKLSGWTGPSSSTEQDKQDRTERMIRQAIDAHEPFNNCSLKVFAKGSYANNTNVRADSDVDIAVECTECRYWGESEKGNHPPSSGSYEGIWTPEKLRAELLSAMNTKFPGQVDSSGSTAIQINSNSARVDADVVPCFSYRYYMNHGSRDGTKIFKTDGSSIVNYPVQQKENGIAKNNRTGYAYKKGVRLLKRVENVMAQDGTFRELPSFFMECLAYNCPDNTFSHPTWTECLRAMLLHIWNNLQGDEPTSGRWLEVSECVFLFHSNQKWTRKDGREFAKAAWNYFGFK

SEQ ID NO: 1258 - protein, 291 aa, Halomonas sp.
MSLEDKLSGWTGPSSSTEQDKQDRTERMIRQAIDAHEPFNDCSLKVFAKGSYANNTNVRADSDVDIAVECTECQYWEESEKGNHPPSGSYEGIWTPEKLRAELLSAMNKKFPGQVDSSGSTAIQINSNSARVDADVVPCFSYRYYMNHGSRDGTKIFKTDSSSIVNYPVQQKENGTAKNNRTGYAYKKGARLLKRVENAMAQDGTFRELPSFFMECLAYNCPDNAFSHPTWTERLRAMLLHIWNNLQGDEPSSGRWLEVSECVFLFHSNQKWTREDGREFAKAAWNYFGFK

SEQ ID NO: 1259 - protein, 292 aa, Halomonas sp.
MSLEDKLSGWTGPSSTTEKDKQDRTERMIRQAIDSHEPFNNFSLKVFAKGSYANNTNVRSDSDVDIAVECTECQYWEESEKGNHPPSSPYGGIWTPAKLRAELVSAMNAKFPGQVDSSGSTAIQINSNSARVDADVVPCFSYRYYMSNGSRDGTKIFKTDGSSIVNYPMQQKVNGTAKNNRTGYAYKKGARLLKRIENAMAQDGAFRELPSFFMECLAYNCPDDAFSHPTWTERLRAMLVHIWSNLQGDEEPASGRWMEVNGCFFLFHKNQKWTREDGRDFAQAAWNYFGFK

SEQ ID NO: 1260 - protein, 291 aa, Burkholderia ubonensis
MSLEDKLSGWTSPSSDSEQEKQDRTERMIRDAVNAHTPFDNCPLKIYAKGSYANNTNVRSDSDVDIAVECTAATYWEESQSGTHPPGTPYNGIWTPAKFRTELIAALKAKFSNQVDTTGTTAIQINSGSARIDADVVPCFSYRYYMPDGSRAGTKIFKTDGSGIVNYPAQQLENGIAKNKQTGYAYKKAARLLKRIENAMAADGAFKELPSFFMEFLAHNCPNSIFDQLTWTACLRAMLIHIWNELQGDEPSTGRWVEANDCFYLFHPHQKWKREDGREFAKAAWNYFEFE

SEQ ID NO: 1261 - protein, 291 aa, Burkholderia ubonensis
MSLEDKLSGWTSPSSDSEQEKQDRTERMIRDAVNAHTPFDNCPLKIYAKGSYANNTNVRSDSDVDIAVECTAATYWEESQSGTHPPGTPYNGIWTPAKFRTELIAALKAKFSNQVDTTGTTAIQINSGSARIDADVVPCFSYRYYMPDGSRAGTKIFKTDGSGIVNYPAQQLENGIAKNKQTGYAYKKAARLLKRIENAMAADGAFKELPSFFMECLAHNCPNSIFDQLTWTACLRAMLIHIWNELQGDEPSTGRWVEANDCFYLFHPHQKWKREDGREFAKAAWNYFEFE

SEQ ID NO: 1262 - protein, 291 aa, Burkholderia sp.
MSLEDKLSGWTGPSSNSEQEKQDRTERMIRDAITSHSAFDNCSLKIYAKGSYANNTNVRADSDVDIAVECTDALYWEEEKSGNHPPGKPYEGIWTPEKLRSELVAALKAKFPNQVDVSGTTAIQINSGSARVDADVVPCFSYRYYFENGTRDGTKIFKTDGKNIINYPAQQLENGIAKNKQTGYAYKKAARLLKRIENSMAADGVFRELPSFFMECLAFNCPNSVFDHSTWTACLRAMLFHIWSQLQGDEPSTGRWVEANGCFYLFHPHQKWTRQDGREFAKSAWYYFEFK

SEQ ID NO: 1263 - protein, 297 aa, Wohlfahrtiimonas chitiniclastica
MSLEEKLISWTKPSSDTEQEKQERTERMIREAISSHRAFDGCNLEIYAKGSYANNTNVRSDSDVDIAVECTEVFYWEKAEEIPPPIGAPYTGVWTPDKLREELVFAMEAEFGEQVDPTGSTAIQINSSSARVDADVVPCFTYRYYMETGFREGTAIFKKDGSSLVNYPKKQLENGRIKNNRTNHSYKKGARLLKRIENEMAEKGLFRELPSYFMECLAYNCPDEVFMHETWTECLKAMLRHIFKELQDDEPVLNRWVEVNEYSDLFHADQEWSRKDGREFAKIAWNYLGLKNAKYKF

SEQ ID NO: 1264 - protein, 291 aa, Enterovibrio calviensis
MSLEDKLFGWTGPSSETEKEKQDRTERMIREAINSHTPFDGCSLNVFAKGSYANNTNVRSDSDVDIAVECTDVRYWEESEKGNHTPGDSYEGIWTPTKLRAELISAMTAKFPGQVDSSGSTAIQINSSSARVDADVVPCFSYRYYMKQGSRDGTKIFKKDGSNIVNYPVQQKENGTAKNNATNYAYKKGARLLKRIENSMAADGEFRELPSFFMECLAYNCPNHVFAHSTWTERLRAMLIHIWDNLQGDEPDENRWLEVNECFFLFHSDQEWTRKDGREFAKAAWNYFGFE

SEQ ID NO: 1265 - protein, 291 aa, Methylophilus sp.
MTLEEKLSSWTGPSSDSERDKQDRTERMVREAINTHTPFENCSLNVFAKGSYANNTNVRSDSDVDIAVECTDVQYWEESEKGNHEPGNPYEGIWTPAKLRAELLAAMVAKFPGQVDSSGSTAIQINSSISRVNADVVPCFSFRYDMKYESRNGTKIFKKDGSSIVNYPVQQLENGIAKNNATNYAFKKGVRLLKRIENAMAADGTFRELPSFFMECLAYNCPNHVFSHSTWTYCLRAMLSHIWSNLQGDEPSEGRWLEVNECFFLFHPGQKWNRADGREFAIAAWNYCGFK

SEQ ID NO: 1266 - protein, 291 aa, Cycloclasticus sp.
MSLEDKLSGWTGPSSDTEKDKQDRTERMIREAINSHEPLNNCSLNVFAKGSYANNTNVRADSDVDIAVECTDVLYWKESEKGNHTPGKPYEGIWTPAKLRAELVSAMKAKFPGQVDTSGSTAIQINSSSSRVDADVVPCFSFRYYMKYGSRDGTKIFKTDGSSIVNYPIQQMDNGIAKNKATGYAYKKGARLLKRVENAMAADGTFRELPSFFMECLAYNCPDHVFSHSTWTDRLRAMLIYIWENLQGDEPDEDRWLEVNECFFLFHSDQKWSRKDGREFAKAAWNYFGFK

SEQ ID NO: 1267 - protein, 293 aa, Escherichia coli
MSLEEKLSRWTGPSSDTEQEKQDRTERMIRQSIDSHEPFNNCSLKVYAKGSYANNTNVRSDSDVDIAVECTDALYWDESEKGIYTPGKSYEGIWTPAKLRAELLSALKKTFPGQVDPSGSTAIQINSNSARVNADVVPCFSFCYYMSGENRNGTKIFKTDGSSLVNYPTQQLNNGIAKNNRTGYAFKKGVRLLKRTENAMAEKGVFRELPSFFMECLAYNCPDRVFTTSTWEECLKEMLIYIYSNLQGDEPESETERWVEVNECFYLFHSEQKWTREDGREFAKAAWNYFGFS

SEQ ID NO: 1268 - protein, 291 aa, Oleiphilus sp.
MSLESQLAAWTAPSSDTEKDKQERTERMIRDAISEHEAFNNCSLKIYAKGSYANNTNVRLDSDVDIAVECNDVLYWDESEKGTHNPGTPYEGIWTPEKLRSELLAAMRSKFPGQIDSSGSTAIQINSSSARVDADVVPCFSFRYHMKYGSRDGTKVFKTDGSNIVNYPAQQLEHGVDKNKRTNYAYKKGVRLLKRLENLMYESGEFRELPSFFIECLVFNCPDEIFSKPNWTERLRGLLFHIWNELQGEEPSTDRWTEANDCFFLFHSSQKWSRADGREFANAAWNYLEFK

SEQ ID NO: 1269 - protein, 292 aa, Acinetobacter sp.
MVSEITLSNWTLPSSDTEIEKQERAERMIRQAIDAHEAFQNCSLKVYAKGSYANNTNVRSDSDVDIAVECTEALYWDESEKGNHQTSGNLYHGIWTPAKLRAELILAMKKKFPDQLDISGVTAIQINSNSARVNADVVPCFSYRYYMKNNYRDGTKIFKTDGKGIVNYPLQQIKNGKDKNNRTNYNYKKSVRILKRIENAMATEGKCKELPSYFIECLAYNCPDYIFTRITWAQMLREIIIYIYHSLDGVEPSLERWVEVNECFYLFHSQQKWTRQDGRAFALAAWNYCGFK

SEQ ID NO: 1270 - protein, 292 aa, Acinetobacter sp.
MITEATLSTWTAPSSDTEKDKQDRAERMIRQAIDEHIPFKACSLKVYAKGSYANNTNVRSDSDVDIAVECTDALYWEEEEKGNRRQVSAGPYKGIWTPAKLRAELVLAMQKKFPNQVDTSGVTAIQINANTARVNADVVPCFSYRYYMENYHRDGTKIFKTNGISIANYPLQQIRNGRDKNNRTNYNYKKCVRILKRIENAMAQESKFKELPSYFIECLAYNCPDYIFTRSTWTLMLREILSYIYHSLEDEPNIDRWLEVNECFYLFHTQQKWTRQDGRAFAHAAWNYCGFK

SEQ ID NO: 1271 - protein, 291 aa, Pseudomonas aeruginosa
MSLEEKLAGWIGPSSATEQDKQDRTERMIREAINAHAAFDDCSLNIFVKGSYANNTNVRSDSDVDIAVECTDVRYWEEEKKGIHTPGNPYTGIWTPAKLRSELVSALKAKFPDHVDDSGTTAIQINSNSARVDADVVPCFSYIYYMEQGSRSGTKIFKTDNSNIVNYPVQQLNNGVAKNKSTNYAYKKIARILKRLENEMAENGKFRELPSYFMECLAYNCPNSLFSYPTWTECIREILIHIWSNLEGAEPETSRWIEVNECFYLFHSGQKWTRNDGREFANAAWNHLGLE

SEQ ID NO: 1272 - protein, 291 aa, Pseudomonas aeruginosa
MSLEEKLAGWIGPSSATEQDKQDRTERMIREAINAHAAFDDCSLNIFVKGSYANNTNVRSDSDVDIAVECTDVRYWEEEKKGIHTPGNPYTGIWTPAKLRSELVSALKAKFPDHLDDSGTTAIQINSNSARVDADVVPCFSYIYYMEQGSRSGTKIFKTDNSNIVNYPVQQLNNGVAKNKSTNYAYKKIARILKRLENEMAENGKFRELPSYFMECLAYNCPNSLFSYPTWTECIREILIHIWSNLEGAEPETSRWIEVNECFYLFHSGQKWTRNDGREFANAAWNHLGLE

SEQ ID NO: 1273 - protein, 291 aa, Pseudomonas nitroreducens
MSLEEKLAGWIGPSSTTEQDKQDRTERMIREAINAHAAFDDCSLNVFVKGSYANNTNVRSDSDVDIAVECTDVRYWEEETQGIHTPGNPYTGIWTPAKLRSELVSALKAKFPEQVDDSGTTAIQINSNSARVDADVVPCFSYVYYMEQESRSGTKIFKTDNSSIVNYPVQQLRNGIAKNNSTNYSYKKIARILKRLENEMAENGKFRELPSYFMECLAYNCPNSLFSYPTWTECVREVLIHIWSSLEGAEPETNRWVEVNECFYLFHSGQKWTRNDGREFANAAWIHLGLE

SEQ ID NO: 1274 - protein, 294 aa, Unknown
  Description of Unknown: Vibrio sequence
MSLEDRLSGWKGPSSDSEQEKQERTERMIRQAIHDHEPLNDCDLTIFTKGSYSNNTNVRSDSDVDIAIECTECVYWEEAEKGIRPTSNTPYSGKWTPEKLRIEIIAALRKKFPGQVDTTGTTAIQINSNTARVDADVVPCFSFKYYLIGGGFRLGTKIFKNGGGNIVNYPRQQLEYGTNKNNRTNYAYKKVVRILKRVQNLMASNDTFRDLPSYFIESLVFNCPDVLFEYPTWTERVKQVLIHIWEGLQGDNEPASGRWTEANDCFYLFHSGQKWSRKDGREFAYAAWNYLGLG

SEQ ID NO: 1275 - protein, 293 aa, Thiomicrospira microaerophila
MSLEEKLIRWTAPSSTTEQDKQDRTERMIREAIDAHSAFDGCELRVYAKGSYANNTNVRSDSDVDIAVECTEVRYWEESEKGVKPSGSSYEGIWTPKKLREELVIAMRAKFPGQVVTAGSTAIQINSSSARVDADVVPCFSYRYYMKSGHRDGTKIFKKDGNSIVNYPTQQKSNGTEKNNRTNYAYKKGARLLKRIENEMSAEGYFRELPSYFIECLAYNCPDTIFARSSWTDRLKGMLAHILDELQGEEPLKESKRWLEVNECYFLFHSDQQWDRKDGREFAKAAWSYFGFK

SEQ ID NO: 1276 - protein, 300 aa, Candidatus Beckwithbacteria bacterium
MNISDDQLSGWIKPWFNNEEERAEKTKDTVKSAVDTHLSDLGIRVFAKGSYPNNTNVRHDSDIDIAVELQDMINLNYAEGVGFSNTGLFGYTGISEIDFKLRLQKALETEFGKNLVDSSGNKVFKIRGSDKILDADIIPCTTYRYYYSTGSTNYNQGIQLILNRPDGIRHFNYPDQHLENGIEKNTSTSKRFKNVARILKNVNGHLSENNNTSPFPSFMIESLAYNVSNPIYTNNEIWRDIVLRGCEEVWTYLLKDEYTLSEDCRWREVNGCKYLFHGQQNWTKDDAKQFIKSAYNLLNK

SEQ ID NO: 1277 - protein, 303 aa, Streptomyces albus
MARQLTVTQRLALINRWKNPPGPSEQLRLARAERMVKEAVDRHGPFRGLDITVAAKGSYPNKTNVRGDSDVDIMVKLNDPFHTDGVAPWWFGEQADAGTWTATTLREEVHAALTNRFGWVDADHNIAFYVPEVVGSHPSIDVVPCFKWVKYDFSAPGGQYVGSVVHGRNRKKVINWPELQLANGRAKNSDTNLRYKFVVRVLKNAENDLTTQGVIKALPSYFSECLIYNVPDHVLLAGDFDDAVRESLREVSRQLSGIRFGSQRMMEPNGIKKVFGEGQKWTEKDARDLVEGAWYYLGYKGCR

SEQ ID NO: 1278 - protein, 269 aa, Streptomyces albus
MVKEAVDRHGPFRGLDITVAAKGSYPNKTNVRGDSDVDIMVKLNDPFHTDGVAPWWFGEQADAGTWTATTLREEVHAALTNRFGWVDADHNIAFYVPEVVGSHPSIDVVPCFKWVKYDFSAPGGQYVGSVVHGRNRKKVINWPELQLANGRAKNSDTNLRYKFVVRVLKNAENDLTTQGVIKALPSYFSECLIYNVPDHVLLAGDFDDAVRESLREVSRQLSGIRFGSQRMMEPNGIKKVFGEGQKWTEKDARDLVEGAWYYLGYKGCR

SEQ ID NO: 1279 - protein, 300 aa, Streptomyces jietaisiensis
MARQLTITQRLALINKWKNPPGPSEQLRLERAERMVKSAVNRHGPFRGLDIMVAAKGSYPNKTNVRGDSDVDIMVKLNDPCHTDGAAAWWFGEQADAGTWTRTRLREEVYAALTNHFGWVDADHNIAFCVPEVVGSRPSIDVVPCFKWVTYDFSAPGGQYVGSVVYGRNRKRIINWPEYQLANGRTKNTNTNLRYKFVVRVLKNVENDLATEGVIKALPSYFSECLIYNVPDDVLLAGDFDDAVRASLQEVYRQITSFFGPQRMWEPNGMKKVFGEGQKWTEKDARELIEGAWYYLGYGG

SEQ ID NO: 1280 - protein, 294 aa, Streptomyces cinnamoneus
MTEDQRLALISKWKSPPGAAEQDRLERAERMVCEAISQHEPFRDLSITVAAKGSYPNNTNVRGDSDVDIKVQLNDPFYYDSPWGGTDQYTGPWTKDKLRQEVRTALTQRFGTVDADHNIAFYVPEVVGSRPSIDVVPCFKYVLYNSAATEGRYEGSIVFGRDGKQVINWPELQLLNGREKNRRTNLRYKFAVRVLKSVENDLADEGVIAPLPSYFSECLIYNVPDHVLLTGSFDDAVRSSLQEVYRQLTSPWPGTSRMVEPNEVKKVFGSDQKWDEKDARDLVEGAWLYLNYGG

SEQ ID NO: 1281 - protein, 299 aa, Streptomyces sp.
MARQLTPGQRLGLISKWRNPPGQSEQVRLERAERMVKEAVRQHEPFLGLDITVASKGSYPNNTNVRGDSDVDIMVKLNDPSHTEGPAEWWFGPRHTGPWTKDKLRQEVHAALVGRFGPVNADGNLAFFIPEVVNSRPSIDVVPCFKWVVYDPTAAGGRYEGSVVYGRDGKKVINWPELQLANGRAKNTNTKLRYKFVVRVLKNVENDLAAEGVIKALPSYFSECLIYNVPDSVFLAGEFDDAVRVSLLEVHRQLTSLFGPSRMREPNGMKKLFGPGQKWDEKDARNLITSAWHYLGYEG

SEQ ID NO: 1282 - protein, 273 aa, Unknown
  Description of Unknown: Streptomyces sequence
MRLERAERMVKEAVRQHEPFLGLDITVASKGSYPNNTNVRGDSDVDIMVKLNDPSHTEGPAEWWFGPRHTGPWTKDKLRQEVHAALVGRFGPVNADGNLAFFIPEVVNSRPSIDVVPCFKWVVYDPTAAGGRYEGSVVYGRDGKKVINWPELQLANGRAKNTNTKLRYKFVVRVLKNVENDLAAEGVIKALPSYFSECLIYNVPDSVFLAGEFDDAVRVSLLEVHRQLTSLFGPSRMREPNGMKKLFGPGQKWDEKDARNLITSAWHYLGYEG

SEQ ID NO: 1283 - protein, 267 aa, Streptomyces sp.
MVKEAVRQHEPFQSLDITVAAKGSYPNKTNVRGDSDVDIMVKLNEPFHTDGMAAWWFGQPARYTGPWTKDKLRQEVHAALTGRFGPVDADHNLAFYIPEVAGSRPSIDVVPCFKWVVYDPTAPGGQHEGSVVYGRNGKKVINWPELQLANGRAKNTNTKLRYKFVVRVLKNVENDLAAEGVIKSLPSYFSECLIYNVPDHVFLAGDFDDAVRASLQEVYRQLTSWLGPQRMREPNGMKKVFGEGQKWGEKDARNLIESAWHYLNFEG

SEQ ID NO: 1284 - protein, 303 aa, Streptomyces sp.
MARQLTYEQRIALINKWKNPPGASEQLRLERAERMVKQAVLRHEPSQRLDITVASKGSYPNNTNVRGDSDVDIMVKLNDPFHTEGLAAWWFGQQASYAGPWTRQKLRWEVEDALTNQFGSVDTDHNLALYVPEVVGSRPSIDVVPCFKWVAYDSTVPGGEYVGSVVYGRNGKRVINWPELQLANGKAKNNATKYRYKFVVRVLKNVENVLAADGVITALPSYFSECLIYNVPDDVFGLDGSLDAVVRESLREVYRQLTGAWFSSQRMVEPNGIKKVFGEGQKWTEKDARELVEGAWHYLNYEG

SEQ ID NO: 1285 - protein, 303 aa, Streptomyces sp.
MARQLTYEQRIALINKWKNPPGASEQLRLERAERMVKQAVLRHEPFQGLDITVASKGSYPNNTNVRGDSDVDIMVKLNDPFHTEGLAAWWFGQQASYAGPWTRQKLRREVEDALTNQFGSVDTDHNLALYVPEVVGSRPSIDVVPCFKWVAYDSTVPGGEYVGSVVYGRNGKRVINWPELQLANGKAKNNATKYRYKFVVRVLKNVENVLASDGVITALPSYFSECLIYNVPDDVLGLDGSLDAVVRESLREVYRQLTGAWFSSQRMVEPNGIKKVFGEGQKWTEKDARELVEGAWHYLNYEG

SEQ ID NO: 1286 - protein, 291 aa, Streptomyces griseus
MINKWKSPPGASEQLRLERAERMVKEAVARHEPFQGFDITVASKGSYPNNTNVRGDSDVDIMVKLNDPFHTEGLAAWWFGQQPRYTGPWTQRKLRQEVEDALTNHFGSVDTDHNLALYVPEVVGSRPSIDVVPCFKWVAYDSMAPGGEYVGSVVYGRNGKRVINWPELQLANGRTKNANTKYRYKFAVRVLKNVENVLASEGVITALPSYFSECLIYNVPDHVMLGVDSLDEVVRESLREVYRQLTGAWFSSQRMVEPNGIKKVFGEGQKWTEKDARELIEGAWYYLNYEG

SEQ ID NO: 1287 - protein, 303 aa, Streptomyces albidoflavus
MARQLTYDQRIALINKWKSPPGASEQLRLERAERMVKEAVARHEPFQGFDITVASKGSYPNNTNVRGDSDVDIMVKLNDPFHTEGLAAWWFGQQPRYTGPWTQRKLRQEVEDALTNHFGSVDTDHNLALYVPEVVGSRPSIDVVPCFKWVAYDSMAPGGEYVGSVVYGRNGKRVINWPEFQLANGRTKNANTKYRYKFAVRVLKNVENVLASEGVITALPSYFSECLIYNVPDHVMLGVDSLDEVVRESLREVYRQLTGAWFSSQRMVEPNGIKKVFGEGQKWTEKDARELIEGAWYYLNYEG

SEQ ID NO: 1288 - protein, 291 aa, Streptomyces albidoflavus
MINKWKSPPGASEQLRLERAERMVKEAVARHEPFQGFDITVASKGSYPNNTNVRGDSDVDIMVKLNDPFHTEGLAAWWFGQQPRYTGPWTQRKLRQEVEDALTNHFGSVDTDHNLALYVPEVVGSRPSIDVVPCFKWVAYDSMAPGGEYVGSVVYGRNGKRVINWPEFQLANGRTKNANTKYRYKFAVRVLKNVENVLASEGVITALPSYFSECLIYNVPDHVMLGVDSLDEVVRESLREVYRQLTGAWFSSQRMVEPNGIKKVFGEGQKWTEKDARELIEGAWYYLNYEG

SEQ ID NO: 1289 - protein, 303 aa, Streptomyces venezuelae
MARQLTYDQRIALINKWRNPPGASEQLRLERAERMVKQAVARHEPFQGLDITVASKGSYPNNTNVRGDSDVDIMVKLNDPFHTEGLAAWWFGQQASYAGPWTRQKLRQEVEDALTNHFGSVDTDHNLALYVPEVVGSRPSIDVVPCFKWVAYDTTAPGGKYVGSVVYGRNGKRVINWPDLQLTNGRTKNTNTKYRYKFAVRVLKNVENDLASEGVITALPSYFSECLIYNVPDHVMLGVDSLDEVVRESLREVYRQLTGAWFSSQRMVEPNGIKKVFGEGQKWTEKDARELIEGAWYYLNYEG

SEQ ID NO: 1290 - protein, 291 aa, Streptomyces sp.
MINKWKNPPGASEQLRLERAERMVKQAVLRHEPFQGLDITVASKGSYPNNTNVRGDSDVDIMVKLNHPFHTEGPAAWWFGQPARYTGPWTRQKLRQEVEDALTNHFGWVDTDHNLAVYVPEVVGSRPSIDVVPCFKWVAYDTTAPGGEYVGSVVYGRNGKRVINWPELQLANGRTKNTNTKYRYKFVVRVLKNVENDLASESVIKALPSYFSECLIYNVPDDVFLREGSLDAVVRESLREVYRQLTGVWFGYQRMVEPNGIKKVFGEGQKWTEKDARELIERAWYYLNYES

SEQ ID NO: 1291 - protein, 299 aa, Streptomyces sp.
MTYEQRIALINKWKNPPGASEQLRLERAERMVKQAVLRHEPFQGLDITVASKGSYPNNTNVRGDSDVDIMVKLNDPIHTEGLAAWWFAQPARYAGPWTRQKLRQEVEDALTNHFGWVDTDHNLAVYVPEVVGSRPSIDVVPCFKWVAYDATAPGGECVGSVVYGRNGKRVINWPELQLVNGRTKNTNTKYRYKFVVRVLKNVENDLASEGVIKALPSYFSECLIYNVPDDVLLLDGSLDTVVRESLREVYQQLTGAWFSSLRMVEPNGIKKVFGESQKWTEKDARELIERAWHYLNYEN

SEQ ID NO: 1292 - protein, 291 aa, Streptomyces sp.
MINKWKNPPGASEQLRLERAERMVKQAVLRHEPFQGLDITVASKGSYPNNTNVRGDSDVDIMVKLNDPIHTEGLAAWWFAQPARYAGPWTRQKLRQEVEDALTNHFGWVDTDHNLAVYVPEVVGSRPSIDVVPCFKWVAYDATAPGGECVGSVVYGRNGKRVINWPELQLVNGRTKNTNTKYRYKFVVRVLKNVENDLASEGVIKALPSYFSECLIYNVPDDVLLLDGSLDTVVRESLREVYQQLTGAWFSSLRMVEPNGIKKVFGESQKWTEKDARELIERAWHYLNYEN

SEQ ID NO: 1293 - protein, 291 aa, Streptomyces sp.
MINKWKNPPGASEQLRLERAERMVKQAVLRHEPFQGLDITVASKGSYPNNTNVRGDSDVDIMVKLNDPIHTEGLAAWWFGQPARYAGPWTRQRLRQEAEDALTNHFGWVDTDHNLAVYVPEVVGSRPSIDVVPCFKWVAYDTTAPGGEYVGSVVYGRNGKRVINWPELQLVNGRTKNTNTKYRYKFVVRVLKNVENDLAAEGVIKALPSYFSECLIYNVPDNVLLLDGSLDAVVRESLREVYQQLTGAWFSYLRMVEPNGIKKVFGEGQKWTEKDARELIERAWHYLNYES

SEQ ID NO: 1294 - protein, 291 aa, Streptomyces sp.
MINKWKNPPGASEQLRLERAERMVKQAVLRHQPFQGLDITVASKGSYPNNTNVRGDSDVDIMVKLNDPIHTEGLAAWWFGQPARYAGPWTRQKLRQEVEDALTNHFGWVDTDHNLAVYVPEVVGSRPSIDVVPCFKWVAYDTTVPGGEYVGSVVYGRNGKRVINWPELQLANGRTKNTNTKYRYKFVVRVLKNVENDLASEGVIKALPSYFSECLIYNVPDNVLLLDGSLDSVVRESLREVYQQLTGAWFSYLRMVEPNGIKKVFGEGQKWTEKDARELIERAWYYLNYES

SEQ ID NO: 1295 - protein, 269 aa, Streptomyces sp.
MVKQAVLRHEPFQGLDITVASKGSYPNNTNVRGDSDVDIMVKLNDPIHTEGLAAWWFGQPARYAGPWTRQRLRQEVEDALTNHFGWVDTDHNLAVYVPEVVGSRPSIDVVPCFKWVAYDTTAPGGEYVGSVVYGRNGKRVINWPELQLVNGRTKNTNTKYRYKIVVRVLKNVENDLAAEGVIKALPSYFSECLIYNVPDNVLLLDGSLDAVVRESLREVYQQLTGAWFSYLRMVEPNGIKKVFGEGQKWTEKDARELIERAWRYLNYES

SEQ ID NO: 1296 - protein, 263 aa, Streptomyces sp.
MVKQAVRRHEPFQGLDITVASKGSYPNNTNVRGDSDVDIMVKLNNPFHTEGMATWWFGEQGPWTRQRLRQEVKDALTNHFGSVDTDHNLSFYVPEVVGSRPSIDVVPCFKWVAYAPGREYVGSVVYGRDGKRVINWPELQLANGRTKNTNTNRRYKFVVRVLKNIENDLASEGVIKALPSYFSECLVYNVPDDVLLHDGSLDVVVRESLREVYRQLTGGWVSYLRPMVEPNGIKKVFGGDQKWTEKDGRELIEHAWHYLNYES

SEQ ID NO: 1297 - protein, 267 aa, Streptomyces scabiei
MVKEAVIAHGPFQGLDIAVAAKGSYPNKTNVRGDSDVDIMVKLNDPFHTDGMAEWWFGQPAGYRGPWTKAKLREEVHAALTDYFGCVDADHNLAFYVPEVAGSRPSIDVVPCFKWVKYDFAAPGGEYVGSVVYGRNGKKVINWPELQLANGRTKNTDTNLRYKFVVRVLKSVENDLAAEGVIKALPSYFSECLIYNVPDHVLLTGDFDDAIRASFQEVYRQITTFFGPQRMWEPNGMKKVFGEGQKWNEKDARELIEGAWHYLGYED

SEQ ID NO: 1298 - protein, 270 aa, Streptomyces rimosus
MVEDAVDRHQPFQGLDITVEAKGSYPNKTNVRGDSDVDIMVKLNKPFHTDGLEPWWLGQRTQHAGPWTAARLREEVHAALSNHFGWVDADHNLAFYVPEVSGSRPSIDVVPCFKWVKYDITAPEGEYVGSVVYGRDGKRVINWPELQLANGCAKNTNTNQRYKFVVRVLKNAENDLAAEGVIEAMPSYLSECLIYNVPDHVLRAGDFDDAVRLSLQEVYRQLTAVFLGPQLMVEPNKIKRVFGEGQKWDEKQARELIEGARHYLGYGDRQ

SEQ ID NO: 1299 - protein, 270 aa, Streptomyces sp.
MVKDAVDRHQPFQGLDITVASKGSYPNKTNVRGDSDVDIMVKLNKPFHTDGLESWWFGQRTQHTGPWTAALLREEVHAALSNHFGWVDADHNIAFYVPEVSGSRPSIDVVPCFKWVKYDITAPEGEYVGSVVYGRDGKRVINWPELQLANGCTKNTDTKQRYKFVVRVLKNAENDLASQGVIEAAPSYLSEFLIYNVPDHVLLAGDFDDAVRLSLQEVYRQLTAVFLGPQLMVEPNEIKRVFGEGQKWDEKQARELIEGAWHYLGYADRQ

SEQ ID NO: 1300 - protein, 300 aa, Streptomyces sp.
MAHQLTYEQRIALLNKWKNPPGPSEKLRLDRAERMVRDAIARYAPFQGLAITVDPKGSYPNNTNVRSDSDVDIKVQMNECFFYDGASWLAKPDRYSGQWTPEKLRAEVEQALVQHFGAIDTDHNIAFNVPEVAGSRPSTDVVPCFKYVLYDSTAVGGHYEGSVVYGRDGKKIVNWPELQLTNGRTKNTNTKLRYKFVVRVLKNVENDLAAQGVIKALPSYFSECLIYNVPDHAFLNGGFDDAIQASLREVHRQLTSTWFGAQGMMEPNGVKKVFGEGQKWDTKDARELIEGAWHYLGYGS

SEQ ID NO: 1301 - protein, 304 aa, Streptomyces sp.
MVEDSVGRQLTTYERLALISKWKSPPGPSEERRLKRAEDMVRAAIDQHAAFYGVNIHVEAKGSYPNNTNVRGDSDVDIKVQLNECFYYDGLVPILAGPDYTGPWTKDVLRREVYAALDAAFGNVDSDHNIAFYVPEVSGSRPSTDVVPCFKYVLYDGAAPGGKYEGSVVFGRDGKKIVNWPELQLANGRAKNTATHQRYKFVVRVLKNVENDLTAEGVIEALPSYFSECLIYNVPNHVFMNRDLDDAVRASLVEVYRQLDSATERQLMKEPNEVKMLFGSEQKWSEQDALDLILHGWRYLNYGG

SEQ ID NO: 1302 - protein, 265 aa, Streptomyces sp.
MVRAAIDQHAAFYGVNIHVEAKGSYPNNTNVRGDSDVDIKVQLNECFYYDGLVPILAGPDYTGPWTKDVLRREVYAALDAAFGNVDSDHNIAFYVPEVSGSRPSTDVVPCFKYVLYDGAAPGGKYEGSVVFGRDGKKIVNWPELQLANGRAKNTATHQRYKFVVRVLKNVENDLTAEGVIEALPSYFSECLIYNVPNHVFMNRDLDDAVRASLVEVYRQLDSATERQLMKEPNEVKMLFGSEQKWSEQDALDLILHGWRYLNYGG

SEQ ID NO: 1303 - protein, 304 aa, Streptomyces albulus
MDRQLSVEERLERLLRWQRPAGAAEAERQRRAERLVREAVAAHGAFADLDIMVEAKGSYPNKTNVRNDSDVDIKVQINDPFHAQIDPQRFWFGGRWMHRYDGPWKPRVLRQELHAALENAFDTVDDSHNVAFCIPEVPGSRPSADVVPCFKYVQFTDESLSQSIEGSIVYCRDGTEIVNWPHQQLVNGRAKNERTNHRYKFVVRVLKSVENDLAEQKVIDPLPSYFSECLVYNVPDHVLAAGSFDDAVREALQHLQRSLHPWLMEPKSLVEPNGIKPLFGRGQKWQPADGRKLVRAAWTYLNYG

SEQ ID NO: 1304 - protein, 265 aa, Streptomyces albulus
MAAHGAFADLDIMVEAKGSYPNKTNVRNDSDVDIKVQINDPFHAQIDPQRFWFGGRWMHRYDGPWKPRVLRQELHAALENAFDTVDDSHNVAFCIPEVPGSRPSADVVPCFKYVQFTDESLSQSIEGSIVYCRDGTEIVNWPHQQLVNGRAKNERTNHRYKFVVRVLKSVENDLAEQKVIDPLPSYFSECLVYNVPDHVLAAGSFDDAVREALQHLQRSLHPWLMEPKSLVEPNGIKPLFGRGQKWQPADGRKLVRAAWTYLNYG

SEQ ID NO: 1305 - protein, 307 aa, Kitasatospora sp.
MVTPLTLVQRQALLRKWIMPASVTEDEYWKRAARMVDEAIAAHPAFAPVRSKLKVYAKGSYPNNTNVRANSDVDISVQLNEPQYADYHPMTNHWQRRQRLPDYEGIWTPALLRAEVGKALTAKFGTIDTSHRVAFYVPPVFNSRPSIDVVPAFRYVQFTNPQCTEGTEGSMVHCTDGKTIVNWPQQQMDNGRAKSTRTNNRYKYVVRVLKSVEDTLTAGKVIDEVPSYFSECLVYNVPDSVLTFGDFDASVRETLRHLDRELGYWMGHYQTMVEPNGIKKLFGDEQKWSVATAREFVKQSMTYLNYG

SEQ ID NO: 1306 - protein, 305 aa, Streptacidiphilus jeojiense
MGRQLTEVERIILLQKWIAAPTQAEADRLERAQRMVNGAVRAHPAFAGLDLTVKGKGSYANNTNVRFDADVDVKVQLNRPHYRGFGMLGFWPWAIDNAEASQGPWTPARFREELGLALKACFNDVDANHNVAFYVPPVPGSRPSADVVPCFAFRQYRDFGGSSFDEGSVVFTRDGGRVINWPEQQLANGIAKNNRTKRRYKFAVRALKQVENAVAADGLITALPSYFSECLIYNVPDSVLLADSLDTALHGALAHLRRDLNWWSGGWRDQLEPNEMKKVFGEGQKWTIQDGRQLIEAAFYYLNYG

SEQ ID NO: 1307 - protein, 307 aa, Streptomyces rubidus
MRLTPQQRVNKLARWTSPPSAAEEARLDRARRMVTDAVKRHPPFAGLGLVVEAKGSWANNTNVSSDSDMDIKVEFTQRIFRGSAAGMSFWDLSLQNSGYTGLWTPEKFRSELQVALRRTSNAVDAGHNVAFYVPSVPGSRPDTDVVPCFTYMYSPVFGAPNRGTVVFTKDGKHIVNWSQQQLDNGRAKNTRTGRRYKLAVRALKAVENDLAALGVIKDLPSYFMECLIYNVPDPVLKNALSLDLAFQAALMHLKGQFTFWSLTATPDAMVEPNGIKKLFGSGQKWTKDDARHLVTAAWDYLGYGVPR

SEQ ID NO: 1308 - protein, 266 aa, Streptomyces kanamyceticus
MVRAAVAAYGPFRGLDVKVDAKGSYPNSTNVRGDSDVDTKIQVNNPYYINGSPSWDAPLGLREPPLAVWPPEHLREHAHAALAEFFGTVDADHNVAFYVPEVAGSRPSIDVVPCFKYRKFHDCRWIDGSIVHARDGQQIINWPEQQLANGCAKNVRTGHRYKIVVRVLKNVENNLADEGVIAALPSYFSECLIYNVPDDVLKAGSLDDAVRNSLSYLDTAMHSLIRALLMVEPNEVKKLFGPGQKWNEKDALDLIEGAWHYLGYGD

SEQ ID NO: 1309 - protein, 300 aa, Rhodococcus fascians
MNLVERQAILRRWVMPSSDYEKDKQDRALRMVKSAIDAWPAFNGVSYHIYAKGSYANNTNVRLDSDVDIAVQNRECLYYEYNGCEQPSSEGTPTYDGDWTPPLWRAEILAALDAKFPGEVSGSGVVAITIDEHDGTRPDIDVVPSFDYVRYDSSDQTRQHRGSKVFPKTGSPIVNYPQQQLDRGTAKNGRTNGRYKRFARALKSAENQLVADGTISDLPSYFMECLVWNVQDEILTGGSDLSAGFKSVLVWLWNGLKEENYVRTDWEEPNGLKYLFHPGAKWTPGDARELVLATWQYLDY

SEQ ID NO: 1310 - protein, 286 aa, Rhodococcus fascians
MPSSDYEKDKQDRALRMVKSAIDAWPAFNGVSYHIYAKGSYANNTNVRLDSDVDIAVQNRECLYYEYNGCEQPSSEGTPTYDGDWTPPLWRAEILAALDAKFPGEVSGSGVVAITIDEHDGTRPDIDVVPSFDYVRYDSSDQTRQHRGSKVFPKTGSPIVNYPQQQLDRGTAKNGRTNGRYKRFARALKSAENQLVADGTISDLPSYFMECLVWNVQDEILTGGSDLSAGFKSVLVWLWNGLKEENYVRTDWEEPNGLKYLFHPGAKWTPGDARELVLATWQYLDY

SEQ ID NO: 1311 - protein, 286 aa, Unknown
  Description of Unknown: Rhodococcus sequence
MPSSDYEKDKQDRALRMVKSAIDAWPAFNGVAYHIYAKGSYANNTNVRLDSDVDIAVQNRECLYYEYNGCEQPSSEGTPTYDGDWTPPLWRAEILAALDAKFPGEVSGSGVVAITIDEHDGTRPDIDVVPSFDYVRYDSSDQTRQHRGSKVFPKTGSPIVNYPQQQLDRGTAKNGRTNGRYKRFARALKSAENQLVADGTISDLPSYFMECLIWNVQDEILTGGSDLSAGFKSVLVWLWNGLKEENYVRTDWEEPNGLKYLFHPGAKWTPGDARELVLATWQYLDY

SEQ ID NO: 1312 - protein, 286 aa, Rhodococcus sp.
MPSSDYEKDKQDRALRMVKSAIDAWPAFNGVSYHIYAKGSYANNTNVRLDSDVDIAVQNRECLYYEYNGCEQPSSEGTPTYDGDWTPPLWRAEILAALDAKFPGEVSGSGVVAITIDEHDGTRPDIDVVPSFDYVRYDSSDQTRQHRGSKVFPKTGSPIVNYPQQQLDRGTAKNGRTNGRYKRFARALKSAENQLVADGTISDLPSYFMECLIWNVQDEIVTGGSDLSAGFKSVLVWLWNGLKEENYVRTDWEEPNGLKYLFHPGAKWTPGDARELVLATWQYLDY

SEQ ID NO: 1313 - protein, 286 aa, Rhodococcus sp.
MPSSDYEKDKQDRALRMVKSAIDAWPAFNGVSYRIYAKGSYANNTNVRLDSDVDIAVQNRECLYYEYNGCKQPSSEGTPTYDGDWTPPLWRAEILAALKAKFPGEVSGSGNVAITIDEHDGTRPDIDVVPSFDYVRYDSSDQTWQHEGSKVFPKTGLPIVNYPQQQLDRGTAKNGRTNGRYKRFARALKSAENQLVLNDAINDLPSYFMECLIWNVPDATLMSGLDLSAGFRSVLVWLWNGLKEENYVRTDWEEPNGLKYLFRAGAKWTPGKARELVLETWQYLDY

SEQ ID NO: 1314 - protein, 304 aa, Geodermatophilus brasiliensis
MSSLSAADRATLLSSWIKPSSDNEKTQQDCAERMIADAIKAHPAFSDIDIRVFAKGSYANNTNVRRDSDVDIVVENRDCFYYEFFGCDAPPAGTIPGYSGQWTPDLWRREVTAAIVNYFGRNDVDTSGSVALAVSERPGSRPSADVVPSFQFHRYDTTDRSVCHEGTRVFKKGSSSRYIDNWPQQQLNNGRAKNTATSRRYKNYARALKNAENYLVKAGAMDAKPSYLMECLAWNVPNSTLSTGDLDGGFRSTLVWLWEHLNDQYKYEEWDEPNGLKYLFCHEQKWTRKDAQEIVLKTWDLLDY

SEQ ID NO: 1315 - protein, 295 aa, Mycobacterium sp.
MSRSSQSEDERMDRAQRMVAAAIEAHPAFDGYRSSIAVYAKGSYANLTNVRADSDVDVVVENRDLYYFCYVPADIAPSPDPRRAPYQGRWNSEDEWRAEVTAALVNKFGATDVDTSGEVAIAVTEVPGSRPSADVVPSFEFRRFDTPDRRIVHVGSRVFKKTNGHIDNYPAQQLANGRAKDAATGGRYKKYVRALKNAENHLAAAGVIDDLPSYFMECLVFNVPDVVMTTGYSLDEGFRATLRYLIVGLYGKSYREGDWVEPNRLKYLFRGNDKWSPEDGMFLAYRAWEYLGYAA

SEQ ID NO: 1316 - protein, 284 aa, Mycobacterium sp.
MDRAQRMVAAAIEAHPAFDGYRSSIAVYAKGSYANLTNVRADSDVDVVVENRDLYYFCYVPADIAPSPDPRRAPYQGRWNSEDEWRAEVTAALVNKFGATDVDTSGEVAIAVTEVPGSRPSADVVPSFEFRRFDTPDRRIVHVGSRVFKKTNGHIDNYPAQQLANGRAKDAATGGRYKKYVRALKNAENHLAAAGVIDDLPSYFMECLVFNVPDVVMTTGYSLDEGFRATLRYLIVGLYGKSYREGDWVEPNRLKYLFRGNDKWSPEDGMFLAYRAWEYLGYAA

SEQ ID NO: 1317 - protein, 310 aa, Nocardioides sp.
MTMSDADRNALVERWTLKSSPSEQNTMVRAERMIREAIDQHPPLQEDRGSLHVYAKGSYANRTNVRRDSDVDIVVENRRLYYSDYIDTKTAHAAVLDPYATDYTGVWIPETWRDEVENALRSYFGLRDVDTTGDVAVTIAAVPGSRPSSDVVPAFEYRRFDSADRRATHHGSKVFKKSGGAIINYPFQQLENGNAKDRRTGGKYKEFARALKNGENALVEAGLMGAKPSYLMECLAYNIPDADLTPGFTHSSWFQHALATLFNRLRQQEYAHDDWVEPNELKWLFSPAQRWSVDDARELASRLWDFLDYP

SEQ ID NO: 1318 - protein, 302 aa, Rhodococcus aetherivorans
MSASERAELLGRWIQPSSENEQAQQERAESMVRKAITTCDALDGANVVIYTKGSYPNNTNVRRDSDVDVVIELHDCLYYDYKPGVIGVEPPPPPYQGAWTPENWRQVVVDALAMAFGPDSIDASGRVAINISAVEGSRPSADVVPSFNYRRYDDPNRTLWHEGSCVFPTDGGSKIVNWPQQQLDNGRSLNTATNHRYKKYVRALKNAENFLAAEGAIGELPSYFMECLVYNVPAAILTTGDLDEGFRATLAHLWGLLEAEESEREMVEPNRMKWLFTSDKKWSIQDGKDLVLATWGHLGYGG

SEQ ID NO: 1319 - protein, 302 aa, Rhodococcus sp.; identical to SEQ ID NO: 1318

SEQ ID NO: 1320 - protein, 272 aa, Rhodococcus aetherivorans
MVRKAITTCDALDGANVVIYTKGSYPNNTNVRRDSDVDVVIELHDCLYYDYKPGVIGVEPPPPPYQGAWTPENWRQVVVDALAMAFGPDSIDASGRVAINISAVEGSRPSADVVPSFNYRRYDDPNRTLWHEGSCVFPTDGGSKIVNWPQQQLDNGRSLNTATNHRYKKYVRALKNAENFLAAEGAIGELPSYFMECLVYNVPAAILTTGDLDEGFRATLAHLWGLLEAEESEREMVEPNRMKWLFTSDKKWSIQDGKDLVLATWGHLGYGG

SEQ ID NO: 1321 - protein, 272 aa, Rhodococcus phenolicus
MVRKAITTCEAFDGANVVIYTKGSYPNNTNVRRDSDVDVVIELQDCLYYDYKPGVIGVEPPPPPYQGSWTPGSWRQAVIDALVTAFGPGSIDTSGRVAINISAVEGSRPSADVVPSFNYRRYDDSHRTLWHEGSCVFPTDGGSKIVNWPQQQLDNGRSLNTATNHRYKKYVRALKNAENFLAAEGTIDELPSYFMECLVYNVPAAILTTGDLDAGFRATLAKLWGLLESEENERQMVEPNRMKWLFTSDKKWSIQDGKDLVLATWSHLGYGG

SEQ ID NO: 1322 - protein, 302 aa, Rhodococcus fascians
MSATARAELLSSWIKPSSENERLQQERAESMVRKAITNCDAFDGINLLIYTKGSYPNNTNVRRDSDVDVVVEFHGCLYYDYKAGVVGAEPPVTPYRGPWTPQKWRQAVVDALIAAFGADSVDTSGRVAINISAVEGSRPSADVVPSFLYRRYDNPDRTIAPEGSCVFPTDGGNKIVNWPQQQLDNGRNLNTQTNHRYKNYVRALKNAENYLATAGTIDELPSYFMECLVFNTPASTLTTGDLDDGFRATLSSLWGLLESEDSKRAMVEPNWMKWLFTEDKKWSIQDGKDLVLATWNHLGYGS

SEQ ID NO: 1323 - protein, 302 aa, Unknown
  Description of Unknown: Rhodococcus sequence
MSATARAELLSSWIKPSSENERLQQERAESMVRRAITTCDAFDGINPLIYTKGSYPNNTNVRRDSDVDVVVEFHGCLYYGYKAGVVGAEPPLTPYQGAWTPQKWRRAVVDALIAAFGADSVDTSGRVAINISAVEGSRPSVDVVPSFLYRRYDNPDRTIAPEGSCVFPTDGGNKIVNWPQQQLDNGRNLNTQTNHRYKNYVRALKNAENYLATAGTIDELPSYFMECLVFNAPASTLTTGDLDDGFRATLSSLWGLLESEDSKRAMVEPNWMKWLFTEDKKWSIQDGKDLVLATWNHLGYGS

SEQ ID NO: 1324 - protein, 304 aa, Unknown
  Description of Unknown: Rhodococcus sequence
MGMSASARTELLSRWIKPSSENEQVQQERAEDMVRKAITTCNAFDGTNVLIYTKGSYPNNTNVRRDSDVDVVIELRDCLYYGYKAGVTGAAPPPPPYQGSWTPESWRKAVVDALVVAFGSDSVDTSGRVAINISAVEGSRPSADVVPSFDYRRYDNSDRTISKEGSCVFPTDGGSKIVNWPQQQLDNGRSLNTETNHRYKNYVRALKNAENFLATAGTIDELPSYFMECLVYNVPASTLTTGDLDEGFRATLVSLWSLLESEESERKMVEPNWMKWLFTSDKKWSVQDGKDLVLATWGHLGYGS

SEQ ID NO: 1325 - protein, 302 aa, Rhodococcus sp.
MSASDRAELLNRWIKPSSENEQQQQARAEDMVRKAITTCGDFDGSNVLVYTKGSYPNNTNVRRDSDVDVAVELQDCLYYDYKPGITGIEPPPRPYQGEWTPRTWRNAVVNALVEAFGKESVDTSGKIAINISAVEGSRPSADVVPSFDYRRYDNPERTVSWEGSCVFPTDDGAKVVNWPQQQLDNGRNLNTRTNYRYKKYVRALKNAENFLAAQGTIDELPSYFMECLVFNVDESTLTRGSLDEGFEATLLELFLLLEEEENERLMVEPSRMTWLFTHDKKWSVEDGMALVLATWRHFGYGS

SEQ ID NO: 1326 - protein, 304 aa, Jiangella alkaliphila
MAMLPAARQLLLSNWIQPSSANEQQQQERAERMVREAIDGSTAFSGSTLKIYTKGSYPNNTNVRRDSDVDVVVELQDCQYYEYLEGRSPAGRKHSPYVGPWTPATWRSAVRAALEAKFGKDSVDTSGTVAINVSAVPNSRPSADVVPSFAFIRYDDPAGITFHEGSCVFPTDGAQKIQNWPRQQLRNGRNLNDRSGRRYKEYVRALKNAENRLSADQVIKDLPSYFMECLVYNVPVATLKYGSLDDGFRETLAYLWENLDNGVAYADWVEPNELKWLFKGHQKWSVGDGKDLVMAAWNYLGYGS

SEQ ID NO: 1327 - protein, 315 aa, Streptomyces viridochromogenes
MQINLIWGESVTALEEKLNRYKARSSNTEQEKQGRAERMVRAAVNGWSGFADVTLSFLPKGSYKNNTNVRADSDVDIAVIHGGFHYFNDSALREGDKIVRRPITCKRYAGAEFRAELEKAMCAAYGADCDTSGSTAIEIAENGGRVKADVVPSFQHRNYYYDTQGNVRYFEGTTTLRTNGEWVINYPEQQYANGVAKNDSTRTGKRYKQIVRILKRVENDLVAAGKIEALPSYFMECLVYCVPDSLFNHQSDTPLTDDFTAIVRHIWNKTKPDGDGKNWYEPNGIKPLFGERQKWSMDDAHRLMLKTWHHLGLGD

SEQ ID NO: 1328 - protein, 277 aa, Streptomyces viridochromogenes
MVRAAVNGWSGFADVTLSFLPKGSYKNNTNVRADSDVDIAVIHGGFHYFNDSALREGDKIVRRPITCKRYAGAEFRAELEKAMCAAYGADCDTSGSTAIEIAENGGRVKADVVPSFQHRNYYYDTQGNVRYFEGTTTLRTNGEWVINYPEQQYANGVAKNDSTRTGKRYKQIVRILKRVENDLVAAGKIEALPSYFMECLVYCVPDSLFNHQSDTPLTDDFTAIVRHIWNKTKPDGDGKNWYEPNGIKPLFGERQKWSMDDAHRLMLKTWHHLGLGD

SEQ ID NO: 1329 - protein, 305 aa, Streptomyces sp.
MTALEEKLTRYKARSSNTEQEKQERAERMVRAAVNSWRGFDDVSLSFLPKGSYKNNTNVRADSDVDIAVIHGGFYYFNDSALREGDKIVRHPITCNRYDGAEFREELEKAMCSAYGSDCDTSGSTAIEIAENGGRVKADVVPSFQHRKYYYDTQGNVRYFEGTTTRRTNGEWVINYPEQQYANGVAKNDSNRTGKRYKQMVRILKRVENDLVVAGEIEALPSYFMECLVYCAPDALFNHQGKTPLTEDFSAVVSHIWNKTKPDGEAKGWYEPNGIKPLFADGQKWSIEQAHQLALKTWQHLGLGS

SEQ ID NO: 1330 - protein, 303 aa, Streptomyces melanosporofaciens
MTALEDKLGRYTAPSSDTEQEKQDRAERMVRKAVEGWSGFDGVGIRFLPKGSYKNNTNVRADSDVDIAVIHKGFHYLNDDALRPSDKIVRHPVTGKRYEGAAFRAELEAAMRSAYGSDCDTSGSTAIEIAENGGRVKADVVPSFEHRKYYYDAQGRVRYFEGTTTRRTNGEWVINYPEQQYDNGVEKNERGTGRRYKRMVRILKRVENDLVAAGKIEALPSYFMECLVYCVPNGRFNHGGLTPLTDDITAVVAHIWSQTKPDGLAKDWYEPNGIKPLFGPGQKWSMDDAHTLALETWQNLGLK

SEQ ID NO: 1331 - protein, 303 aa, Streptomyces sp.
MTALEDKLTRYTAPSSDTEQDKQDRAERMVRKAVESWSGFDGIGIRLLPKGSYKNNTNVRADSDVDIAVIHKGFNYFNDDALRQEEKIVRRPLTGRRYEGAAFRSELEKAMKHAYGSDCDTSGSTAIEIAENGGRVKADVVPSFQHRKYYYDTMGEVRYFEGTTTRRTNGDWVVNYPEQQYDNGVEKNERGTGRRYKRMVRILKRVENDLVAAGKIEALPSYFMECLVYRVPDGRFNHGGLTPLTDDIAAVITYIWNQTKPGGSAKDWNEPNGIKPLFGPGQKWSMEEAHELALKAWQNLGLS

SEQ ID NO: 1332 - protein, 303 aa, Unknown
  Description of Unknown: Streptomyces sequence
MTTLEDKLTRYKAPSSNTEQDKQERAERMVRKAVEGWSGFDGISIRFLPKGSYKNNTNVRADSDVDIAVIHKGFHYFNDDALRPADKIARHPITSKHYDGAEFRAELEKAMRAAYGSDCDTSGSTAIEIAENGGRVKADVVPSFEHRKYHYDTMGRIQYFEGTTTRRTNGEWVINYPEQQYANGVAKNNRTGMRYKQMVRILKRVENDLVAVGEIEALPSYFMECLVYCTPDGHFNHGGLTPLTDDITHIIRHIWNQTKPGASAEDWHEPNDIKPLFGPGQKWSMEDAHELTLKTWQNLGLDS

SEQ ID NO: 1333 - protein, 303 aa, Streptomyces virginiae
MTALEDKLTRYKAPSSNTEQEKQERAERMVRKAVEGWSGFDGIDTRFLPKGSYKNNTNVRTDSDVDIAVIHKGFHYFNDDALRPADKIVRHPITSRHYGGAEFRAELEKAMRAAYGSDCDTSGSTAIEIAENGGRVKADVVPSFEHRRYYYDNMGTVRYFEGTTTRRTNGEWVINYPEQQYVNGVAKNNRTGMRYKQMARILKRVENGLVAADEIEALPSYFMECLVYCTPDGHFNHGGLTPLTDDFTHVIRYIWNQTKPGASAKDWREPNGIKPLFGPGQKWSVGDAHELTLKTWQNLGLGN

SEQ ID NO: 1334 - protein, 320 aa, Rhodococcus sp.
MIHNETYIDNRRKYAMTALEDKLNRYRQPSSNSEKDKQERAERMVKQAVDKWAEDYDKISFRYVSKGSYANNTNVRQDSDVDISVLRTDFHYFDTSALSAADAKTSDGVTYPMMGIAMRNSLAQSIKSRFGSDSDTTGSTAIELHENSGRVSADIVPSFSFRKYYYDALGNISYHGGQKVFKTDGTSVVNYPDQQLLNGRTKNVATGSLYKEMVRILKRAENDLVAAGTIEPLPSYLMECLMYNVPNSHFQSMNSNPLTDILTNAIAHIWSATNPDGEAINWYEPNGIKPLFKGKQKWTMDDANKLAFETFRLFNLRDAS

SEQ ID NO: 1335 - protein, 306 aa, Nocardia vaccinii
MSALEEKLKRYCEPSSQNEQDMQDRAERMVRRAVGSWASYWGETNLKYVPKGSYANNTNVRQDSDVDIAVVRTAFWYIDDSALMPADKVMRSHRDYPFEGIEFRNDLAVFLKSEWGDGCDTTGTTAIELVENTGRVKADIVPSFKFCKYDYDADGRVVQHCGQKVFRTDGTSVVNYPDQQLENGRAKNVATGGRYKKLVRILKRAENELVKSGHLEALPSYFMECLMYRVPNDYFGHTGDSGLTDDLTAAIAYIWSATNPGAPAQGWKEPNEIKPLFGLGQKWAMDDAHNLMLHVFGLFDLGEEAA

SEQ ID NO: 1336 - protein, 302 aa, Actinobacteria bacterium
MDWENWLRVAAEPPSDNEDDKRQRTETQIRDALADYEGLQGRPYIVYAKGSYANNTNVRLNYDVDIAVEYRGFFYFDLCFDFEDSGPTDVGITTPSKDPYTRTDFKRDIRAALVKAFGENAIEDGTVAYRVREKKTTLPADVVPCWEYRRYDHLVNGRPTYHEGARIYPTSGGYKNNFPKRQLTNGRDKNKRTGYRYKRMVRALKKLETRLVADGKLAAELPSYLTECLVYNVSDVVFGHTAFKADMREVLAQIFNATLATGNSDDWEHVHGLLYLFRGSTEWTTQDVHAMADAAWDELGFE

SEQ ID NO: 1337 - protein, 298 aa, Arthrobacter sp.
MTNWEDWLKTAAQPPSNHEDDKWQRTLAQVKTSLDAHEPLKGRPWRVYAKGSYANNTNVRLNFDVDIAVEYHGFFYYDLEFGLKGKDKSVVGVVDSDDPYTRDQFKKDIHDALIESFGTDSVEVGDIAYRIRNGKTTLPADVVPCWEYRRYDSEQTVHHGARIYTGSGKIVNNFPHHQLENGTSKNLATSRRYKRMARALKKLQTKMLDAGEVKDELPSYLIECLVYNVPNGSFGADTYTADMRWVLATIFNSTLVGGDWNDWEEVNGLKYLFRGDAKWTREQVHTFADAAWNHMGYE

SEQ ID NO: 1338 - protein, 301 aa, Mycobacterium abscessus
MDWETWLRAAAQRPSDNETQKRDRTEQEIRDALSAYDSLRGRPYRVYAKGSYANNTNVRLNFDVDIAVEYGGYFYSDLAFELQGQDKSVVGVVSSDDPYTTDEFKADILGALRQAFGKTAVAEGNIAYRVRESKTTLPADVVPSWEYRRYDRIANGQPVFHRGSRVFPRNGSWKNNFPALQLHNGRQKTSDTGRRYKRIVRALKKLQTKLVNEGLLRKELPSYLVECIVYNVPNDYFNHPTYLSDMREALAYIFNNTLAAGNWNDWHEVHELHYLFRGGSWTREEVHHLADVAWDHLGFED

SEQ ID NO: 1339 - protein, 305 aa, Rhodococcus sp.
MGNLVDWEAWLRSAAKRPSDNEESKRDRTEQQIRAALDDYGPLSGKYRVYVKGSYANNTNVRLNYDVDVAVEYTGYFYSDLCFDLQGHDDSEVGVYASYDTYSREDFKRDIKAALFETFGSDAIEIGKIAYRVRENKTTLPADVVPSWEYRRYDRIDAWGDPVVHVGSRVYPSTGGYKNNFPKIQVTRGTEKNDRTHRRYKRMVRCLKKMQTRLTDAGVLENELPSYLVECLVYNVPDSLFNNSTYLEDFRKVVGAIWGSTQPNGDWGEWEEVHGLHYLFKGSFAGMRADAHTLADKAWDEVGIE

SEQ ID NO: 1340 - protein, 306 aa, Candidatus Frankia californiensis
MATDWEKTLRAWVKPPSENEDAKRDRTEQEIRQAISDSDHLKDVGYKVYAKGSYANNTNVRLDYDVDIAIECTDFFYYDKTGAAADVRKAATLESKFIAYKGKYTSEVFKTAVEDALVAYYGRKAVTRGNMAMRVREKKTTLPADVVPCFEYHYVYDTDIYGDPVYYQGTRVYKDSGGYIHSWPVQQKERGNAKNNVTGRRYKRIVRALKRLESVLVAEEIIKDLPSFLIECLVYNVPNSSFNHTKYVDDMRSVLTAIYNETMSSGDYSEWLEVSERKYLFRPSQSWSRSDAHELAGKAWDYMGFE

SEQ ID NO: 1341 - protein, 304 aa, Candidatus Microthrix parvicella
MTTNWQSLFDSWAKPPSDTEIDERDHTEKQVKNALQAWPALARRNFRVFVKGSYWRATNVRRGADVDLAVELLGVAPMDQAFVVTKEFKAKGLTDAELNLTDAPPEYSRARATFKDDCLDALVDAFGPTMVERHNKCITVSEKSTTLPADVVPCTTHRRYDSRSVSSDGIQITPDHGPSIINWPQQDRDNGIAKNARTSRRYKRVVRGLKALEDLMAESGSPETPSWLVECLVYNVPDEVFDSSSNHINALTTLLWLHENLASTSGRGDWLEVNELKYLFTVSQPWSTQEASDFVARAMRLLTS

SEQ ID NO: 1342 - protein, 298 aa, Candidatus Izimaplasma sp.
MRNWDQIFSNWSSGPSSTEQTKIDNAVRQIRKAIDASEKLKDRNIDVFVQGSYKNRVNVSQDSDVDVGILCHNTFYWEVKEETDKEIVKSGISPATYDYAVFKREVFEALKDYFGHNAVNRGNKSIDVNENTYRVDSDVVPFFDYRYYTTTTNYLKGVKLLPDNRVPSEILNWPTQHYDNGVRKNGRTGRRYKRVVRIMKKLRNEMLERNIAQAKNIPSFLIECLVYNTPDNDLQYSSYKDTIRAVLAHLYNNTRTTTYCDKWTEVSGRKYLFTRNQGWTISGVHAFIAAAWNYVGYE

SEQ ID NO: 1343 - protein, 299 aa, Candidatus Izimaplasma sp.
MMRNWDQIFSNWSSGPSSTEQTKIDNAVRQIRKAIDASEKLKDRNIDVFVQGSYKNRVNVSQDSDVDVGILCHNTFYWEVKEETDKEIVKSGISPATYDYAVFKREVFEALKDYFGHNAVNRGNKSIDVNENTYRVDSDVVPFFDYRYYTTTTNYLKGVKLLPDNRVPSEILNWPTQHYDNGVRKNGRTGRRYKRVVRIMKKLRNEMLERNIAQAKNIPSFLIECLVYNTPDNDLQYSSYKDTIRAVLAHLYNNTRTTTYCDKWTEVSGRKYLFTRNQGWTISGVHAFIAAAWNYVGYE

SEQ ID NO: 1344 - protein, 328 aa, Yersinia kristensenii
MSLESTALCVINKMLFNTLLVAFQSKEYFVSRDWESVFATWSQGPSATEQERAENAERQIRQAIQASDKLKNRNIKVFTQGSYRNRVNVRRDSDVDVGVLCFDTYFPEYPDDNVKMELAKSFVPATYEYATFKSELEEALVARFGRSAVTRGSKAFDIKANTYRVESDVAAFFEHRRYVTATYYHSGVEMIPDDYDPPRVKNWPEQHYENGVSKNASTSRRYKRVVRVLKKLSNEMASNGIQSAKDAPSFLIESLVFNASNSCFEYQSFKPMVRHVLAELFNNTMSHEKCSEWGEVNELKYLFRGSQPWTRESAHQFLSDAWDYIGYE

SEQ ID NO: 1345 - protein, 299 aa, Yersinia kristensenii
MSRDWESVFATWSQGPSATEQERAENAERQIRQAIQASDKLKNRNIKVFTQGSYRNRVNVRRDSDVDVGVLCFDTYFPEYPDDNVKMELAKSFVPATYEYATFKSELEEALVARFGRSAVTRGSKAFDIKANTYRVESDVAAFFEHRRYVTATYYHSGVEMIPDDYDPPRVKNWPEQHYENGVSKNASTSRRYKRVVRVLKKLSNEMASNGIQSAKDAPSFLIESLVFNASNSCFEYQSFKPMVRHVLAELFNNTMSHEKCSEWGEVNELKYLFRGSQPWTRESAHQFLSDAWDYIGYE

SEQ ID NO: 1346 - protein, 292 aa, Unknown
  Description of Unknown: Yersinia pseudotuberculosis complex sequence
MSRDWESVFATWSQGPSATEQERAQNAERQIRQAIQASDKLKNRNIKVFTQGSYRNRVNVRRDSDVDIGVLCFDTYFPEYPDDNVKMELAKNSVPATYEYATFKSELEEALVARFGRDAVTRGSKAFDIKANTYRVESDVAAFFEHRRYVTATYYHSGVEMIPDDYDPPRVKNWPEQHYENGVSKNTYSLRRYKRVVRVLKTLSNEMASKGIQSAKDAPSFLIESLVFNASNSCFEYQSFKPMVRHILAELFNNTMSHEKCSEWGEVNELKYLFRSSQPWTRESAHQFLRRL

SEQ ID NO: 1347 - protein, 301 aa, Halomonas sp.
MNRDWESVFSAWSQGPGKTEQERVENTERQIKQAIQASDKLKNRNIRVFAQGSYRNRVNVRRDSDVDIGVLCFDTYFPEYPDDNVKMELAKSFVPANYEYVTFKNELEEALVSRFGRESVKRGSKAFDIKANTYRIESDVAAFFEHRRYLTTNYYHSGVEMIPDDYAPPRVRNWPEQHYQNGTSKNYATSRKYKRVVRILKNLSNEMASNGIQSAKEAPSFLIECLVFNASTSCFEHQTFKQTVRAVIAELFINTLSYDICSEWGEVSGFKYLFRGSQPWTRESAHQFLSDAWDYLGYESC

SEQ ID NO: 1348 - protein, 299 aa, Citrobacter braakii
MSRDWESVFATWSQGPSATEQERVENAERQIRQAIQASDKLKNRNIKVFTQGSYRNRVNVRRYSDVDVGVLCFDTYFPEYPDDNVKMELAKSFVPATYEYATFKSELEEALVARFGKAAVTRGSKAFDIKSNTYRVESDVAAFFEHRRYVTATYYLSGVEMIPDDFTPPRIKNWPEQHYENGVSKNTSTSRRFKRVVRVLKNLSNEMASKGIQSAKDAPSFLIESLVFNASSSCFEYQSFKPMVRHVLAELFNNTMSQEKCSEWGEVNELKYLFRSSQPWTRESAHQFLSDAWDYIGYE

SEQ ID NO: 1349 - protein, 299 aa, Citrobacter braakii; identical to SEQ ID NO: 1348

SEQ ID NO: 1350 - protein, 299 aa, Shewanella mangrovi
MSRDWESVFTTWSQGPGKTEQERADNAERQIRQAIQASDKLKNRNIKVFTQGSYRNRVNVRQDSDVDVGVLCFDTYFPEYPDDNVKMELAKSFVPATYEYATFKSELEEALVARFGRAAVTRGSKAFDIKANTYRVESDVAAFFEHRRYVTTTYYHSGVEMIPDDYDPPRVKNWPEQHYENGVSKNDATSRKYKRVVRVLKKLSNEMASNGIQSAKDAPSFLIECLVFNASNSCFQYQSFKQMVRAVLAELFNNTLSDEMCSEWGEVNELKYLFRGSQPWTRASAHQFLSDAWDYIGYE

SEQ ID NO: 1351 - protein, 299 aa, Vibrio nigripulchritudo
MSRDWESVFATWSQGPSKTEQERAENAERQIRQAIQASDKLKNRNIRVFTQGSYRNRVNVRQDSDVDVGVLCFDTYFPEYPDDNVKMELAKSFVPATYEYATFKSELEEALVARFGRAAVTRGSKAFDIKANTYRVESDVAAFFEHRRYVTANYHHSGVEMIPDDLDPPRVKNWPEQHYQNGVSKNDATSRRYKRVVRVLKKLSNEMASNGIQSAKDAPSFLIECLVFNASNSCFEYQSFKPMVRHVLAELFNNTLSYEKCSEWGEVNELKYLFRGSQPWTRASAHQFISDAWDYIGYE

SEQ ID NO: 1352 - protein, 299 aa, Vibrio cholerae
MSRDWESVFTTWSQGPSRTEQERAENAERQIRQAIQASDKLKNRNIRVFTQGSYRNRVNVRQDSDVDIGVLCFDTYFPEYPDDNVKMELAKSFVPATYEYATFKSELEEALVARFGRAAVTRGSKAFDIKANTYRVESDVAAFFEHRRYVTANYHLSGVEMIPDDLDPPRVRNWPEQHYQNGVSKNDATSRRYKRVVRVLKKLSNEMALNGIQSAQDAPSFLIECLVFNASNSCFEYQSFKPMVRHVLAELFNNTLSYEKCSDWGEVNELKYLFRGSQPWTRESAHQFISDAWDYIGYE

SEQ ID NO: 1353 - protein, 299 aa, Enterobacter cloacae
MSRDWESVFATWSQGPSATEQERVENAEKQIRQAIQASDKLKKRNIKVFAQGSYRNRVNVRRYSDVDIGVLCFDTFFPEYPDDNVKMELAKSFVPATYEYATFKSELEEALVAWFGRAAVTRGTKAFDIKSNTYRVDSDVAAFFEHRRYVTATSYLSGVEMIPDDYSPPRVKNWPEQHYENGVSKNTSTSRRFKRVVRILKNLSNEMASKGIQSANDAPSFLIESLVFNASNSCFEHQSFKPMVRHVLAELFNNTLSQEKCSEWGEVNELKYLFRSSQPWSRESAHQFLSDAWDYIGYE

SEQ ID NO: 1354 - protein, 299 aa, Enterobacter sp.
MSRDWESVFATWSQGPSATEQERVENAERQIRQAIQASDKLKKRNIKVFAQGSYRNRVNVRRYSDVDIGVLCFDTFFPEYPDDNVKMELAKSFAPATYEYATFKSELEEALVAWFGRAAVTRGTKAFDIKSNTYRVDSDVAAFFEHRRYVTATSYLSGVEMIPDDYSPPRVKNWPEQHYENGVSKNTSTSRRFKRVVRILKNLSNEMASKGIQSANDAPSFLIESLVFNASNSCFEHQSFKPMVRHVLAELFNNTLSQEKCSEWGEVNELKYLFRSSQPWSRESAHQFLSDAWDYIGYE

SEQ ID NO: 1355 - protein, 299 aa, Marinobacter sp.
MSRDWESIFTTWSQGPSKTEQERAENAERQIRKAIQASEKLKNRNIKVFTQGSYRNRVNVRQDSDVDIGVLCTDTYFPEYPDDNVKMELAKSFIPATYEYATFKNELEEALVARFGKTAVTRGSKAFDIKANTYRVESDVAVFFEHRRYVTSTYHHTGVEMIPDDYQSPSVKNWPEQHYQNGVSKNDANTRRYKRVVRVIKKLSNEMASKDIQSAKDAPSFLIECLVFNASTSCFEYQTFKPMVRAVLAELFNNTLSDDKCSGWGEVSELKYLFRASQPWTRESAHKFLSDAWNYIGYE

SEQ ID NO: 1356 - protein, 299 aa, Pseudoalteromonas sp.
MSRDWESVFTTWSQGPSKTEHERAENAERQIRQAIQASEKLKNRNIKVFTQGSYRNRVNVRQDSDVDVGVLCTDTYFPEYPDDNVRMELAKSFTPATYEYESFKNELEEALVARFGRVAVTRGSKAFDIKANTYRVESDVAAFFEHRRYVTSTYHYAGVEMIPDDYKPPSVKNWPDQHYQNGVAKNDATTRRYKRVVRILKKLSNEMASKEIKSAKDAPSFLIECLVFNASTSCFEYQTFIQMVRAVLAELFNNTLSDDKCSEWGEVSELKYLFRASQPWSRASAHQFLNDAWNYIGYE

SEQ ID NO: 1357 - protein, 299 aa, Pseudoalteromonas denitrificans
MSRDWESVFTTWSQGPSKTELERAENAEKQIRQAIQASEKLKNRNIKVFTQGSYRNRVNVRQDSDVDVGVLCSDTYFPEYPDDNVKMELAKSFIPATYEYATFKDELEEALVARFGRAAVTRGCKAFDIKANTYRVESDVAAFFEHRRYVTATSHHSGVEMIPDDFKPPRVKNWPDQHYQNGVSKNDTTTRRYKRIVRVLKKLSNEMASKDIQSAKDAPSFLIECLVFNASTSCFEDQTFKRIVRAVLAELFNNTLSDDKCSEWGEVNELKYLFRASQPWTRQSAHQFLSDAWDYIGYS

SEQ ID NO: 1358 - protein, 299 aa, Pseudomonas alcaliphila
MSRDWESVFSSWSQGPSQTEQARAENAERQIREAIRASDKLKNRDIRVFTQGSYRNRVNVRRASDVDIGVLCFDTYFPDYPDDNVKMELAKSFVPASYEYATFKNELEEALIARFGRVSVRRGSKAFDIKANTYRVESDVAAFFEHRRYVTTGFYHSGVEMIPDDYNPPRVRNWPEQHYNNGVSKNDATQRRYKRAVRILKSLSNEMALAGIQSAKDTPSFLIECLVFNASTPCFQYQTFKLMIRAILAELFNNTLSDELCSEWGEVSELKYLFRGSQPWTRKSAHQFLSDAWDYIGYQ

SEQ ID NO: 1359 - protein, 299 aa, Pseudomonas sp.
MSRDWESVFSSWSQGPSQTEQARAENAERQIREAIRASDKLKNRDIRVFTQGSYRNRVNVRRDSDVDIGVLCFDTYFPDYPDDNVKMELAKSFVPASYEYATFKNELEEALIARFGRASVRRGSKAFDIKANTYRVESDVAAFFEHRRYVTTGFYHSGVEMIPDDYNPPRVRNWPEQHYNNGVSKNDATQRRYKRAVRILKSLSNEMALAGIQSAKDTPSFLIECLVFNASTPCFQYQTFKSMIRAILAELFNNTLSDELCSEWGEVSELKYLFRGSQPWTRKSAHQFLSDAWDYIGYQ

SEQ ID NO: 1360 - protein, 299 aa, Unknown
  Description of Unknown: Vibrio sequence
MNRDWESVFTTWSQGPSKTEQERAENAERQIRQAIHDSEKLRNRNIKVFTQGSYRNRVNVRKDSDVDIGVVCFDTFFPVYPDDNVKAQLNKSFSDGVYTYALFKNELEEALVARFGREAVSRGSKSFDIKENTYRVESDVAAFFEHRRYTSVTHYLSGVEMIPDDYTPPRVRNWPEQHYQNGVAKNDATSRRYKRVVRILKTLCNEMASKKIKSAEDTPSFLVECLVFNASNECFGYQSFKPMVRAVLAELFNNTMNDQKCSEWGEVSELKYLFRSSQPWTRQGAHQFISDAWDYVGYE

SEQ ID NO: 1361 - protein, 299 aa, Vibrio alginolyticus
MNRDWESVFTTWSQGPSKTEQERAENAERQIRQAIHDSEKLRNRNIKVFTQGSYRNRVNVRKDSDVDIGVVCFDTFFPVYPDDNVKAELNKSFSDSVYTYALFKNELEEALVARFGREAVSRGSKSFDIKENTYRVESDVAAFFEHRRYTSVTHYLSGVEMIPDDYTPPRVRNWPEQHYQNGVAKNDATSRRYKRVVRILKTLCNEMASKKIKSAEDTPSFLVECLVFNASNECFGYQSFKPMVRAVLAELFNNTMNDQKCSEWGEVSELKYLFRSSQPWTRQGAHQFISDAWDYVGYE

SEQ ID NO: 1362 - protein, 299 aa, Shewanella baltica
MNRDWESVFTTWSQGPSKTEQERAENAERQIRQAIHASEKLKNRNIKVFTQGSYRNRVNVRKDSDVDIGVVCFDTFFPEYPDDNVKAELNKSFSDGVYTYALFKNELEEALVARFGREAVSRGSKSFDIKENTYRVESDVAAFFEHRRYTSVTHYLSGVEMIPDDYTPPRVRNWPDQHYQNGVSKNDATSRRYKRVVRIIKTLCNEMASKKIKSAEDTPSFLVECLVFNASNECFGYQSFKPMVRAVLAELFNNTMNDQKCSEWGEVSELKYLFRSSQPWTRQGAHQFISDAWDYVGYE

SEQ ID NO: 1363 - protein, 299 aa, Shewanella baltica; identical to SEQ ID NO: 1362

SEQ ID NO: 1364 - protein, 299 aa, Vibrio campbellii
MSRDWESVFSRWAQGPSKTEQDRAENAERQIRQAIQNSSKLQSRNIKVITQGSYRNRVNVRKDSDVDIGVICYDVFFPEYPDDNVKAELNKSFSDGTYTYLTFKNELEEALVARFGRASVSRGSKSFDIKENTYRVESDVAAFFEHRRYMSTTRYLSGVEMRPDDGKPFIVRNWPEQHYANGVSKNDATSRRYKRVVRILKTLSNEMAENGIKSAKDAPSFLIECLVFNASNSCFNYSTYSQMVRAVLAETFNNTINDEKCSEWGEVSELKYLFRGAQPWTRQGAHQFLSDAWDYIGYE

SEQ ID NO: 1365 - protein, 299 aa, Vibrio parahaemolyticus
MSRDWESIFSRWAQGPSKTEQDRAENAERQIRQAIQNSSKLQSRNIKVITQGSYRNRVNVRKDSDVDIGVICYDAFFPEYPDDNVKAELNKSFSDGTYTYLTFKNELEEALVARFGRASVSRGSKSFDIKENTYRVESDVAAFFEHRRYMSTTRYLSGVEMRPDYGKPFIVRNWPEQHYANGVSKNDATSRRYKRVVRILKTLSNEMAENGIKSAKDAPSFLIECLVFNASNSCFNYSTYNQMVRAVLAETFNNTINDEKCSEWGEVSELKYLFRGAQPWTRQGAHQFLSDAWDYIGYE

SEQ ID NO: 1366 - protein, 299 aa, Unknown
  Description of Unknown: Aeromonas sequence
MNRDWESVFSTWARGPSETEQARAENAERQIRQAIQSSPKLQSRDIKVFTQGSYRNRVNVRKDSDVDIGVVCYDTFFPEYPDDNVKAELSKSFSDGTYTYFAFKNELEEALVARFGRASVSRGSKSFDIKENTYRVESDVAAFFEHRRYISSTRYLSGVEMRPDDGKPSIIRNWPEQHYINGVSKNDSTSRRYKRVVRIIKTLSNEMAGNGIESAKRAPSFLIECLVFNASSPCFNYLTYMQMVRAVLAELYNNTITDEKCLEWGEVSELKYLFRGSQPWTRQGAHQFLSDAWDYIGYK

SEQ ID NO: 1367 - protein, 299 aa, Halomonas elongata
MARDWESVFSTWSQGPSKTEQEKVENAERQIRQAIQTSPKLQNRDIKVFSQGSYRNRVNVRRDSDVDIGVLCFDTFFPAYPDDNVKAILKERFSDGEYTYSQFKHELEEALVNRFGRGAVSRGSKSFDVKENTYRVESDVAAFFEHRRYTSTATYLSGVEMIPDDLTPPRVRNWPEQHYSNGVAKNDATNRRYKRVVRILKNLSNEMASQGIASAKEAPSFLIECLVFNASNVRFNHSSFKAMIREVLAELFNNTLSDETCSEWGEVSELKYLFRASQPWTRESAHVFLSDAWDYIGYS

SEQ ID NO: 1368 - protein, 299 aa, Vibrio alginolyticus
MSRDWESVFSTWAKGPSQTEQTRAENAERQIRKAIQASEKLKNRNIKVFTQGSYRNRVNVKQDSDVDVGVVCYDSYFPNYTDDNVKVELAKSFVPASYEYSSFKNELEEALIAHFGRTSISRGSKSFDIKENSYRVESDVAAFFEHRRYTAVNRHLSGVEMIPDDLSPPSVINWPEQHYDNGVQKNTVTNRRYKRVVRVLKTLSNEMSKNGIKSAKEAPSFLIECLVFNAPNSAFEHTQYKPMVRAVLANLFNDTRSDDKCSEWGEVSELKYLFRGPQQWTRSSAHQFLSDAWDYIGYE

SEQ ID NO: 1369 - protein, 299 aa, Methyloversatilis universalis
MSRDWESVFSTWAQGPSATEQERSENAERQIRAAISASEKLKNRDIRVFTQGSYRNRVNVRRNSDVDIGVLCFDTYFPEYPDDNIKANLSESFVPATYTYQTFKNELEEALVSKFGRPAVTRGKKAFDIKANTYRVEADVAAFFEHRRYTSVSNYLSGVEMIPDDFNPARIRNWPEQHYENGVQKNNETSRTYKRVVRILKTLSNEMADAGVTSAKNTPSFLTECLAFNAPNSAFGYSSYKSVVREVLANLFNDTMDDKKCSEWGEVSELKYLFRGSQPWTRATAHQFLNDAWNYIGYK

SEQ ID NO: 1370 - protein, 299 aa, Pseudomonas syringae
MSRDWESIFTTWAQGPGKTEQDRAENAERMIREAIHASPKLQNRSITVFTQGSYRNRVNIRKDSDVDIGIVCYDTFFPEYPDDNIKANVSRGFSDATYTFFTFKNELEEALVKKFGRESVSRGAKSFDIKENTYRIDSDVTPFFEHRRYSSTSLYLSGVEMITDNHTPPRIRNWPEQHYENGVQKNTNTSRNFKRTVRILKNLSSEMAKQGVQSAKNTPSFLIECLVFNASQQCFLFTTYKQIVRAVLAELFNNTITDSTCSEWGEVSELKYLFRTSQPWTRQEAHKFISDAWDHIGYE

SEQ ID NO: 1371 - protein, 297 aa, Actinobacteria bacterium
MRDWEKQFGQWASPPSATEEQRCVNTEKAIREAIQASDVLKSRNIKVFTTGSYKNNTNVRLDSDIDIGVVCYDVFFPDYPEGTTQETFGNVDGGYTYAAFKNEVGQALVARFGTDHVSRGNKAFDVHENTYRVDADVAAFFEHRRYQRSGDFIAGVELRPDNGTPGKVINWPEQHYSNGVAKNNATGRRFKGVVRILKCVCNEMTEAKIAAATNIPGFLIECLVWNVPNAHFGHSTLTGDVRAALAFLFNNTRTDAECSEWGEVSELKYLFRGTQKWTRGGAHAFISAAWDYVGFEG

SEQ ID NO: 1372 - protein, 316 aa, Sorangium cellulosum
MSRNWDQTLKDWAETINATDEERGRSAREAIQQAIRGAPKLEQKGIDVFVTGSYRNNTNTRADSDIDVAVVLRDLAFYEFPAEGSVTREMLGIRTSDYSFDAFRNDVEAALRARFGTSNVTAGNKAFDVRASGARLDADVAVFLKHRRYTGKKTATGAWEYIDGAEMRPRNAPAERIINWPEQHYDRGIAKNEATNRRFKRMVRIFKRLRADMAVQGDTEQQSAAGQVRAFVLECLVHNAPDACFNLEEGGYLKDTEAVLSCLLRATQPSGTGHKLLEVSGMQPLFHGPARRTPQQAYAFLKAAERRIFGAKELPR

SEQ ID NO: 1373 - protein, 316 aa, Sorangium cellulosum
MSRNWDQTLKDWAETINATDEERGRSAREAIQQAIRGAPKLEHKGIDVFVTGSYRNNTNTRADSDIDMAVVLRDIAFYEFPAEGLVTREMLGIRTSDYSFDAFRGDVEAALRVQFGTSNVTAGNKAFDVRASGARLDADVAVFLKHRRYTGKKTATGAWEYVEGVELRPRDAPAERIINWPEQHYERGIAKNDATNRRFKRMVRILKRLRADMAVQGDTEQQSAAGQVRPFVLECLVHNAPDACFNLEEGGYLKDTEAVLSWLLRATQPRGTGHKLMEVSGLQPLFDGPARRTPQQAYAFLKTAWRRIFGAKELPR

SEQ ID NO: 1374 - protein, 317 aa, Sorangium cellulosum
MPTNWDETLKKWAETINATDEERGNGAREAIQQAIRSAPKLASQKGIEVFVTGSYRNNTNTRGDSDIDVAVVLRDVAFYELPADGSVTREMLGLRDSGYSFDSFRDDVGTALKDRFGAGNVTAGNKAYDVHASGDRLDADVAVFLGHRRYTGKRTASGAWECFEGVEMRPRNAPAERIINWPDQHYRRGVAKNDATNRRFKRMVRIFKHLRADMADQGDDEQRSAAGQVRAFVLECLVYNAPDACFNLEQGGYLKDTEAVLRWLLDATRPGADSSKLMEVSGMKPLFHGPARRTPEQAYAFLKAGWRRIFGAKGLPR

SEQ ID NO: 1375 - protein, 308 aa, Marinobacter adhaerens
MTQYWRDRFATWSRPPSDSEEAKADRAARMINEAISNYAPLDSKSISVYGAGSYKNNTNTRNESDIDIAVVLHDCFFSKYPNGKPPQPEDLGHTGGVKYGLDAFHEDVGRALKAKFGHDGVTAGSKAFDVHSNTSRLDADVAVFLEHHRYTGKRNTDGSWHYLEGVEMRGKDGSRIINWHQDHYRNGVDKNNRTGRRYKRIARVLKCLRDDMKRSEEQSIRQAADVPSFLLECLAFNASDGCYQQGDLYDDLKAVITTLWNGTKAETDDFVYVEVSGLKWLFGGEQPWTKASAHSFLLKAWQHVGFSR

SEQ ID NO: 1376 - protein, 308 aa, Halomonas sp.
MSQYWRDRFSSWSRPPSDSEEDKADRAARMINDAISRCVSLENKRTSVYGTGSYKNNTNTRNESDIDIAVVLHDCFFSEYPVGQSPQAEDLGHEGGVTYGLKAFREDVGRALEAKFGRDGVTAGSKAFDVHSNTARLDADVAVFLEHHRYTGKINADGTWHYLEGVEMRDRDGSRIINWHQDHYANGVNKNYRTSRRYKRIARVLKCLRNDMKNSAEQSVQQAADVPSFFLECLAFNASDACYQQGDLYNILKAVITELWNGTKPEGDDFVYVEVSGLKWLFGREQPWTKATAHCFLLNVWQHVGFTK

SEQ ID NO: 1377 - protein, 294 aa, Labrenzia aggregata
MNYTEDQFTRFAAPPSKTEQDKMDNAERAVKNAISGSDQLKARNIRVFPQGSYRNRVNVRGDSDVDIAVVCSDTFFWEGPEGATRETLGITPATYHFDVFRSELETALVDYFGRAAVDPGDKAFDIKANSYRVDADVAPFFDHFRHAGDGSKIKGVEMRTRAGRSIINWPDQHYENGVWKNDRTSRSYKGCVRILKSLRYAMLSDNIASAEGTSSFLMECLIWNVPDKDLMQGTWVQSMREALVYLFNNTIRFEDCSEWGEVSELKYLFGGNQAWTWEGTHRFLSDCWDYVGYS

SEQ ID NO: 1378 - protein, 295 aa, Gammaproteobacteria bacterium
MSKDWESTFTHWSKGPASTESDRCENAIKAIKGAINKSDNLSALDIDVILQGSYRNRVNVRQDSDVDVGIICNDPFFYNLPDEVSLESANIVDAAYQFSDFKHDVRIALVEHFGYEAVTQGNKAFDIKANTYRVEADLAPFFEYRDYWNSSEYRQGVKLISDTGVSIENYPEQHYTNGVIKNNSTGRKYKRSVRILKNLRSEMQDKGFNSAVKIPGFLIECLVFNVPDDTFNFDNYLSIIREVLVNIFNNTIVSADCSKWLEVNNIKYLFHISQPWTKEQVHKFILDAWDYVGYE

SEQ ID NO: 1379 - protein, 293 aa, Thalassospira australica
MSWEERFQAWSRGPSQSETERCENAIRAIKDAINASDALRQRNVTVFLQGSYRNRVNVRQDSDVDIGVLCNSVHFANYPDGMSGKDFGVVDSDYTYATFKRDVGEALLNRFGPEHVTLGSKAFDIKSNTYRVEADVAAFFEHRRYYPNSNYTSGVELRSSHGGRVINWPEQHYTNSTNKNARNARRYKRIVRILKKINYEMQTNNVPSSQNIPGFLCECLVWNVPDKIFDERQFSNILRDCLAYLYEQLNIESSNEWGEVSELKYLFSANQKWTKQQAINFVVGAYNYVGFGQ

SEQ ID NO: 1380 - protein, 303 aa, Shewanella sp.
MLLQQATSKSEQTWEDKFKSWSVGPSKTEEERCENAINMIKDAISSSEKLKNRDVKIFLQGSYRNKVNVRADSDVDVGVVCKDVFYANYPKGYNRDSFGYTESSYTFSEFKNDVEEALVSKFGRVAVTRGNKAFDIKANSYRVEADVAPFMEHRRVSTDGSYLEGVQQFSDDGKSIINWPEQHYENGVSKNTATSRRYKRTARVLKKLKNEMANNGYSHLDNIPGFLCECLIWNVPNSHFNKDRFYDVLRSSIGYLYHELDKDASDEWGEVSDLKYLFGTSQKWTKKQAQDFLKAAWNYVGFE

SEQ ID NO: 1381 - protein, 305 aa, Colwellia chukchiensis
MSFNNSAAKALGTSNWEHKFKDWSTGPGKTERVRCENAISMIKSAIESSEKLTSKSINVFLQGSYRNKVNVQADSDVDVGIVCSDVFFGHYPKGYNRDSFGYVAASYSFDDFKDDIEKALVDKFGRAAVTRGSKAFDIKANTYRVEADVAPFMEHRRFKTNGSYITGVQQFSDDGKKIINWPEQHYENGVSKNTLTSKKYKRTVRVFKKLTNEMAANGIEDARSIPGFLCECLIWNVPNEYFNYTTFYDVLRNAIVYLYAELGKESSDEWGEVSELKYLFGSNQKWTKQQARRLLVAAWNYVGYE

SEQ ID NO: 1382 - protein, 304 aa, Ralstonia sp.
MSATWNERFASWAQAPSQTETNRIDNAIAAIKNALAADPKVASVTKVFVQGSYRNRVNVRQDSDVDIGVLYTGNLFGTDYPPGKTAADFNLIGAEYGYSDFKNDIEKALVSRFGRVAVTRGDKAFDIHENTYRVDADVVPLIVHRRYAVDGSYICGTELRPDNGGRIINWPERLYDTHIWPRQHYENGNTKNNDTRRAYRGVVRIVKKLRNIMDEENVAEAKPIKGFNIECLAWNTPNTCFAHATWYEDVSAVLSHLSYNLSSMVLCEEWGEVSELKYLLKGDDTKRKQFKAFVDGARGYIGSA

SEQ ID NO: 1383 - protein, 304 aa, Ralstonia sp.; identical to SEQ ID NO: 1382

SEQ ID NO: 1384 - protein, 294 aa, Pseudoxanthomonas wuyuanensis
MSAAWEERFSAWAQPPCTTETQKIEHAITAIDKALAAWPKVAGVTRAFVQGSYRNRVNVRQNSDVDIAALYTPSIFFPKYPAGLSRQDFNHITATYTYAEFKNDIGDALYNYLGRNNVTRGDKAFDVHENSYRVDADVVPVLEHRWYRADRTYLSGTQFHPDSGGEVINWPDQHHANGNTKNDETGRAYRGMVRIIKKLWYLMDGNNVPAAKPLKGFNIECVVWNVPNYCFAHATWFDAVSTVLNYLSIDLCSMQSCGEWTEVSGLKMLLDGDDTKRLQFKAFVDRARTEIGIS

SEQ ID NO: 1385 - protein, 246 aa, Xanthomonas arboricola
MQGSYRNRVNVRQDSDVDIAVIYTGGTFFADYPEGTTRETFGNLPGTYTYAQFKKDIGDALVGYFGPLHVTRGDKAFDVHETTYRVDADVVPVFEHRRYQNAGTYLSGTRLYSDKGVKIINWPDQHYANGNEKNNSTQRAYRKIARIVKKLRNVMDDEGVPEAKPLKGFNVECLIWNVPDALFMHDTLFQDVTAALNYLSTQLSSMGACGEWGEVSDLKYLLKGNETKRQQLKAFIDRGRTRIGIA

SEQ ID NO: 1386 - protein, 252 aa, Cycloclasticus sp.
MSREWETIFSTWAQSSGATESERLERTISSIKNALSADDRLCTKSKVYVQGSYRNRVNVKQDSDVDIGILYTGNTFYPDYPEGMSQSDFGNIDSDHTYREFKDEVEIALVNYYGRAAVHRGNKAFDLHENTYRVDADVVPVFEHRYYSRDGSYICGVQIYPDNGGSIINWPERLYDDHHWPNQHYENGVSKNTNTGRRYKSVVRILKKLRNTMADKGIAAANPIPGFLIECLVWNTPTLKIRETEPKRSDDF

SEQ ID NO: 1387 - protein, 296 aa, Candidatus Campbellbacteria bacterium
MAWEDTFKSWGGAPGVTEQQKMENAEIAVKKAIKANVTLSSMDISIIPQGSYKSRTNVKNDSDVDICVCLNSTFFPRYPQGKSKEDYGNSDGSISFAEFKNLVQKALEDYFGKTSVTRGNKAFDIHSNSYRVDADVVPALAYRYYYDTGYKWHDPEGVCFLADDGTKIINWPHQTYENCKNKHEATGQRYRKITRILKRLRNKMQEENIVEAKDIPSFLIQSMVWSAPDDHFNRDTYSADVRAVLAHCHNETLPNGKHATLCEVNDIKNIYGTHQPCTREKAHSFFSRAWDYLGFE

SEQ ID NO: 1388 - protein, 296 aa, Candidatus Uhrbacteria bacterium
MSWEDTFKSWGAAPGTTEQQKMENTETAVRKAISASARLADMDISIIPQGSYKSKTNVKNDSDVDICVCLNSTFFPRYPEGKTQNDYGNVDGSISFSDFKNLIQKALEDYFEKSEITRGNKAFDIHSNTYRIDADVVPAFAYRYYYDTGYDWHKEEGICFLTDDGTKIINWPHQTYRNCKNKHDATGQRYRKMTRILKRLRNKMQEENIVEAKDIPSFLIQSMVWSAPDDHFNRATYSADVRAVLAHCYNETLPNGKHATLREVNDIKNIYGSHQPCTREKAHAFFSRAWSYFEFE

SEQ ID NO: 1389 - protein, 298 aa, Candidatus Magasanikbacteria bacterium
MSWEDTFKSWGAAPGTTEQQKMENAENAVRKAINAETVLKNMDISIIPQGSYKSRTNVRQDSDVDICICLNSTFFPRYPIGKTKEDYGNIDGSINFDEYRNLVQRALQNYFGTEYVTPGNKAFDIHSNTSRVDADVVPAFAYRYYHGEGENDYQQPLGIAFLTNNEKKKIINWPHHTYDNGKEKQQRTGQRYKKVVRIIKKLRNKMQEESISESQDIASFLIESMVWNAPDSHFNRDTYTADVRAVLAYCFNETLPNGSHGKLGEVNDFKYLFGDHQPWSRERAHKFFSSAWDYLGFE

SEQ ID NO: 1390 - protein, 297 aa, Candidatus Kuenenbacteria bacterium
MNWEDTFRSWGGPPGQTEKEKMENTENAIKNAIQKDDKLSQMDISVFAQGSYKSRTSVRQDSDVDVCVCLNSTFFTHYPEGKSDEDFGNSEGSISFPEFKNLIETALKNYFGSDKVIRGNKAFDIHSNSYRVDADVVPAFAYRYYDGDGEDDYIKPAGIGFLTDKGIRINNWPKQAYENGVSKQSNTGERYKKMVRVMKKMRNKMQEDNITSASNVPSFLIESMVWNVPDNGFNSDNYYDDVKYVVANCFNKTIKDEDCKEMCEVNDIKYLFHSFQPWNRAQAHSFFDAAWDYVGFE

SEQ ID NO: 1391 - protein, 296 aa, Deltaproteobacteria bacterium
MSWEDTFNSWCKPPGQTEQDKMNNAEAAIKKAIAKHDRLSDMDITVFAQGSYQANTTVKQDSDVDVCVRLNSTVFTRYPEGKNNADYGYTDGSIRFAEYKNLINEALNDYFGSQYVTRGNKAFDIHSNSYRVDADVVPAFAYHCFEDGCDDYRKPAGVAFDTDKGARIMNWPDQTYSNGVDKNNATSRRYKKMIRILKNLRNDMQENKITAANDIASFLIECLVWNTPNKGFGHLNLTDDVRYVLAHTFNETLTDEKCNEWGEVNEIKYLFRPSQPWSRIQAHNFLSAAWDYIGFE

SEQ ID NO: 1392 - protein, 300 aa, Lentisphaerae bacterium
MNISEETFTWWSQGPGKTETDKCKNAEVAVRKAIDADDPLCTLDISVFAQGSYKVRTNVRQDSDVDICIRYNTSFFPDYPDGMTDQSFGNSNGTMAFSDFKNMIEKALKNYFGESGVTRGKKAFDVHANSYRIDADVVPTFERRRYTGNKNSYGTWEFHSGTAFIPDNGDLIENWPDHNYNNGISRNDTTGRCYKRVIRILKHLRNKMQEERISESANIASFLIECLAWNAPLEAFTHDSYSDILRHVIASLWNRTRKIEDCTEWGEVNELKYLFRSSQPWTCEQANKFLDAAWKYIGFT

SEQ ID NO: 1393 - protein, 300 aa, Verrucomicrobiae bacterium
MNISEDNFIAWSKGPSDTETTKCENAENAVRKAIKANSDLQNLDIKVFAQGSYKSRTNIRLDSDVDICVCCYESFFGDYPNNTTSDSFGHTSATLKYSDFKDMVESALKSYFGKDGVTRGNKAFDIHANSYRIDADVVPTFEHRRYTGETNSDGTDYYLSGVGLKPDKGDLIKNWPDQHYNNGISRNSETGRNYKRVIRILKRLRNKMQEDKIPEASNIASFLIECLVWNADVVAFEQKTYTAIARHIIADLYNRTRKDEDCSEWGEVNELKYLFRNLQPWTRQQANNFLHAAWNYIGYK

SEQ ID NO: 1394 - protein, 300 aa, Scytonema millei
MNISENTFVSWSRGPSQTESDKCENAERIVRKAIEADVKLSSLDISVFAQGSYPARTNVRQNSDVDICVRYNSAFFPDYPSGTTQNTFGNVDSTLSFAEFKNMVEQALVSYFGKNGVTRGNKAFDIHANTYRIDADVVPTFEHRRYTGRWNTDGTPHYISGVAFKPDKGSLIKNWPQQTYANGVARNNSTGRKYKRVIRILKRLRDKMQSENVSEAKNISSFLIECLVWNAALEAFSKKSYTEILRYIIVDIWNRTRKDEDCSKWGEVNELKYLFRSSQPWTRQEGNNFFQAVWNYIGYT

SEQ ID NO: 1395 - protein, 300 aa, Nostoc sp.
MNISEDTFVSWSRGPSQTESDKCENAERIVRKAIKADVKLSSLDISVFAQGSYRARTNVRQNSDVDICVRYNSAFFPDYPSGTTRNTFGNVGSAISFAEFKNMVEQALVNYFGRNGVTRGNKAFDVHANTYRIDADVVPTFEHRHYTGRWNTDGTPHYISGVAFKPDNGSLIQNWPQQTYDNGVNRNNSTGRKYKRVIRILKRLRDKMQSENVSGAKNISSFLIECLVWNAALEAFSKESYTEILRYIIVNIWSRTRKDEDCSEWGEVNELKYLFRNSQPWTRQEANNFLQAVWNYIGYT

SEQ ID NO: 1396 - protein, 300 aa, Nostoc sp.
MNISEDTFVSWSRGPSQTESDKCENAERIVRKAIKADVKLSSLDISVFAQGSYRARTNVRQNSDVDICVRYNSAFFPDYPSGTTRNTFGNVGSAISFAEFKNMVEQALVNYFGRNGVTRGNKAFDVHANTYRIDADVVPSFEHRHYTGRWNTDGTPHYISGVAFKPDNGSLIQNWPQQTYDNGVNRNNSTGRKYKRVIRILKRLRDKMQSENVSGAKNISSFLIECLVWNAALEAFSKESYTEILRYIIVDIWSRTRKDEDCSEWGEVNELKYLFRNSQPWTRQEANNFLQAVWNYIGYT

SEQ ID NO: 1397 - protein, 300 aa, Oxalobacteraceae bacterium
MNFSESTFELWSKGPGKTEADRCANAEKAVRNAIDAHEKLRGLDISVFPQGSYKARTNVRQESDVDICVRYNGAFLADYPDNKAHADFGNLDSVFTYAEFKDLVGEALFDFFGDDGVTRGNKAFDVHANTYRIDADVVATFEHRRYTGERDQDGTHTYLSGVAFIPDEGEIVKNWPVQNYDNGIEKNSRCNRHYKRVVRILKRLCYKMRSEGVAGTDGIGSFLIECMVWNAPDDAFAHQTYTEDVRYVLANLWNRTRTDDTCSEWGEVNELKYLFRLGQPWTRQQANDFLQAAWDYIGFQ

SEQ ID NO: 1398 - protein, 287 aa, Alphaproteobacteria bacterium
MPAELKERPVSGERSPSAWEPILTTWSKGPSKTEQEKCENAEKQVRKALDASERLSKMDITVFAQGSYRGRTNVRLDSDVDINVRLNTTLFCDYPPGKADKDFGLTDGSISYADFKDLVGQALVSRFGRTGVTRGKKAFDVHENTNKIEADVVATFEHRRYTGRENWDGSAHFLKGTAFIPDNGGIVKNWPDQHFDNGKKKHEDTGERYRKVVRIMKLMRNEMQEAKVPEAMNIPSFLVECLVWNTPNDKFGLDGWLGSLPLYTDLKNVIVSTYNGTKTDAGCKEWG

SEQ ID NO: 1399 - protein, 301 aa, Candidatus Thiomargarita nelsonii
MVREWEQDFRRWGRPPSQTEIDRCNNAVSVVRNAVHSYVAFAARNIEVFAQGSYRSGTNVRVDSDVDICVRCMDVCFSKLGDGVSDADTGLVSASYTYAEFKDDVEQALRTYLGEAAVVRGNKAIDLHANTYRVDAGVVPTFEHRRYYRDSQGLVKYLSGTELRPDKGGRIINWPEQNYRNGTEKNNDTLMRYKKMVRILKTLKNEMADAGIAAADPIPSFLIECLVWNVPNSNFGNTNYTDDVRNVLLYLYSTTRSKDSCHEWGEINELKYLFRDFQTWRQEQAYTLIVSAWGYSDMEQS

SEQ ID NO: 1400 - protein, 300 aa, Deltaproteobacteria bacterium
MARDWEQDFRLWGRPPGTTEAERSDNAVRVVQNAVRSYAAFSTRNLRVFAQGSYRNGTNVRKDSDVDVCVCCMDVCFADYLDGVTSSDTRLGSANYTYAQFKGDVEAALRAYLGAKSVTRGDKAIDLHENSYRVEADVVPTFEHRRYYRDGFGQVRYLSGTELHPDKGGRVINWPEQNYRNGTNKNQNTSKRYKMMVRILKRLRNEMENAGRPEAKPISSYLLECLVWNVPDLRFGNKTYCADVTSILGYLYSATEKDENCKEWREVNELKYLFQPSQPWTREQARKFVLGAWSYVGVLK

SEQ ID NO: 1401 - protein, 303 aa, Nitrospirae bacterium
MNRDWETVFRNWAKPSSDTEQQKCGNAVKMVCDAISGDSALSQKNIEVFPQGSYRNNTNVRQDSDVDICVCLLDVCLVDFSMSGALTDQIVGLNSSDYTYGEFKNSVEKALVAKFGRANVRRCNKAFDIHANTYRVDADVVPCFEHRRYTGERHYDSSYYYLSGTEFCPDNGGRIINWPQQHYENGVAKNDATGNRFKYITRVLKRLRNEMADKGIAAAKPIPSYLIECLVWNVPNEGFGHDIYTDDVRYVLAHTFNETINDEKCSEWREVNELKYLFRIRQPWTRQQAHEFLSAAWNYIGFE

SEQ ID NO: 1402 - protein, 293 aa, Unknown
  Description of Unknown: candidate division Zixibacteria bacterium sequence
MDWEVTFRQWAQPPSATEREKMENAERAIKKAIDACEALDSRNIRVFAQGSYRNRTNVRQDSDVDICVLCKDIFYFQLPEGYSRDQFGLDSPATYADAQYRADIESALVSHFGRGSVTTGNKAWDIHANTYRVDADVVACFEYRYYFTDGSFRKGTAVIPRSGLYIANYPDQNYENGKAKNDETNHRFRAAVRILKNLSNYMKENGESFIQLPSYLYECLTWNVPNEGFDHDAYIDDIRWILAHLCNETRTDETCNEWCEVNSFKYLFRPSQKWTRVEANTSLNSAWRYLGFN

SEQ ID NO: 1403 - protein, 300 aa, Candidatus Daviesbacteria bacterium
MPPIPKIADIDATFNSWAKSPSTTEQEKCDNSVRAVKQAVVSFEGFNDKDVSVFAQGSFRDRTNISSESDVDVGVLCTDTFYYDLPEGTTKEDFEISAAGYEHPQYKDDLHQALNDHFGESAVVRGNKAFDVHENSYRIDADVVPHFEYRLYDKYGSYRTGTAFLTDDGNRIVNWPEQNYSNGVTKNDETKGSFKAVTRIIKNLRVKMEEDGIAAAKPIPSYLIECLVWNVPNPGLMHDTYKEDVRYALAHLFNDTREFESCKEWGEVNEIKYLFRDSQPWRRVQANAFLDAAWNYLGFE

SEQ ID NO: 1404 - protein, 297 aa, Bacillus cereus
MFELKSSIEDTCKNWCKPASETETQKCENALRMIKDAIRESDELREMNIHIIPKGSYHNNTNVRLNSDVDIAVVLKDTFYADYPKEKSKSDFGNMSSSYKFSDYRDAIERALHAKFGSENVNRGNKAFDLHSNSYRVDADVVPCLEHRRYREDGTFITGTAFDARYTNERVNNYPVQHYENGIRKNNITNRRYKRVVRILKRLRYKMKEDGYEHETISSFLIECLVWNVPNNYFGHVKLSDDVEGSLEYLIYNTSNRDLCGEWGEVSELLYLFHSGRKYTLNQVHDFLKHAKAYLFN

SEQ ID NO: 1405 - protein, 297 aa, Unknown; identical to SEQ ID NO: 1404
  Description of Unknown: Bacillus sequence

SEQ ID NO: 1406 - protein, 290 aa, Bacillus cereus
MEDTCKNWCKPASETETQKCENALRMIKDAIRESDELREMNIHIIPKGSYHNNTNVRLNSDVDIAVVLKDTFYADYPKEKSKSDFGNMSSSYKFSDYRDAIERALHAKFGSENVNRGNKAFDLHSNSYRVDADVVPCLEHRRYREDGTFITGTAFDARYTNERVNNYPVQHYENGIRKNNITNRRYKRVVRILKRLRYKMKEDGYEHETISSFLIECLVWNVPNNYFGHVKLSDDVEGSLEYLIYNTSNRDLCGEWGEVSELLYLFHSGRKYTLNQVHDFLKHAKAYLFN

SEQ ID NO: 1407 - protein, 290 aa, Bacillus cereus; identical to SEQ ID NO: 1406

SEQ ID NO: 1408 - protein, 297 aa, Bacillus pseudomycoides
MFELKSTVEDTCQNWCKPASKTESQKCENALRMIKDAIRESDELKEMDIQIIPKGSYHNNTNVRLNSDVDIAVVLKDTFYADYPKDKSKDNFGNISSSYKFSDYRDAVERALHAKFGSENVHRGNKAFDLHSNSYRVDADVVPCLEHRRYREDGTFITGTAFDARYTNERVNNYPVQHYENGTQKNNISNRRYKRVVRILKRLRYKMKEDGYEYETISSFLIECLVWNVPNNYFGHDKLSRDVEASLDYLIHYTSNRDLCGEWGEVSELLYLFHSGRKYTLNQVHDFLKHAKAYLFN

SEQ ID NO: 1409 - protein, 297 aa, Unknown
  Description of Unknown: Bacillus cereus group sequence
MFELKSNVEDTCQNWCKPASKTESQKCENALRMIKDAIRESDELKEMNIQIVPKGSYHNNTNVRLNSDVDIAVVLKNPFFADYPKGKDKGDFGNFTSSYKFSDYRDAVERALHKKFGSENVNRGNKAFDLHSNSYRVDADVVPCLEHRRYKDDGAYTTGTAFDARFTGERVENYPVQHYENGTNKNTQTSRRYKRVVRILKRLRYKMKEDGHEYETISSFLIECLVWNVPNGYFGNAKLSEDVEASLDYLIYNTSNPDLCGKWGEVSELLYLFHSGRKYTRTEVNDFLKHAKTYLFN

SEQ ID NO: 1410 - protein, 297 aa, Bacillus anthracis
MFELKSSVEDTCQSWCKPASRTESQKCENALRMIKDAIRESDELKGMDIQIIPKGSYHNNTNVRLNSDVDIAVVLKKPFFADYPKDKGDKDFGNASSSYKFSDYRDAVERALHKKFGSENVNRGNKAFDLHSNSYRVDADVVPCLEHRRYKDDGTYTTGTAFDARFTGERVENYPVQHYENGTNKNTLTSRRYKRVVRILKRLRYKMKEDGHEYETISSFLIECLVWNVPNSYFRNAKLSEDVEAALDFLIHNTSNLDLCGKWGEVSELLYLFHSGRKYTRTEVNDFLKHAKTYLFN

SEQ ID NO: 1411 - protein, 297 aa, Bacillus wiedmannii
MFELKSNVEDTCQNWCKPASKTESQKCENALRMIKDAIRESDELKEMNIQIVPKGSYHNNTNVRLNSDVDIAVVLKNPFFADYPKDKDKGDFGNITSSYKFSDYRDAVERALHKKFGPENVNRGNKAFDLHSNSYRVDADVVPCLEHRRYREDKTYTTGTAFDARFTNERVKNYPVQHYENGVSKNTITNRRYKRVVRILKRLRYKMKEDGHEYEAISSFLIECLVWNVPNSYFGNDKLSKDVEDSLDYLIYNTSDENLCKEWGEVSELLYLFHSGRKYTWNEVNDFLKHAKAYLFN

SEQ ID NO: 1412 - protein, 297 aa, Planococcus antarcticus
MFEFKSNLEDTFQNWSKPASENEESKCENAIRMIRDALSKSAALKNRGIQLIPKGSYHNNTNVRLTSDVDIAVKLKDVFFADYPDGQGHKDFGNSDADYTFAQYRSDIEAAIVNHFGIENVELGNKAIQINFNSYRVDADVVPCFEHRRYSLGGSYLTGTEFQTRHSQNRIINFPEQHYINGVRKNTETSRRYKKLVRIFKRLRYNLLDEGYAVEKVSSFLVESLIWNVPNDRFNNATLTEDVQKCFDYLIEKTSSVEKTKEWGEVSELLYLFRANRKYTFSDTHKFLVEGRKYLFK

SEQ ID NO: 1413 - protein, 297 aa, Planococcus faecalis
MFEFKSSLEATFQSWSKPASESEEAKCENAIRMIKDALSKSVALKNRDIQVIPKGSYHNNTNVRLTSDVDIAVKLKDVFFADYPDGQGHKDFGNSDADYTFAQYRNDIETAMINHFGSENVEPGNKAIQINFNSYRVDADVVPCFEYRRYSKDGSYLTGTEFLTRHSQKRITNFPEQHYSNGVRKNNETSRRYKKMVRIFKRLRYNLLDEGYDVENVSSFLVESLVWNVPNNRFNNLTLTEDVHQCFDYLIAQTSNSEKTKEWGEVSELLYLFHATRKYTLNDAQRFLVEGKAYLFK

SEQ ID NO: 1414 - protein, 296 aa, Bacillus sp.
MFELKESLEATFQSWSKPASDTEETKCDNALRMIREALNKSDVLSKYDIQLIPKGSYHNNTNVRLTSDVDIAVKLKDVFYANYPEGKTNSDFGNRGADYTFAQYRSDVDQAMIDKFGSNNIEFGNKAIQINSNSYRVDADVVPCFEHRRYSKDGTFITGTEFITRHTNQSVINFPEQHYINGVRKNNETSRRYKKMVRIFKRLRYNLLDEGYGVEDVSSFLVESLIWNVPSNKFNNATLTEDVKQCFNYLITQTSDIEKCKEWGEVSDLLYLFNRTRKYTRSDAYRFLVDGYAYLF

SEQ ID NO: 1415 - protein, 296 aa, Bacillus sp.
MFELKGNLEATFQNWSKPASYTEETKCDNALRMIRDALNKSEKLSKYEIQLIPKGSYHNNTNVRLTSDVDIAVKLKNVFFANYPEGKTHEDFGNHDADYSFAQYRSDVDQAMINKFGEKSIEFGNKAVKIKSNTYRVDADVVPCFEHRRYSQNGTYITGTEFVTRHTSKRIINFPEQHYRNGVTKNNDTSKRYKKMVRIFKRLRYNLLDEGYDVENVSSFLVESLIWNVPNNRFNNATLTEDVKQCFNYLIIQTAEYEESKDWGEVSELLYLFHSDRKYTRSDTHQFLLDGYTYLF

SEQ ID NO: 1416 - protein, 297 aa, Bacillus megaterium
MFEIKSNLEATFQSWSQPSSDSESSKCENAISMIKGALRTSEELSNYDIQLIPKGSYHNNTNVRLNSDVDIAVKLKDIFFAEYPDGKKHEDFGNHSAKYTFQEYRAAVEQAMINKFGYANVEFGNKSLKIHSNTYRVDADVVPCFEHRRYSSNGSYITGTEFIARHSGEHVRNFPEQHYENGVYKNNRTSRRYKKVVRIFKRLRYKLRDEGNKVDNISSFLLESLIWNVPNDRFNGDTLTSDVRECFRYLIENTLYEKSCEDWGEVSELLYLFHPTRKYTVDQVNIFLCEGYKYLFK

SEQ ID NO: 1417 - protein, 294 aa, Bacillus vietnamensis
MLGTGISLESLLEKWSKPASDTEETKCDNALRMIKKSIGSSQELSGYTIKFILQGSYYNNTNVRLNSDVDIAVKLTDTFYPNYPEGTTRNDFGNLESKYTFAEYRDSLERALIATFGENSVTRGDKSLKIRSNSYRVDADVVPCFEHRRYRRDGSYIKGTEFRTRYGNNQVINFPEQHYANGVEKNKATGRKYKRMVRIIKRLRYKMKDDGFDVENIPSFLIECLVWNVPNRYLNTGSYTEDLRGSLRYLIQNTDSYDTCEEWGEVSELLYLFRSKYNYREINQFVRAAYEFVF

SEQ ID NO: 1418 - protein, 297 aa, Bacillus thuringiensis
MFQTVDKLESTFIKWSKRASDNEESKCDNALKMIKDAINKSPKLSMYEFSYIQQGSYYNNTNVRLNSDVDIAVRKKDTFFADYPLGKTHEDFGNHSSSYAFEDYRKDIHQALVNKFGAENVELADKCIKIRSNSYRVDADVVPCYEHRRYSTDGEYILGNAFKTRKSLKLVKNFPEQHYSNGIEKNNRTSRRYKRVVRILKRLRYELKEKGYRHENISSFLIECLVYNAPDDLFNNRTYTEDVQKVLNYLIANTALDTYCFLWTEVSGLLNLFSTEKSYSRDDVNKFLNDSFNYLFK

SEQ ID NO: 1419 - protein, 297 aa, Bacillus cereus
MIKTAEKLEKTLISWARRASDSEESKCENALKMIKDAINKSEKLSKYEFAYVQQGSYYNNTNVRLNSDVDIAVRLKNIFFTTYPEGKGHADFGNVNNTYAFSDYRNDVYEALIDKFGDKDVTLGDKCIKIRSNSYRVDADVVPCFEHRRYSNNGSYILGNGFKTRKEDELVKNYPEQHFENGVLKNNNTSRRYKRVVRILKRLRYVLNDQGYKHENISSFLIECLVWNVPNNLFNNTTYTEDIQKVLNYLIENTSTADKCKEWGEVSDLLYLFHSSKQYTRQEVNTFLNDVYKYLCE

SEQ ID NO: 1420 - protein, 296 aa, Paenibacillus riograndensis
MDWKSNLEDTFTKWSKRSSDYEEEKCERALSMIKSAVKEDEQIKNSDISFIPQGSYHNNTNVRLNSDVDICVKLKSTVFSEVPDGMKKEDFGLVTSEYTFKQYQDDVERALVKKFGRENVKKGSKAFDIKSNTYRVDADVVACFEHRRYSRDGTYITGTQFYTSTGVKVVNFPEQHYSNGVKKNDETRRNFKRVVRIIKRLKLKMVEEGVEGLDNISSFLIECLVWNVPSNYFDNNSYVDDVRKILSYLYHNTKEDHLCKEWGEVSDLLYLFHSGRSYSIKEVNNFILRAFNHVFN

SEQ ID NO: 1421 - protein, 296 aa, Paenibacillus odorifer
MSWKDNLEDTFTKWSKRSSDNEEEKCERALSMIKSAVKEDEQIKNSDISFIPQGSYHNNTNVRLTSDVDICVMLKSSIFSQVPDGMKKEDFGLVTSEYSFKQYQDDVERALVKKFGRENVKKGGKAFDIKSNTYRVDADVVACFEHRRYNMDGTYISGTQFFTSTGEKIVNFPEQHYSNGVKKNDATRRNFKRVVRIIKRLKYQMVDDGVKGLDNISSFLIECLVWNVSNGYFNNITYVEDVKKILSYLYHNTKEDHLCKEWGEVSDLLYLFHSGRSYSLEEVNGFILNAYNHVFN

SEQ ID NO: 1422 - protein, 294 aa, Desulfovibrio sp.
MARDWEEQFRKWAKPPGTTEETRCSNAESAIKNALSRSAFLSGINYSAFAQGSYANNTNVRADSDVDVGVLCKDVFFYELPEGMHPEDFSIAPAPFSYADYKNAIYDALVTHFGRSAVKRGNKAIDVKENTYHVEADVAPFFEHRRYNSDGTFLSGCELRPDDNSRQVINWPQQHYSNGVDKNLNTGRRYKSVVRILKSLSCEMSECRIKDCGVCGFFIECLAWNVPNSNFGNSLYTDDIRNSLIYLYNNTKEIEKCKEWGEVSDLKYLFHGWQKWNANDANSFTLSAWNFIGF

SEQ ID NO: 1423 - protein, 314 aa, Bdellovibrio sp.
MAESTWSGAFGSLFENRSSTDKLEQKLRKWAQSPSESEIEKCDRAVRMIKAAIDADEKLSKMDISVFAKGSYANRTNIPSDSDVDVVVRLNTLYYNIYPEGTTPQTFGFVTATYIYEHFKADIAAAIVNYFGSGQVTIGNKAIQVHANTVRVDADVVPHAVHRHYHADFSYHEGVALKSKDGQVIYNWPKQDYDNGVKKNETTGKRYKAITRIFKNLRCEMKEQGYDSADSAASYLLACLAYNIPDYIYDDESYVKMTEDCLIFLVQQTSDLNTVAHWNEVNERKKLFGSHQGWKFDEVHTFICDAYRYFQGLK

SEQ ID NO: 1424 - protein, 291 aa, Haloferula sp.
MPDWENTFSTWTKRASDTEEEQCVNAETAIRKAIKASSELTNLDISVFAQGSWAANTNVRRDSDVDVCICFEETVGLGLPPGRTMEEYGYRGAAPISSREFRARVGRALVSYFGQDDVTPGSKAYTIRDNTYRVHADAVPTILYRNYNFSPTIEGVALDPDGGKRIVNYPKQALANGIAKNNATNRYYKRAVRIMKRTRNYLRERGDESVKFAPSFQIESLVYNVDNSVFMLPSWTETIRQLIIAAHSIAVGPSSPVEVNHIKPLFGDHSQWTREHAQAFLVAAWNKLGFA

SEQ ID NO: 1425 - protein, 295 aa, Streptococcus mitis
MRYSEEALQSWIKPLSATEETRVENTIGMIKDAIERSGLSSKYEYEIFAQGSYANNTNVKKNSDIDICIMVKSLFYCEYVDGLSDLDYNYSSSSTNANVFKNEVIKALISKFGAESVYIGNKCININSNSYHVNADVVPCFQYRNYRYIGSRSSEKFVEGIKFFTSNGNYEVINYPKVHIQNGISKNKSTHYKYKYLVRIMKHIKNEMQELGLTNERISSYLIECLVWNIPEQMFFNSNSYTGLLQQALYYIVSQVNLNWVEVSGMYYLFRSEQKWNLQDTKTFLVRMIEFLDYK

SEQ ID NO: 1426 - protein, 295 aa, Streptococcus mitis; identical to SEQ ID NO: 1425

SEQ ID NO: 1427 - protein, 295 aa, Unknown
  Description of Unknown: Streptococcus sequence
MRYSEEALQSWIKPLSATEETRVENTIGMIKDAIERSGLSSKYEYEIFAQGSYANNTNVKKNSDIDICIMVKSLFYCEYVDGLSDLDYNYSSSSTNANVFKNEVIKALISKFGAESVSIGNKCININSNSYHVNADVVPCFQYRNYRYIGSRSSEKFVEGIKFFTSNGNYEVINYPKVHIQNGISKNKSTHYKYKYLVRIMKHIKNEMQELGLTNERISSYLIECLVWNIPEQMFFNSNSYTGLLQQALYYIVSQVNLNWVEVSGMYYLFRSEQKWNLQDTKTFLVRMIEFLDYK

SEQ ID NO: 1428 - protein, 295 aa, Streptococcus sp.
MRYSEEALQSWIKPLSATEETRVENTIGMIKDAIERSGLSSKYEYEIFAQGSYANNTNVKKNSDIDICIMVKSLFYCEYVDGLSDLDYNYSSSSTNANVFKNEVIKALISKFGAESVSIGNKCININSNSYHVNADVVPCFQYRNYRYIGSRSSEKFVEGIKFFTSNGNYEVINYPKVHIQNGISKNKSTHYKYKYLVRIMKHIKNEMQELGLTNERISSYMIECLVWNIPEQMFFNSNSYTGLLQQALYYIVSQVNLNWVEVSGMYYLFRSEQKWNLQDTKTFLVRMIEFLDYK

SEQ ID NO: 1429 - protein, 295 aa, Streptococcus sp.
MRYSEEALQSWIKPLSATEETRVENTIGMIKDAIERSGLSSKYEYEIFAQGSYANNTNVKKNSDIDICIMVKSLFYCEYVDGLSDLDYNYSSSSTNANVFKNEVIKALISKFGAESVSIGNKCININSNSYHVNADVVPCFQYRNYRYIGSRSSEKFVEGIKFFTSNGNYEVINYPKVHIQNGISKNKSTHYKYKYLVRIMKHIKNEMQELGLTNERISSYLIECLVWNIPEQMFFNSNSYTGLLQQALYYIVSQVNLNWVEVSGMYYIFRSEQKWNLQDTKTFLVRMIEFLDYK

SEQ ID NO: 1430 - protein, 295 aa, Streptococcus sp.
MRYSEEALQSWIKPLSATEETRVENTNGMIKDAIERSGLSSKYEYEIFAQGSYANNTNVKKNSDIDICIMVKSLFYCEYVDGLSDLDYNYSSSSTNANVFKNEVIKALISKFGAESVSIGNKCININSNSYHVNADVVPCFQYRNYRYIGSRSSEKFVEGIKFFTSNGNYEVINYPKVHIQNGISKNKSTHYKYKYLVRIMKHIKNEMQELGLTNERISSYLIECLVWNIPEQMFFNSNSYTGLLQQALYYIVSQVNLNWVEVSGMYYLFRSEQKWNLQDTKTFLVRMIEFLDYK

SEQ ID NO: 1431 - protein, 295 aa, Streptococcus mitis
MRYSEEALQSWIKPLSATEETRVENTIGMIKDAIERSGLSSKYEYEIFAQGSYANNTNVKKNSDIDICIMVKSLFYCEYVDGLSDLDYNYSSSSTNANVFKNEVIKALISKFGAESVSIGNKCININSNSYHVNADVVPCFQYRNYRYIGSRSSEKFVEGIKFFTSNGNYEVINYPKVHIQNGISKNKSTHYKYKYLVRIMKHIKNEMQELGLTNERISSYLIECLVWNIPEQMFFNSNSYTGLLQQALYYIVSQVNLNWVEVSGMYYLFRSEKKWNLQDTKTFLVRMIEFLDYK

SEQ ID NO: 1432 - protein, 295 aa, Streptococcus pseudopneumoniae
MRYSEEALQSWIKPLSATEETRVENTIGMIKDAIERSGLSSKYEYEIFAQGSYANNTNVKKNSDIDICIMVKSLFYCEYVDGLSDLDYNYSSSSTNANVFKNEVIKALISKFGAESVSIGNKCININSNSYHVNADVVPCFQYRNYRYIGSRSSEKFVEGIKFFTSNGNYEVINYPKVHIQNGISKNKSTHYKYKYLVSIMKHIKNEMQELGLTNERISSYLIECLVWNIPEQMFFNSNSYTGLLQQALYYIVSQVNLNWVEVSGMYYLFRSEKKWNLQDTKTFLVRMIEFLDYK

SEQ ID NO: 1433 - protein, 293 aa, Streptococcus intermedius
MKYSEEVLRSWIKPLSDTEEIRVENTVRMIKDAMDESVLSSKYEYEIFSQGSYANNTNVKKNSDIDICIMVKSMFYCQYVDGLSEGNYNHSSSSIGANVFKNEVIKALISKFGSESVSIGNKCINIDSNSYHVNADVVPCFQYRNYRKIQSRDSERFIEGIKFFTSSGNKEVINYPKRHLQNGISKNNETHYRYKYLVRIMKHIKNEMRVVGLVDENISSYLVECLIWNIPNQMFNTNNYTDLLHRALIYLVSKMDCDWVEVSQMFYLFHAEQKWTLQETKDFVIKMIDFLEF

SEQ ID NO: 1434 - protein, 294 aa, Streptococcus merionis
MKYDESTLLSWTSPLSSTEEARVENTVRMIKDAINKNELLANYTIEVFAQGSYANNTNVKRNSDIDICVMLKSVFYPKYVEGKEQSDYGHLSSQFTFYDFKAEVIKSLELKFGYNSITIGNKCINISANSYHVNADVVPCLQYRNYEYLNSYSDSKYIEGIKFFTSYENKEVVNYPKVHNENGISKNNNTNYKYKKMVRIIKRIRNNMFDEGIKNETISSYLLECLVWNVPDYIFNSCKSYTQLLEAVLIFIVNNIDSNWCEVSNMFYLFHNQQKWNLNDTRAYIEMMSRYIKS

SEQ ID NO: 1435 - protein, 299 aa, Enterococcus faecalis
MSKFSESTLSGWTKPASVTEEDRIENTISMIKSAIKNDNNFDNLVYEVFVQGSYGNNTNVRTNSDIDVNIMLTSTFYSKYPEGKTNSDYGFTDGTITYNEYKNLILTALTNKFGTGNVTVGNKSIKITSNSYRVEADCIPSLLYRNYEYENSSSPNNYIEGIKYFASDNTSVVNYPKVHINNGIEKNNQTHKNYKRLVRVIKRLRNKMTAENHFTNENITSFLIECLIWNVPNNYINDYDTWDETIKQTLIFIKSSINDNSYKNWTEVSGMFYLFHNNRKWTSDDVSSFVNSLWSFMEY

SEQ ID NO: 1436 - protein, 313 aa, Enterococcus faecalis
MIQYYQKNKLGVFILSKFSESTLSGWTKPASVTEEDRIENTISMIKSAIKNDNNFDNLVYEVFVQGSYGNNTNVRTNSDIDVNIMLTSTFYSKYPEGKTNSDYGFTDGTITYNEYKNLILTALTNKFGTGNVTVGNKSIKITSNSYRVEADCIPSLLYRNYEYENSSSPNNYIEGIKYFASDNTSVVNYPKVHINNGIEKNNQTHKNYKRLVRVIKRLRNKMTAENHFTNENITSFLIECLIWNVPNNYINDYDTWDETIKQTLIFIKSSINDNSYKNWTEVSGMFYLFHNNRKWTSDDVSSFVNSLWSFMEY

SEQ ID NO: 1437 - protein, 313 aa, Enterococcus faecalis
MIQYYQKNKLGVFILSKFSESTLSGWTKPASVTEEDRIENTIKMIKSAIKNDNNFDNLVYEVFVQGSYGNNTNVRTNSDIDVNIMLTSTFYSKYPEGKTDSDYGFTDGTITYNEYKDLILTALTNKFGTGNVTVGNKSIKITSNSYRVEADCIPSLLYRNYEYKNSSSPNNYIEGIKYFASDNTSVVNYPKVHINNGIEKNNQTHKNYKRLVRVIKRLRNKMTAENHFTNENITSFLIECLIWNVPNNYINDYDTWDETIKQTLIFLESSINDNSYKNWTEVSGMFYLFHNNRKWTSDDVSSFVNSLWSFMEY

SEQ ID NO: 1438 - protein, 299 aa, Enterococcus wangshanyuanii
MSKFSETTLSSWTKPASTTEEDKINNAISMIKSAIKNDTNFDNLSYEVFVQGSYGNNTNVRVNSDIDVNIMLTSTFFPEYPEGKDGSNYGFTNGSISYDEYKQLVLTALINKFGSDKLSVGNKSIKIDSNSYRVEADCIPSFQYRNYKYNSSSSERNFVEGIKYFASDHTSVVNYPKVHIKNGIAKNTQTGRNYKRLVRVIKRLRNKMALDNYFNNENITSFLIECLIWNVPNKYINNYDTWDETIKQTLIFLNESIKDSSYEKWGEVSEMLYMFHSGRKWTINDVQSFINSLWMFMEY

SEQ ID NO: 1439 - protein, 298 aa, Butyrivibrio sp.
MRYPENTLQSWTNPLSETEENRVDNTIRMIRDAIQSKDELSNVEFEIFAQGSYANNTNVRQNSDIDICVMLKSSFYTNYEEGTSSADFGYTDGEMSFDDFREYVIDALRSKFGYASVSPQNKCIDIDANSYHVNADVVPALQYRDYKIIHSRNKDRFVEGIKFFSQTGAQVINYPKDHISNGRKKNNDTNYKFKKLVRIMKRIRNEMVFDGKLNGEIITSFLVECLVWNVPNSHITKYDSWNDTLQDSIAYLWNAINDGNADEWGEVSERLYLFRGRKWTMQDTKDFLGKMYNYLGFK

SEQ ID NO: 1440 - protein, 298 aa, Coprobacillus sp.
MKYSETTLQTWTAPLSSTEEERVENTINMIKAAIRSHNELSLMSYEIFAQGSYANNTNVRQNSDIDICVMLTSTFFGNYEDGTKASDYGFSDGSISFSDFKKYVIEALRDKFGDLNVKVGNKCIDIDANSYHVNADVVPAFQYRDYKIIHSKKADRFVEGIKFFAQNDEMVINYPKEHLKNGREKNNATNYQYKKLVRIMKHIRNNMVGEGLIDGEIITSFLVECLVWNVKNTYITKYDSWNETLQNSIAFLWNEINDGNAKEWGEVSERLYLFHSGRKWNQDSAKQFLGKMYSYLGY

SEQ ID NO: 1441 - protein, 294 aa, Bacteroidetes bacterium
MMEFTEDIFNKWILPPDDLDEEKLSDAVKIITDIIHEDKILGKMKIEVFGQGSYSNDTNVKLNNEIDINVRYMDNFYLDLQQEKNDSDFGLNARCNYSSLEFKSAVENTLVNKFGKEAIERNDKYIYVKGNVNRIAQYIVPTCQYRRYSGKDSYEVGVKFQTDKGDWISNFPLQHIANAKTKNYRTQNKFKHLVRIFKRLRYKMIEDGDYIKAPSFLLECLAWNIPDKIYNDNDSWSKLLKQSLIYLFNNIRNPNLCKNWYEASGLLPLFHSDRKWTVEDVNIFLVRVWIYLKL

SEQ ID NO: 1442 - protein, 295 aa, Cecembia lonarensis
MAKYTEDQLTSWTKPPSDSEQTKLENSEKMVREAISSDEKLSKKTIETFGQGSYANNTNVRLNSDIDINVKYSDGFYFDLPKDKSREDFGITLTSYSYEEYKDDVENALVNKFGRSEVVRKDKCITVKENSYRVETDVVPTWDYRRYSENGNYVQGTKFKTDKGIWIDNYPKQHIANGISKNNNTARRFKRLTRLHRKLRYKMIDDGGNVSDNITSFLLECLVWNVPNRIMNDYDTWTERLKQSIIYLYNNTREESSCKEWGEVSELLYLFHGGRKWTSKDVNSYMVLLWNHLEF

SEQ ID NO: 1443 - protein, 295 aa, Cellulophaga baltica
MAKFTEETLTNWTKPPSNSEQTKLENSERMVRDAISSDAKLKTKSTETFGQGSYANNTNVRLNSDIDINVRYTGGFYYNLPAEKTKEDFGITPTTYSFSEFKNDVENALVNKFGRSEVVRNDKCITVKENSYRVETDVVPTWNYRRYSTDGNYVLGAKFISDKGTEVINYPKQHIQNGINKNNNTSRRFKRLTRLHRKLRYKMQEDGINVSDNITSFLIECLVWNVPNTKIDNYYSWTERLKQSIIYIHEQTKEQDSCNEWGEVSELLYLWRGNRKWSRADVNQYMVQLWQYLEF

SEQ ID NO: 1444 - protein, 298 aa, Fulvivirga imtechensis
MPKFSEQTLTNWTKPPSESEQTKLENSEKMVRDAINSAEKLKNKSTETFGQGSYANDTNVRLNSDIDINVRYTGGFFFDLPNDKSEADVGIDKLPPSGYSFNEFKNDVENALVQKFGRDDVKRNDKCITIVGNTYRIQTDVVPTWNYRRYNKSGSYVLGAKFFADKGNGIVNFPKQHISNAISKNTDTYRRFKRLTRLHRKLRYRMIEDGENVNENITSFLLECLTWNVPNHIMNNYDTWTERLKQSIIYLYNHTKTLEDCKSWGEVSELFYLFHGGRKWSSKDVNQYMGQLWNYLEF

SEQ ID NO: 1445 - protein, 299 aa, Chryseobacterium caeni
MAKYSEDTLTSWTKPPSETEQTKLENSERMVREAINDDPKLKTKSTETFGQGSYANDTNVKLNSDIDINVRYTGGFYFELPENTTETDIGLDKLGSTAYTFKEFKDDVENALVRKFGRSEVVRNDKCITIKENTYRIQTDVVPTWNYRRYNKNGTFVLGAKFFPDNSAWGIVNFPKQHIENAINKNSNTSRRFKRLTRLHRKVRYKMIDDGIKVSDNITSFLLECLVWNTPNQIMNEYDSWTERLKQSIIYIYQQTTEDSTCKEWGEVSELLYLFYSGRKWSRSDVNEYMVQLWNYLEF

SEQ ID NO: 1446 - protein, 298 aa, Latescibacteria bacterium
MAKFTEETLSSWTKPPSDSEETKLQNAERMVHEAIKDDGKLSELSTEIFGQGSYANDTNVRLNSDIDINIRYTGGFYFDLPDGKTRSDYGLNSPSDYSVEEFKNDVETALAIKFGRNSIKRKNKCITVLGNSYRVETDVVPTWNYRRYSEDGSYVLGAEFRTDNCEWIINFPKQHIENGKYKNSNTSKRFKRLTRIYRRLRYKMIDEGESVSDNITSFLLECLIWNIPNGIFNNYGTWTDRLRESIIYLYQNTKEEETCKKWGEVSELLYLFHSERKWSREEVNNFLVLAWNFLEFIQ

SEQ ID NO: 1447 - protein, 296 aa, Nitrosomonas ureae
MPRFSEDTLSNWTKPPSDTEETKLSNAERMVREAINEDPILSSKTTEVFGQGSYANDTNVRLNSDIDINVRYTGGFYFDLPEGISRDDFGLNSPSEYSLCEFKNDVYAALVRKFGGNSVKRKNKCITVLGNSYRVETDVVPTWNYRRYDKSGTYVLGAKLRIDSGEYVVNYPQQHIENGKIKNANTNRRFKRLTRIYRKLRYKMLDDRFPVSDSITSFLLECLVWNMPNSILNDNDTWQERLKESIIHLYQHTKDENKCDEWGEVSELLYLFRGNRKWTKSDINKFSEDAWSYLGY

SEQ ID NO: 1448 - protein, 293 aa, Lewinella persica
MPRISEQVLENWTNPPSNSEENKLSNSERMVREAISASPNLKSKTTETFGQGSYANNTNVKLNSDIDINVMYSDGMFYELPAGASSKDYGITPHSYTFTEYKKDIYDALVSKFGVNDVQWNDKCITIRGNTYRVETDVVPTWLHTRYESPNSTVEGCKFFSDNGKGILNYPKQHIQNGINKSNQTHRRFKKLTRIHRKLRYQLIDEGVIAKDPISSFLLECLVFNCPNDTFNKTSWNDRLKSSITFLYLSTDDAPKSNEWGEVSELLYLFKGRKWTQSDVKHYMGILWTYLEY

SEQ ID NO: 1449 - protein, 304 aa, Unknown
  Description of Unknown: uncultured Dysgonomonas sp. sequence
MPRFTEEQLNQMCRPASDTEETKLQNAEAILRKALSSSTIVQSSKYEIFGQGSYANNTNIRLNSDIDINVCYTDGFYYKIPEGKTANEYGLGNPTDYSFQAFKTNIEEMLVAYYGRSEVIRKNKCLTIKGNTNRIQIDVVPTWRYRRYDYANNRTYSEGVVLYGDDNQYKQVINYPKQHITNGISKNTDALRRFKRLTRIFKNVRIRMDNDSYHPNENITSFLLECLAFNVPTSTYVKNRYTCSWNDILKDSIYYLWDNTKEDSTTYNEWGEVSELLYLMRGHKWSRQDVHDYMYWMWNYLQLG

SEQ ID NO: 1450 - protein, 301 aa, Bacteroides thetaiotaomicron
MAKFTNEQLTAMARPASETEEQKLENAENAVKNALANYTLASGNYDVFGQGSYANNTNIRNNSDIDINVCYTGGFYYKIPEGKTREEYGLTNPSTYSYTQFKNDVERILVSHFGRNNVVRKNKCIHIKENTYRVEIDVVPTWKYRRYGDYHYHYEEGVILYADNDGKEIINFPKQHLKNGVLKNNDTSRRFKRLVRIVKNLHIRMKDEGYYNNANITSFLLECLTYNYPNSNFHIAQECDWNQILREYIYYFWSKTKEDSQDWTKWVEVSECLYLMFGHKWSRQDINSFMYNLWNYLEYNK

SEQ ID NO: 1451 - protein, 301 aa, Prevotellamassilia timonensis
MAKYTHEQLCLFAQPASETEETKLERAIEAVKRALGNSDIILSDKYEIFGQGSYANNTNVRNNSDVDINVCYTAAYYYELPKGKTKDDYGFSGNVQYSYSEFKNDIERMLVAYFGRNNVIRKNKCIHIQENTYRTEIDVVPTWEHRTYIGENNDPYNFYRGVKLWSDDGEEVINYPKQHKNNGINKNTNTQKRYKRLVRILKNINIKMADSGFYKNINITSFLIECLMYNYPNNALATSIYDWNSILQDVIRYFWNKTREDCYDWYQFLENSEFLYLMIKHKWDRSDVHEFMTKLWIFLEY

SEQ ID NO: 1452 - protein, 354 aa, Sphingomonas sp.
MFGLAPTAPTSALAGLFGGTPAPAPATPNILALLLNAGSGAAEGPCRSRSSWNDRFTHWERPESVSEGGTIERAKTNVSAAIADNSWLNGQRVRVEGQGSYFNRTNVRREADIDLRVVHPLLKVDYADNVYLPAAQGMLGYSDAGPTFQQIFNGLRVNLAKDLSTRFGRSNVEVGKKAIRIKGITGSRAEVDVVPAIRYHHVTWLTDAQRYLTLEGVAILSTDGRWTVNFPDQHAANGRAKRGRTGHQFKRTVRIFKRMQADMLRTGAMKARVPSFLVECLVYAVEDPYFTVPTDDRYGRVRRVAWRIKQLLSAAQAGLTEINDIKWLFHADQAWNHADALAFADAAIAYLGDA

SEQ ID NO: 1453 - protein, 378 aa, Sphingomonas sp.
MAAHDKINWLNEPIEPALGCGLGSIFGLAPTAPTSALAGLFGGTPAPAPATPNILALLLNAGSGAAEGPCRSRSSWNDRFTHWERPESVSEGGTIERAKTNVSAAIADNSWLNGQRVRVEGQGSYFNRTNVRREADIDLRVVHPLLKVDYADNVYLPAAQGMLGYSDAGPTFQQIFNGLRVNLAKDLSTRFGRSNVEVGKKAIRIKGITGSRAEVDVVPAIRYHHVTWLTDAQRYLTLEGVAILSTDGRWTVNFPDQHAANGRAKRGRTGHQFKRTVRIFKRMQADMLRTGAMKARVPSFLVECLVYAVEDPYFTVPTDDRYGRVRRVAWRIKQLLSAAQAGLTEINDIKWLFHADQAWNHADALAFADAAIAYLGDA

SEQ ID NO: 1454 - protein, 423 aa, Ferrovibrio sp.
MTFGKPPPRNPFDHLFSDQPGGGELFRLITALGQQQPPPPPPTYMDNELFRSLASMGQASAAAKALDVFGLTPLLEPYTPHSAKAVADGLGIADFISLSSINSAGALARLLEENYRSRRDWNDRFAHWQRPASVSEEGTIERAAANVRAALSASSWLVDQGLELCQQGSYFNNTNVRRDSDIDLRLVHPAVNVVFGPNVVPQYARGALGYAAGGRKFGDIFSDMRAHTSAALAKRFGAANIVPGSKAIKVRGITGSRAMVDVVPCVRLHIIDWVSDWSRYITTEGVAIIGNAGWIYNFPDLHHRNGKAKRQNTAHRFKRMVRIFKALRDDMEGRGIAGARVPSFLVECLVYAVEDGYFLHDEDLYGRVRRIALRMQARLAAPDAERTMLEISGVKHLFQPGQAWTFAQARNFMDAVVTHLGNA

SEQ ID NO: 1455 - protein, 325 aa, Alphaproteobacteria bacterium
MQQRNYMLEALALSRTRQSWNDRLAHWERPASDSEEEMIERAATMVRQIMSHNSWFAAEAVEIAPQGSYYNNTNVRQESDIDLRAVHPMIHVVYGDQVVKEYADSTLRYAFGGRTFDEVAGQMRIEMARELIATFGALNVGADGNKAIRVKGVPGSRAPVDVVPCFNLHVVHWDTVAHQYFVIKGIAIFSCDGRLTINFPDQHHGNGMQKRARTQLRFKRNVRMLKRLRDELVTGNVIKGEEVPSFLLECLVYAVEDDYFLVEADDRYGRLTRVVRRIHEQLDDPAWLRTAIEINGVKLLFGSHQAWTADSAKTFTAAAWSRLLA

SEQ ID NO: 1456 - protein, 323 aa, Tardiphaga sp.
MTDSRSLIEAAMTAARTRASWNSWLETAERPASDHEEAKILRAASLASDIVNKNAWLQVQGAVVCPQGSYYNNTNVRLEADMDLRVQVPQVQIEYMNGLDQARTSHLATYSTNSLSYAAINALVRSNLEHDLVDKFGRKNVDATGEKAIKVHGLDGSRADCDLVPTFELNVFMNDGLGAQMIEGVAILGRTGDWTYNFPDQHHDNGITKRSRTSHRFKRNVRMLKRLNYELLSRGDIARRIPSFYAECLVYGVEDDFFLIERDDRYDRLLRILKRLAEQLADANWCHMATEVNAIKFLFRNNSAWTPTEAAAFVRASINRLTS

SEQ ID NO: 1457 - protein, 322 aa, Methylobacterium pseudosasicola
MFDTRQIVEAAIAKERTRSSWNDRLWHWERPASDSEETKIQRAADAARLLVTGNATLCAESVQIRPQGSYYNNTNVRLEADMDLRVQLPGIITVYADGVSPLLADGVLGYSSTGRAASEIARSVRDALASDCRRRFGAANVSVGKKAVTVDGLSGSRADVDLVPAFHLHHVMADGLGGYLRHEGVVIVSADGSQTFNFPEQHHANGKAKRSRTQHRFKKNVRMLKRLNYELFDQGAIPKRIPSFLVECLVYVVEDWHFLVQEDRYDRLVRILRRLRVRLGDATWVETATEVNEIKYLFRSSQAWNLADARNFVDAALVRLGG

SEQ ID NO: 1458 - protein, 354 aa, Rhizobium sp.
MKDFEKRNAGFSGLAGLFNQEPTPPDPFGLSSIFDALKQDSVRTRSSWNDRFSHWETAESTTETKAIERARDMVHSALRENKWLANEGVMLGPQGSFTNRTNVRNEADIDLRVQHPSLRIECDSNVNFQAAYQAGTYFDSGRPFADLAQDMRNEISRDLKAHFGKGAVDDTGKKAIRVDGVAGSRGEVDVVPCFTLHHIRAGAGFVPFNTVHGVAILSTDGNWTMNYPEQHIANGRLKRTTTGHQFKRMVRIVKRLQTDMEEYGVLEERVPSFLIECLIYLVEDHHFVYNEDRYDRLKRILGRISEILSQGGFLSSYLLLEINGVKPLFGSGQAWTLEKAQRFVSSALRHLGNR

SEQ ID NO: 1459 - protein, 354 aa, Rhizobium oryzae
MNDFEEQNAGFSGLAGLFNQKPTLPDPFGLSSLFDSLKQDSVRTRSSWNDRFSHWETAESTTETKAIERARDMVHSALRENKWLANEGVVFGPQGSFTNRTNVRNEADIDLRVQHPSLRIECDPNVNFQAAYQAGTYFDTGRSFANIAQYMRTEISRDLKAYFGKGAVDDTGKKAIRVNGVDGSRGEVDVVPCFTLHHIRAGAGFVPFNTAQGVAILSTDGSWTMNYPEQHIANGRLKRATTGHQFKRMVRIVKRLQTDMEEYGVLEERVPSFLIECLVYLVEDHHFVYNEDRYDRVKRVLGRVSEILSQGGFLSPYLLLEINGIKPLFGSSQAWTLDKAQRFVNSALRHLGSR

SEQ ID NO: 1460 - protein, 350 aa, Sinorhizobium medicae
MIDDKRNAGFFGLGVPQSRDKSQDFTGLASFFETALNDSVRRRATWNERFTHWERSESTTETVAIERGRTTVERILSQNQWLVSEGVRFAPQGSFTNRTNVRNEADIDLRVQHPVLRIEHEPGVNPYVAAGTFGYFDEGRTYSQIATDMRLKIAADLKSALGKQNVDASGKKAIRIKGVSGSRGEVDVVACFTLHHVYVPTGEWAYNRVEGVAILGTDGAWTFNYPDQHIANGRRKRTTTRHQFKRMVRIIKRMQADMSGHGVITERVPSFLVECLVYLVEDQHFLYSEDRYDRVKRILRRSLEIVSQDGPVLYSLREINGIKPLFGVQAWTVEKARRFLASAISHLGTC

SEQ ID NO: 1461 - protein, 353 aa, Rhizobium etli
MSDFSKGNGGLFGLGLGIPQPAERKNDLIGLGSIFKSLNESVRRRSSWNDRFAYWEKAESTTETIAIERGRSVVQGILENNRSLISEGVRFVPQGSFTNRTNVRNEADIDLRVQHPLLRIEHEAGVDPASASNAYGYYDAGRTYAQIAGDMRSTIATELKASLGKTNVDDSGKKAIRVKGVTGSRGEVDVVPCFTLHHIYIPHGTFQYERIEGVAILGLDGTWTLNYPDQHIANGRLKRATTNHQFKRIVRIVKRMQSDMTDHGVITVRVPSFLVECLVYLVEDHNFVMNEDRFDRVKRILKRSLEIISQPGLNLNYYPEINGIKPLFGARQAWTVEKARWFLATAIRHLGDC

SEQ ID NO: 1462 - protein, 401 aa, Unknown
  Description of Unknown: Rhodomicrobium sequence
MRIIANGFTFPTGTGIVAFGSADLPTHSDCFRGRTMAGLFDNQKNPLMDIWFGSGPEPKPSLGELLVGPEAVQAKVGAAMSPLLSALFPQAGSVRSRAEWNAWLEHRQKPASPTEEQMLERARRYVIDAIQRSEGLVARGVRVEPQGSYFNNTNGRTLADVDLRVVDPGIYIEYALGVVPAEAYQAFGYYPTGVTNSQRLQWLRAELLTALSDKIKKGVGPGKKAIKIEGITGSRADVDVVPCMNYHGIINVAGQYRVLPGIILLSTGGQFIINFPEQHHANGVRKRERTAHRFKRVVRCFKHMGEEMVKHGVLPANAPSFLIECLVYLVDDGQFLVDADLYGRMRRIAQSMQHILQNPYTALELTEINEIKLLFGPHQPWTLATAQEFADAAVLYLGNLS

SEQ ID NO: 1463 - protein, 294 aa, Parcubacteria bacterium
MNVSDERINTWAKALSETEDNRCENAKSMVVEAMRERFGNSITIIHQGSHRNRTNIRTDSDVDIAVVYDDIYYSDLRNLPNEHHAGHWAGVSTPVYTFAQFKNDVHQALNDKFGLGYATRKNKCIRVAGNTYRVNADVVPAFQSKRYNSPNLVSEVGIGILTDGGTVIHSYPEQHYASGVAKNDETSQAYKAIVRVLKNTRREMEDKGLLAKDSMSSFLIESLVWNAPEHRFLNSTYREDARDVLSHIWTDMRDASAHPNYKEVSQLEWLLRGTNHTPTKAEVFTKAAWNYLAP

SEQ ID NO: 1464 - protein, 293 aa, Candidatus Collierbacteria bacterium
MNVSDDRLALWARPLSETEDAKCVSAREQITQAMRAKFGNSVRVFLQGSYANRTNVRQDSDIDIVVVHTDFYFPDVSLLPQEQQSTYWASFKPATYTYDDFRNEVHTTLLSTFPSMVQPKEKCLKVAGNTTRMNADVIASFTHHRFYSPTDIEHTGIAFNTRSGTRVESFPEQHYDNGVVKNESTGRSYKQVVRILKNVRNALIESRSIDEKLVSSFFIECLVWNVPDEYFEGTSNREIARAVVAKIWHDMRDPNISKDYLEISKLFWLFRGQPRTTAQAEAFMLKAWHYLEP

SEQ ID NO: 1465 - protein, 294 aa, Sphingobacteriales bacterium
MATTEQQLISWSKPVSTTEDEKCKRAISQITEAIRNKFGGNVSIFLQGSYENNTNVRKDSDVDIVVRHDGYFYDDLQRLNDNDKKIYEANRRPGDYQFDQLKDDVHKALISAFGSDAKRKNKCIEVLGNSYRITGDVVPCFVHKRFATLTTTEVEGIQFYSDTGTKIISFPKQHYQNGVIKTESTGRMYKRIVRILKVIKNSLIDSGKITEDLASSFFIECLVYNVPNDQFVFGNYTQILKNVITKVYNDMGDLEVANKYVEVSGYKWLFGSDAKRPPANGKEFMLKCWQYAEF

SEQ ID NO: 1466 - protein, 292 aa, Elizabethkingia meningoseptica
MNFSEQQLINWSRPVSTTEDLKCQNAITQITAALRAKFGNRVTIFLQGSYRNNTNVRQNSDVDIVMRYDDAFYPDLQRLSESDKAIYNAQRTYSGYNFDELKADTEEALRNVFTASVERKNKCIQVNGNSNRITADVIPCFVLKRFSTLQSVEAEGIKFYSDDNKEIISFPEQHYSNGTEKTNQTYRLYKRMVRILKVVNYRLIDDGEIADNLVSSFFIECLVYNVPNNQFISGNYTQTLRNVIVKIYEDMKNNADYTEVNRLFWLFSNRSPRTRQDALVFMQKCWNYLGYQ

SEQ ID NO: 1467 - protein, 292 aa, Elizabethkingia sp.
MNFSEQQLINWSKPVSTTEDLKCQNAISQITAALRAKFGNRVTIFLQGSYRNNTNVRQNSDVDIVMRYDDAFYSDLQRLSESDKAIYNAQRVSAGYNFDELKADTEEALRNVFTTSVERKNKCIQVNGNSNRITADVIPCFVLKRFSTLQSVEAEGIKFYSDDNKEIISFPEQHYSNGTEKTNQTYRLYKRMVRILKVVNYRLIDEGEISDDLVSSFFIECLVYNVPNNQFISGNYTQTLRNVIVKIYEDMKNNADYTEVNKLLWLFSNKSPRTRQHALVFMQKCWNYLGYQ

SEQ ID NO: 1468 - protein, 292 aa, Elizabethkingia miricola
MNFSEQQLINWSRPVSTTEDLKCQNAISQITAALRAKFGNRVTIFLQGSYRNNTNVRQNSDVDIVMRYDDAFYPDLQRLSESDKAIYNAQRVSAGYNFDELKADTEEALRNVFTTSVERKNKCIQVNGNSNRITADVIPCFVLKRFSTLQSVEAEGIKFYSDDNKEIISFPEQHYSNGTEKTNQTYRLYKRMVRILKIVNYRLIDEGEISDNLVSSFFIECLVYNVPNNQFISGNYTQTLRNVIVKIYQDMENNADYTEVNKLLWLFSNRSPRTRQNALVFMQKCWNYLGYQ

SEQ ID NO: 1469 - protein, 293 aa, Flavobacterium sp.
MNFDEQQLITWSKPISTTEDQKCQNVISQVTAALKAKFGNKISIFLQGSYRNNTNVKQNSDVDIVMRYDDAYYSDLHRLSESDKALYNAQKTSAGYSFDQLKADTELALRNVFSSDVKRKNKCIQINGNTNRITADVIPCFVLKRFRNLTTIEAEGIKFYSDENDAIISFPDQHYTNGTRKTNETYRLYKRMVRILKVVNYRLIDDRKISDTLVSSFFIECLVYNVPNEYFMSGNYTQTLKNVIEKIYTDMKNNAEYKEVSELLWLFSIRTPRTHKDAMNFMQYCWDYLGYED

SEQ ID NO: 1470 - protein, 293 aa, Candidatus Melainabacteria bacterium
MALSEQQIKNWARALSETENSKCVNTVSAIRKVLEDHFGSKIKVFLQGSYANSTNVRQDSDVDIVACYQDAYFPNYSFLDQVERVVYESNATAHDYKFSEFKNDVMILLRSNFGTSVERKEKCIHIKGNIYRVNVDVVPCFLHSRFMPSGVTIEGIELRTDTAKIPVKNFPDQHKANGQEKNQLTDQKYKAVVRILKNCRNFLIDNNHIDEKFMPSFFLECIVWNVPNSCFMNDSYKEMTNNVISKIYDDMSVQETANNYAEISDLIWLFKGQTKRTPAIANQFLKQVYGVIN

SEQ ID NO: 1471 - protein, 292 aa, Candidatus Taylorbacteria bacterium
MITDQQLQNWSSPLSETENARCSATVALITKVLKDKFGSKVDIFLQGSYKNSTNVKQDSDVDIVICYQDAFFPEISSLSPQDKALHKTYYSDSEYTFTQFKDEVEQVLKANFSGSVERKNKCVRVIKNSYRVNADVIACFVHKRFSTATTVEAEGIELVSDDGNRVKSFPKQHYENGVEKNKNTDQVYKSIVRTIKKCRNHLIDNNHIDDKAMSSFFLECLVWNIPHTHFKNYSFKEKVNNVIKKLYEDMSIVETAQEYAEVSDLLWLFKGQNVRTHEQAKTFLEKVYALIN

SEQ ID NO: 1472 - protein, 298 aa, Omnitrophica bacterium
MAISRDQIDRWSNAPSEREETKCQNTVERVKQIIRNHFGNDVYIYLQGSYRNRTNVKAESDVDIVIEHPNYYFPGLSSLSDVERTKYNASSIAAEYSFDRFKADVHALLQSDFGSTYVKRKNKCIRVEKDAYRVNADVIPCYTYKRFSTATLVEVEGIGLKADSGEVIDSFPKQHYENGASKNLSTDGRYKGVVRVLKNVRNELLDQRQISEDLMRSFFLECLVWNVPNSDFNYGSLYDTTRQIIFRIWDDMVKPEKASNYAEVSDLKWLLRGSESTSKINNARMFMEKAWQFIGYQS

SEQ ID NO: 1473 - protein, 295 aa, Candidatus Daviesbacteria bacterium
MSISEDQLTRWAKPPSETEEDKCRMTRERIERALRAEFGDSIRVFLQGSYKNRTNVKQESDVDIVVEYTGTYFHELHMLSPQELQRYWELHIPVTYPYHKFKDDVARILTDEFDPGEVKRVDKCIKVFKNGERIHADVIPCFTHNCYATATTVAHKGIHFITDAGIDTFNYPEQHHENGETKNVITKGKFKDMVRILKNIRYDLIDAGTISKKEMASYFIESLVWNLPNSIFAGAENSTMLKNIIILIYGDMGDSKKAEEYREIHNLRLLLPATGYTAQQARTFMEQTWTHLGFD

SEQ ID NO: 1474 - protein, 316 aa, Klebsiella pneumoniae
MGIPESQLDTWSHQGSITQSASTYSIIKNALESANTEYHGKNFKVFLQGSYGNDTNIYAESDVDVVICLDDVYYSDLTQLSPEDKEAYDRAFVPATYLYTQFKQDVLEALTERFGSDVKVGDKAIVVAANGSRRKADVIASMQFRRYWKFKGHYDSQYDEGICFFNSAGERIANYPKQHSENLTLKHQASNKWLKPMVRVLKNLRSKLIADGKLKSGLAPSYYLEGLLYNVPNEKFGTSYSDCFVNAMNWIQTEADKDKLLCANEQYYLLWEGTHTSWEKADAEAFIGAAIKCGMNGEVSPRNCCLKVRQTVSRRN

SEQ ID NO: 1475 - protein, 297 aa, Klebsiella aerogenes
MGIPESQLDTWSHQGSITQSASTYSIIKNALESANTEYHGKNFKVFLQGSYGNDTNIYAESDVDVVICLDDVYYSDLTQLSPEDKEAYDRAFVPATYSYTQFKQDVLEALTERFGSDVKVGDKAIVVAANGSRRKADVIASMQFRRYWKFKGHYDSQYDEGICFFNSAGERIANYPKQHSENLTLKHQASNKWLKPMVRVLKNLRSKLIADGKLKSGLAPSYYLEGLLYNVPNEKFGTSYSDCFVNAMNWIQTEADKDKLLCANEQYYLLWEGTHTSWEKADAEAFIGAAIKMWNEW

SEQ ID NO: 1476 - protein, 297 aa, Klebsiella sp.
MGIPESQLDTWSHQGSITQSASTYSIIKNALESANTEYHGKNFKVFLQGSYGNDTNIYAESDVDVVICLDDVYYSDLTQLSPEDKEAYDRAFVPATYSYTQFKQDVLEALTERFGSDVKVGDKAIVVAANGSRRKADVIASMQFRRYWKFKGHYDSQYDEGICFFNGAGERIANYPKQHSENLTLKHQASNKWLKPMVRVLKNLRSKLIADGKLKSGLAPSYYLEGLLYNVPNEKFGTSYSDCFVNAMNWIQTEADKDKLLCANEQYYLLWEGTHTSWEKADAEAFIDAAIKMWNEW

SEQ ID NO: 1477 - protein, 297 aa, Serratia odorifera
MGIPESQLDTWSHQGSIAQSASTYSIIKNALESANTKYHGKNFKVFLQGSYGNDTNIYAESDVDVVICLDDVYYSDLTQLSPEDKEAYDRAFVPATYSYTQFKQDVLEALTERFGSDVKVGDKAIVVAANGSRRKADVIASMQFRRYWKFKGHYDSQYDEGICFFNGAGERIANYPKQHSENLTLKHQASNKWLKPMVRVLKNLRSKLIADGKLKPGLAPSYYLEGLLYNVPNEKFGTSYADCFVNAINWIQTEADKDKLLCANEQYYLLWEGTHTSWEKADAEAFIDAAIKMWNEW

SEQ ID NO: 1478 - protein, 297 aa, Enterobacter hormaechei
MGIPESQLDTWSHQGSIAQSASTYSIIKNALESANTKYHGKNFKVFLQGSYGNDTNIYAESDVDVVICLDDVYYSDLTQLSPEDKDAYDRAFVPATYSYTQFKQDVLEALTERFGSDVKVGDKAIVVAANGSRRKADVIASMQFRRYWKFKGHYDSQYDEGICFFNGAGERIANYPKQHSENLTLKYQASNKWLKPMVRVLKNLRSKLIADGKLKSGLAPSYYLEGLLYNVPNEKFGTSYADCFVNAMNWIQTEADKDKLVCANEQYYLLWEGTHTSWEKADAEAFIDAAIKMWNEW

SEQ ID NO: 1479 - protein, 297 aa, Klebsiella pneumoniae; identical to SEQ ID NO: 1478

SEQ ID NO: 1480 - protein, 297 aa, Enterobacter cloacae
MGIPESQLDTWSHQGSIAQSASTYSIIKNALESANTKYHGKNFKVFLQGSYGNDTNIYAESDVDVVICLDDVYYSDLTQLSPEDKDAYDRAFVPATYSYTQFKQDVLEALIERFGSDVKVGDKAIVVAANGSRRKADVIASMQFRRYWKFKGHYDSQYDEGICFFNGAGERIANYPKQHSENLTLKHQASNKWLKPMVRVLKNLRSKLIADGKLKSGLAPSYYLEGLLYNVPNEKFGTSYADCFVNAMNWIQTEADKDKLVCANEQYYLLWEGTHTSWEKADAEAFIDAAIKMWNEW

SEQ ID NO: 1481 - protein, 297 aa, Escherichia coli
MGIHESQLDTWSHQGSIAQSASTYSIIKNALESANTKYHGKNFKVFLQGSYGNDTNIYAESDVDVVICLDDVYYSDLTQLSPEDKDAYDRAFVPATYSYTQFKQDVLEALTERFGSDVKVGDKAIVVAANGSRRKADVIASMQFRRYWKFKGHYDSQYDEGICFFNGAGERIANYPKQHSENLTLKHQASNKWLKPMVRVLKNLRSKLIADGKLKSGLAPSYYLEGLLYNVPNEKFGTSYADCFVNAMNWIQTEADKDKLVCANEQYYLLWEGTHTSWEKADAEAFIDAAIKMWNEW

SEQ ID NO: 1482 - protein, 297 aa, Yersinia enterocolitica
MGIPESQLDTWSHQGSIAQSASTYNTIKNALESTNTEYHGKNFKVFLQGSYGNDTNIYAESDVDVVICLDDVYYSDLTQLSPEDKEAYDRAFVPATYSYNQFKQDVLKALTERFGTDIKVGDKAIVIAANGGRRKADVITSMQFRRYRKFKGNYDSQYDEGICFFNDAGERIANYPKQHSENLTLKHQASNKWLKPMVRVLKNLRSKLVADGKFKSGLAPSYYLEGLLYNVPNEKFGTSYADCFVNAMNWIQTEADKDKLLCANEQYYLLWEGTHTSWEKADAEAFIDAAIKMWNEW

SEQ ID NO: 1483 - protein, 297 aa, Pseudomonas aeruginosa
MGIPESQLETWSRQGSITQSASTYGTIKSALESAGTEYHGKNFKVFLQGSYGNDTNIYAESDVDVVIRLDDVYYSDITRLSPEDKAAYDRAFVPATYSYDQYKRDVLKALTDRFGSDVKAGDKAIAVAANGSRRKADVIASMQFRRYWKFKGTYDSQYDEGICFFNGAGERIANYPKQHSDNLTRKHQSSNKWLKPMVRILKNLRSKLVADGKLKAGLAPSYYLEGLLYNVPNEKFGISYADCFVNSMNWIQTEANKDKLLCANEQYYLLWEGTHTSWEKADAEAFIEAAIKMWNDW

SEQ ID NO: 1484 - protein, 297 aa, Pseudomonas aeruginosa
MGIPESQLETWSHQGSITQSASTYSTIKNALESASSAYHGKNFKVFLQGSYGNDTNIYAESDVDVVIRLDDVYYSDLTQLSPEDKEAYDHAFVPATYSYDQYRQDVLKALTDRFGSDVKAGDKAIAVEANGNRRKADVIASMQFRRYWKFKGTYDSHYDEGICFFNGAGERIANYPKQHSENLTRKHQASNKWLKPMVRVLKNLRSKLVADSALKAGIAPSYYLEGLLYNVPNEKFGISYADCFVNAMNWIQTEADKDKLLCANEQYYLLWEGTHTSWEKTDAEAFIGAAIKMWNEW

SEQ ID NO: 1485 - protein, 297 aa, Escherichia coli
MGIPESQLETWSHQGSITQSASTYSTIKNALESAGAAYHGKNFKVFLQGSYGNDTNIYAESDVDVVIRLDDVYYSDLMQLSPEDKEAYDRAFVPATYSYDQYKRDVLKALTDRFGSDVKAGDKAIAVAANGGRRKVDVIASMQFRRYWKFNGTYDSHYDEGICFFNGAGERIANYPKQHSENLTKKHQGSNKWLKPMVRVLKNLRSKLVADGTLKAGIAPSYYLEGLLYNVPSEKFGVSYFDCFVNAMNWIQTEADKDKLLCANEQYYLLWEGTHTSWEKANSEAFIEAAIRTWNDW

SEQ ID NO: 1486 - protein, 297 aa, Hydrogenophilales bacterium
MGIPESQLKVWSHQGSITQSATTYSVIKNALEATSTAYHGKNYKVFLQGSYGNDTNIYAESDVDVVIRLDDVYYSDVTQLSREDKEAYDQAFTPATYSYDEYKKDVLKALTDRFGSDVKAGDKAIAVAANGSRRKADVIAAMQFRRYWKFKSTYDTNYDEGICFFNGAGERIANYPKQHSENLTTKHQGSNLWLKPMVRVLKNLRSKLVADGALKAGVAPSYYLEGLLYNVPSEMFGSSYTDCFVGAMNWIQAEADKSKLVCANEQYYLLWEGSQTSWERVNAEAFIEAAIRLWNEW

SEQ ID NO: 1487 - protein, 297 aa, Shewanella sp.
MGIPESQLEVWSHQGSIKQSAATYHSIKDALETASAAYHGKNYQVFLQGSYGNDTNIYSESDVDVVIRLDDVYYTDLTSLSPEDKAIYDQARIPATYAYDQYKKDVIKALTDRFGSDVKVGDKAIAVAANGSRRKADVIAAMQFRHYWNFKSSQDAQYTEGICFFNGAGERIANYPKQHSQNLTAKHQDSNQWLKPMVRVLKNIRSKLVDNGTLQPGVAPSYFLEGLLYNVPNDKFSSSYADAFVDAINWIQNEADKTKLVCANEQYYLLRSGAPNCWESADADTFINASIDLWNTW

SEQ ID NO: 1488 - protein, 297 aa, Alcanivorax sp.
MGIPESQLEVWSHQGSIKQSAATYHAIKDALEAASAAYHGKNYQVFLQGSYGNDTNIYSESDVDVVIRLDDVYYDDLTSLSPEDKAAYDHARVPATYAYDQYKKDVIKALTDRFGSDVNEGDKAIAVAANGGRRKADVIAAMQFRRYWKFKSIHDAQYTEGICFFNGAGELIANYPKQHSENLTTKHQGSNQWLKPMVRILKNIRSKLVDNGTLQPGIAPSYYLEGLLYNVPNEKFGSSYADSFVNAINWIQNEADKSKLVCANEQYYLLRSGTLTCWEVADAEAFINASIDLWNTW

SEQ ID NO: 1489 - protein, 297 aa, Burkholderia cepacia
MGIPESQLETWSHQGSIIQSAKTYQTIKDALESANSAYYGKNFHVFLQGSYGNDTNIYSESDVDVVIRLDDVYYSDLTSLSPEDRVTYDRALIPATYAYDQYKKDVVKALVDRFGSDVTIGDKAIAITANGSRRKADVIAAMQFRRYWKFKSIYDTQYVEGICFFNGAGKLIANYPWQHSENLTSKHQGSNGWLKPTIRILKNLRGNLIDDGQLQPGIAPSYYLEGLLYNVPNESFGSSYADSFVNAINWIQREADKSKLVCANEQYYLLRSGTPTSWESADADAFISAAIRLWNAW

SEQ ID NO: 1490 - protein, 297 aa, Burkholderia anthina
MGIPESQLETWSHQGSITQSAKTYQTIKDALESANSAYYGKNFHVFLQGSYGNDTNIYSESDVDVVIRLDDVYYSDLTSLSPEDRVAYERALIPATYSYDQYKKDVVKALVDRFGSDVTIGDKAIAITANGSRRKADVIAAMQFRRYWKFKSTYDTQYVEGICFFNGAGKLIANYPRQHSENLTSKHQGSNGWLKPTIRILKNLRSNLIDDGQLQPGIAPSYYLEGLLYNVPNESFGSSYADSFVNAINWIQREADKSKLVCANEQYYLLRSGTPTSWESANADAFISAAISLWNAW

SEQ ID NO: 1491 - protein, 297 aa, Burkholderia pseudomallei
MGIPESQLETWSHQGSIVQSATTYRTIKNALENTKSAYYGKNFHVFLQGSYGNDTNIYSESDVDVVIRLDDVYYSDLTSLSPEDRVAYDRALIPATYAYDQYKKDVVKALADRFASDVTVGDKAIAIAANGSRRKADVIAAMQFRRYWKFKSIYDTQYIEGICFFNGAGKLIANYPRQHSENLTSKHQGSNGWLKPTIRILKNLRSNLIDYGQLQPGIAPSYFLEGLLYNVPNENFGSSYADSFVNAINWIQQGADKSKLVCANEQYYLLRSGTPTSWESTDADAFISAAIRRWNAW

SEQ ID NO: 1492 - protein, 297 aa, Thiobacillus denitrificans
MAISESQLDIWSHQGSIQQSSSTYNSIKSTLEAAGTPYSGKGYKVFLQGSYGNDTNIYAESDVDVVIRLDDCFYSDLSELSEAEKSAQEKAYSDAAYSYSDFKRDVLATLIAQYGSDVKEGGKAIAIGASGNRRKTDVIVAAQFRRYFKFNSNSDQSYAEGICFWNSAGERIANYPKQHSANLTANHQASNQWLKPMVRILKNMRSRCVDEGLLKAGTAPSYFIEGLLYNVPTDLLSKNYQNCFMNAFNWIQNEADKDKLVCANEQYYLLRDASHTCWPKPDGEAFINATISLWNDW

SEQ ID NO: 1493 - protein, 296 aa, Betaproteobacteria bacterium
MPIPESQLETWSHQGSITQSSATYNTIKDVLEGKNTPYAGKSYKVFLQGSYGNDTNIYSESDVDIVIRLDDCFHHDLSGLSPLQQEAFKSSNTDATYTHDDFQKDVLSVLSSRFGHDVDSGEKAIAITANGNRRKSDVIAATTYRRYHKFISSSDQSYDEGICFFTSSGEQIANYPKQHSENLTRKHQNTSRWFKPMARVLKNLRSRLITEGMLKSGVAPSYYLEGLLYNVPDSQFGKSYDDTFVNAMNWILGADRQDFICANEQYYLLREGSPVTWRTEKCDEFLNAAVDLWKQW

SEQ ID NO: 1494 - protein, 296 aa, Ignavibacteria bacterium
MAIPEAQLETWSHQGSITQSSSTYATVKNALEEVGSAYHDKNYKVFLQGSYGNDTNIYSESDVDVVIQLDSTFYYDIDDLPQNQKEAFQNSLTNATYSWAQFKNDVLTHLSSKYPSAISSGEKAIKISASGNRRSADVIAAAQFRRYYKFNSPSDQNYNEGICFFNSNGFRIANYPQQHSKNSTAKHQATNSWFKPIVRIFKNMRSKLVADGIIKNDIAPSYYIEGLLYNVPNDKFGKSYADTFVNAINWIDSADKTKFVCANEQYYLLRKDVLVCWGPDNADEFIKSIINLWNNW

SEQ ID NO: 1495 - protein, 297 aa, Burkholderia cenocepacia
MSEAQLETWSHQGAIRGSSLTYQAIKSTLENADSPYAGKNIEVFLQGSYGNATNIYAESDVDVVILLKDCFQQDLKALSEEQKTAWRAAYHDAVYAHRDFKKDVVSVLRDAYGGDVTVGDKAIAIAARGVRRKADVIAAIGYRRYYRFNGLRDQSYDEGICFYDAAGTRIANYPKQHAENLTAQHQATQQRLKPMVRIWKNLRSALVEAAAIEAGAAPSYYLEGLLYNVPVDKFVGSYGDTFVNVYNWLVTEADKTQLVCANRQYYLLRDNAPTCWAPAQCEAFLAATLAYWDDWGA

SEQ ID NO: 1496 - protein, 297 aa, Burkholderia sp.
MPIPEAQLETWSHQGAIQGSSSTYQSVKTILESKDAAYAGKSFDVFLQGSYGNATNIYSESDVDVVIVLKDCFQSDLENLSEEERVAWKGAHHDATYTHTDFKRDVLSVLVDAYGNDVNIGDKAIAIEANGARRKADVIPAIQYRRYYKFNGLHDQQYDEGICFYNAAGERIANYPKQHSANLTTRHQATNQWLKPMVRIWKNLRSKLVADGEIEAGTAPSYYVEGLLYNVPVEKFGESYEASFVNAFNWLVREADKSKLVCANEQYYLLRDNAHTCWAPAKCDVFLDATARLWKNW

SEQ ID NO: 1497 - protein, 297 aa, Pseudomonas aeruginosa
MPIPEAQLETWSHQGAIQGSSSTYQSVKTILESKDAAYAGKSFDVFLQGSYGNATNIYSESDVDVVIVLKDCFQSDLENLSEEERVAWKGAHHDATYTHTDFKRDVLSVLVDAYGNDVNIGDKAIAIEANGARRKADVIPAIQYRRYYKFNGLHDQQYDEGICFYNAAGERIANYPKQHSANLTTRHQATNQWLKPMVRIWKNLRSKLVADGEIEAGTAPSYYVEGLLYNVPVEKFGESYEASFVNAFNWLVREADKSKLVCANEQYYLLRDNAHTCWAPAKCDAFLDATAKLWKNW

SEQ ID NO: 1498 - protein, 297 aa, Bordetella ansorpii
MPIPEAQLETWSHQGAIKGSSSTYQSIKGKLESKDAAYAGKNVEVFLQGSYGNDTNIYSESDVDIVIVLKDCFQSDRKSLSEVEQAAWRSAHHDATYTHADFKRDVLALLVDAYGNEVNVGDKAISIDASGTRRKADVIPAIQYRRYYKFNGLHDQRYDEGICFYNAAGECIANYPKQHSANLTTRHQATNQWLKPMVRIWKNLRTKLVEDGKIEAGAAPSYYIEGLLYNVPVEKFGSSYETSFVNAFNWIVTDADKTKFVCANEQYYLLRDSAHTCWEPAKCDAFLDAAAKLWKDW

SEQ ID NO: 1499 - protein, 297 aa, Achromobacter xylosoxidans
MPIPEAQLETWSHQGAIKGSSSTYQSIKAKLESKDAAYAGKNVEVFLQGSYGNDTNIYSESDVDIVIVLKDCFQSDRKSLSEVEQAAWRSAHHDATYTHADFKRDVLALLVDAYGAEVNVGDKAISIDASGTRRKADVIPAIQYRRYYKFNGLHDERYDEGICFYNAAGECIANYPKQHSANLKTRHQAANQWLKPMVRIWKNLRTKLVEDGKIEAGAAPSYYIEGLLYNVPVEKFGSSYEASFVNAFNWLVTDADKTKLVCANEQYYLLRDSAHTCWEPAKCDAFLDAAAKLWKDW

SEQ ID NO: 1500 - protein, 297 aa, Burkholderiales bacterium
MAIPESQLVTWSHQGSIAQSSTTYNSIKGVLEGNGTPYAGKNYKVFLQGSYGNDTNIWAESDVDIVICLNDCWQRDIEALSPDDTAAYQGAFVDATYGHVEFKNDVVAALTARYGADVKVGDKAIALAANGTRRKADVIAAIQFRRYYRFKSASNSTYDEGICFYNAAGERIANYPRQHSANLTQKHKDTSQWFKPVARVFKNMRSRLVDDGLLKPGVAPSYYIEALLHNVPSGLFGTNYQSSVANVIDWYRNEADKTQLVCANHQYYLLRNGAHTCWNQANCDAFVDAAVELWHSW

SEQ ID NO: 1501 - protein, 247 aa, Nitrosomonas europaea
MPISESQLETWSHQGSITQSSTTYNTIKSVLEASTTPYASKNFKVFLQGSYGNDTNIYAESDVDIVIRLDDCFHSDLESLSDDEKSAYKQAFNDATYTHADFKRDVLSVLEGQYGSAVKAGDKAIAINASGSRRKSDVIVATQFRRYFKFRSASDSEYVEGICFFNATGERIANYPKQHSANLTAKHQASSKWLKPMVRVLKNMRSRMVEDGLIKAGIAPSYESPRVLRRLQLLREWSHEQSNKVFP

SEQ ID NO: 1502 - protein, 247 aa, Nitrosomonas europaea; identical to SEQ ID NO: 1501

SEQ ID NO: 1503 - protein, 297 aa, Thiobacillus sp.
MPIPESQLETWSHQGSITQSSSTYKTIKSVLEDSTTPYAGRNFKVFLQGSYGNDTNIYAESDVDIVIRLDDCFHSDLESLSDDEKSAYKQAFSDATYTHADFRRDVLSVLEGQYGSAVKAGDKAIAIDASGSRRKSDVIVATQFRRYFKFRSASDSEYVEGICFFNSAGERIANYPKQHSANLTAKHQASSQWLKPMARVFKNMRSRMVEDGLIRAGIAPSYYIEGLLYNVPNEKLTTSYQDCVVNTLNWYRQEASKTDLVCANEQYYLLRDGYHTCWRQAACDAFIEAAVQLWNDW

SEQ ID NO: 1504 - protein, 297 aa, Bordetella hinzii
MPIPESQLETWSHQGSITQSSSTYNTIKSVLEDSTTPYAGRNFKVFLQGSYGNDTNIYAESDVDIVIRLDDCFHSDLESLSDDEKSAYKQAFSDATYTHADFKRDVLSVLEGQYGSAVKAGDKAIAIDASGSRRKSDVIVATQFRRYFKFRSASDSEYVEGICFFNSAGERIANYPKQHSANLTAKHQASSQWLKPMARVFKNMRSRMVEDGLIKAGIAPSYYIEGLLYNVPNEKLTTSYQDCVVNTLNWYRQEASKTDLVCANEQYYLLRDGYHTCWRQAACDAFIEAAVKLWNDW

SEQ ID NO: 1505 - protein, 297 aa, Bordetella hinzii
MPIPESQLETWSHQGSITQSSNTYNAIKSVLEANTTPYAGKNFKVFLQGSYGNDTNIYAESDVDIVIRLDDCFHSDLESLSDDEKSAYKQAFSDATYTHTDFKRDVLSVLEDQYGSAVKTGDKAIAIDASGSRRKSDVIVATQFRRYFKFRSASDSEYVEGICFFNAAGERIANYPKQHSANLTAKHQASSQWLKPMARVFKNMRSRMVEDGLIKAGIAPSYYIEGLLYNVPNEKLTTSYQDCVVNALNWYRQEASKTDLVCANEQYYLLRDGYHTCWRQAACDAFIEAAVKLWNEW

SEQ ID NO: 1506 - protein, 297 aa, Thauera sp.
MPIPESQLETWSHQGSITQSSNTYNTIKSVLEASTTPYAGKNFKVFLQGSYGNDTNIYAESDVDIVIRLDDCFHSDLESLSDDEKSAYKQAFSDATYTHADFKRDVLSVLEGQYGSAVKAGDKAIAIDANGSRRKSDVIVATQFRRYFKFRSASDSEYVEGICFFNAAGERIANYPKQHSANLTAKHQASSKWLKPMTRVFKNMRSRMVEDGLIKAGIAPSYYIEGLLYNVPNEKLTTSYQDCVVNALNWYRQDASKTDLVCANEQYYLLRDGFHTCWRQAACDAFIEAAVKLWNEW

SEQ ID NO: 1507 - protein, 278 aa, Xanthomonas campestris
MPIPESQLETWSHQGSITQSSSTYNTIKSVLEDSTTPYAGRNFKVFLQGSYGNDTNIYAESDVDIVIRLDDCFHSDLESLSDGEKSAYKQAFSDATYTHADFKRDVLSVLEGQYGSAVKAGDKAIAIDASGSRRKSDVIVATQFRRYFKFRSASDSEYVEGICFFNSAGERIANYPKQHSANLTAKHQASSQWLKPMARVFKNMRSRMVEDGLIKAGIAPSYYIEGLLYNVPNEKLTTSYQDCVVNNLNWYRQEASKTDLVCANEQYYLLRDESTRVS

SEQ ID NO: 1508 - protein, 297 aa, Acidovorax avenae
MAIPESQLETWSHQGSITQSSNTYNTIKNVLEGSTTPYANKNFKVFLQGSYGNDTNIYAESDVDIVIRLDDCFHSDLKSLSEDEKSAYKDAFNDATYTHVDFKQDVLSVLEGQYGSAVKAGDKAIAIDASGSRRKADVIVATQFRRYFKFRSTDDSEYVEGICFFNAAGERIANYPKQHSANLTSKHQGSSKWLKPAVRVLKNMRSRMVDEGLIKAGVAPSYYIEGLLYNVPPDKLSRSYENCIVNILNWYRQDASKTDLVCANEQYYLLRDGHHTCWSQSNCDAFVEAAVDFWNQW

SEQ ID NO: 1509 - protein, 297 aa, Pseudomonas aeruginosa
MPIPESQLETWSHQGSITQSSNTYNAIKSVLEASTTPYAGRNFKVFLQGSYGNDTNIYAESDVDIVIRLDDCFQSDLESLSDDEKSAYQKAFSDATYTHTDFKRDVLSVLEDQYGSAVKTGDKAIAIDASGSRRKSDVIVATQFRRYFKFRSASDSKYVEGICFFNAAGERIANYPKQHSANLKAKHQASSKWLKPMARVFKNMRSRLVESGLIEAGIAPSYYIEGLLYNVPNEKFTTSYQDCVVNILNWYWQDAAKTDLVCANEQYYLLRDGYHTCWSQTDCDALVEVAVDLWNQW

SEQ ID NO: 1510 - protein, 297 aa, Nitrosomonas eutropha
MPIPESQLETWSHQGSITQSSNTYNTIKSVLEASTTPYAGKNFKVFLQGSYGNDTNIYAESDVDIVIRLDDCFHSDLESLSDDEKSAYKQAFSDATYTHTDFKRDVLSVLEDQYGSAVKTGDKAIAIDASGSRRKSDVIVATQFRRYFKFRSASDSEYVEGICLFNAAGERIANYPKQHSANLTAKHQASSKWLKPMVRVLKNIRSRMVDEGLIKAGVAPSYYIEGLLYNVPNEKFTHSLEDCMVNILNWYRQDAAKTDLVCANEQYYLLRDGYHTCWSQTDCDALVEAAVDLWNQW

SEQ ID NO: 1511 - protein, 297 aa, Burkholderia ubonensis
MSIPESQLETWSHQGSITQSSDTYNTIKNVLEASAVPYAGKNFKVFLQGSYGNDTNIFAESDVDIVIRLDDCFYSDLTELTEEDKEAYKSAFLDATYTHVDFKRDVLSVLSQQYGDAVTVGDKAIAIDANGSRRKADVIVASQFRRYFKFRSSDDSQYVEGICFWNGKGERIANYPKLHSANLTTKHQNTSSWLKPMARVFKNMRSRMVGDGLIDAGVAPSYFVEGLLYNVPNEKLASSYQNCVVNTLNWYLQEAAKIDLVCANEQYYLLRDGYHTCWTQANCDAFVKAAVELWNEW

SEQ ID NO: 1512 - protein, 297 aa, Burkholderia cepacia
MPIPESQLETWSHQGAITQSSNTYNTIKNVLEASSTPYAGKGFKVFLQGSYGNDTNIFSESDVDIIIRLDDCFMSDLSDLTEDEKVAHKSAFRNATYTHVDFKRDVLSVLTQQYGKAVNAGDKAIAIDASGSRRKADVIVAIQFRRYFKFLSANNSDYAEGICFWNGKGERIANYPTQHSTNLTTKHQNTSKWFKPTARVFKNMRSRMVDEGLLKAGVAPSYYIEGLLYNVPSEKLTSSYQDCVVNTLNWYRQEASKTDLVCANEQYYLLRDGYHTCWQQTNCDAFVEAAVKLWNEW

SEQ ID NO: 1513 - protein, 297 aa, Oxalobacteraceae bacterium
MPIPETQLATWSHQGSITQSSETYNSIKNVLEASTTPYADKNFKVFLQGSYGNDTNIYAESDVDIVICLDDCFQSDLTDLTEEERGAYKAAFKDATYTHVEFKRDVLAVLRARYGDAVKAGHKAIMIAANGVRRKADIIVAIKYRRYSKFSSLTGAAYVEGICFWDSNGRMIANYPKQHSANLTLKHQNTNKWFKPMARVLKNIRSRLVSDGLINAGAAPSYYVEGLLYNVPDAKFASSHQECLLQVLNWYLKDASKADLVCANKQYYLLCDDYATCWNQADCDAFIQATITLWNEW

SEQ ID NO: 1514 - protein, 297 aa, Unknown
  Description of Unknown: Pseudomonas sequence
MPIPESQLETWSHQGSVAQSSSTYNSIKDVLEDATTPYVDKNFKVFLQGSYGNDTNIYAESDVDIVIRLDDCFFSDTDWLSEEEKTVHKHAFKSSAYTHVDFKRDVMSVLQAQYGKAVNARGKAIAIDANGSRRKSDVIAAIQYRRYSKFRSNTDSAFIEGICFFSADGQQIANYPKQHSANMTFKHQATSGWLKPMARVFKNMRSRMISEGLIERGTAPSYYLEGLLYNVPTDRFRTSYSDCVANVVNWYREEANKSELVCANEQYYLLRDGYHTCWPQDHCDAFIEAAVRLWNNW

SEQ ID NO: 1515 - protein, 297 aa, Pseudomonas alcaligenes
MPIPESQLETWSHQGSVAQSSSTYNSIKDVLEDATTPYADKNFKVFLQGSYGNDTNIYAESDVDIVIRLDDCFFSDTNWLSGEEKEAHKYAFKSATYTHVDFKRDVLSVLKAQYGKAVNAGGKAIAIDANGSRRKADVIAAIQFRRYSKFRSTTDSEYIEGICFFNADGEQIANYPKQHSANLTSKHQATSGWLKPMARVLKNMRSRMISEGLIEAGTAPSYYLECLLYNVPINRFTTSYSDCVANVVNWYREEANKNELVCANEQYYLLRDGYHTCWPQDQCDAFIEAAVKLWNNW

SEQ ID NO: 1516 - protein, 246 aa, Bordetella parapertussis
MPIPESQLDTWSHQGSITQSSNTYNSIKKVLEASTTPYAGKSIEVFLQGSYGNDTNIYAESDVDIVIRLDDCFFSDLGSLSEEEKAAHKQAFSDAMYTHVDLKRDVLSVLTDQYGSAVNAGKKAITIEANGSRRKADVIVATQFRRYSKFRSPSDSEYAAGICFFNTAGERIANYPKQHSAHLTSKHQASSKWLKPMARVFKNMRNRMVGHGLIKADVAPSYYIEGLLACRTISSRQATRTASSTR

SEQ ID NO: 1517 - protein, 246 aa, Bordetella parapertussis; identical to SEQ ID NO: 1516

SEQ ID NO: 1518 - protein, 297 aa, Variovorax boronicumulans
MGIPEDQLNTWAKQGSIQGSSETYNLVKETLEEDVAPYHGKDVSVFLQGSYGNDTNIIGESDVDIVIRLKDCWQSDLSELNEEQKTAYKEAYSNATYGHVEFRKDVLIVLRNEYGKGVEDGNKAIYVPPSDARRATDVVAAIQFRRYFKFNGLQDQSYAEGICFYDKAGTRIANYPKQHSENMTKRHQDSNEWLKPMVRIIKNARTKMVNDEALEAGIAPSYFLEGLLYNAPLECFGTNYNTSLQKVLQWMYDTEDDTKWVTANEQYYLLRDGYATCWPTGNYATFKNAIIKLWNDW

SEQ ID NO: 1519 - protein, 296 aa, Deltaproteobacteria bacterium
MAIPESQLEIWAHQGSITQSSNTYTTIKRALEASDTKYADKTYEVFLQGSYGNDTNIYAESDVDVVIRLDSVYYYDITALTAGEQARFNAALIPGTYSYATYKADVIAALLKSFGTVDVKPDKKAVKIKSSGSRRNADVVVAAEFRRYFSGLLGPQYEPGICFFNSSGDRIANYPKQHSANCTAKHQATHGWFKPMVRILKNMRSRLVDDGSIEQGSAPSYFLEGLLYNVPNDKFGGSYNDTFVAAVNWILQAERNNLECANKQHYLVRDFDATCWPYGNCDRFLNALTQLWNEWS

SEQ ID NO: 1520 - protein, 301 aa, Bradyrhizobium sp.
MAIPETQLETWTHVGAAAQSAATYQSIKGVIEHKDAPYSSRRIDSFLQGSYGNDTNVYGADSDVDIVLRTRGLLHYNIDALSGPEKTAFKTAYPTPAEYTLKSFRTDVIAWLDKQYGSDLDTSGKKALRLKANGTRRSSDILLVAPHKKYSRYYSEQDKECIEGVLFITTNGTEIVNYPKQHSENMTRKHQATAEWLKPTVRIFKNMRNRLIRDGKIKSGVAPSYFIEGMLYNVPVSEFGVSYANTVDKCWGWLNSPPDASALMCANGIHPLVRDNSHTSWPIQGYLDFLAETQKLWVQWK

SEQ ID NO: 1521 - protein, 301 aa, Bradyrhizobium japonicum
MAIPETQLETWTHIGAAAQSAATYQSIKGVIEHKDAPYSSRRIDSFLQGSYGNDTNVYGADSDVDIVLRTRGLFHYNIDALSGPEKTAFKTAYPTPAEYTLESFRTDVVAWLDKQYGSDLDTSGKKALRLKANGTRRSSDILLVAPHKKYSRYFSEQDKECIEGVLFITTNGTEIVNYPKQHSENMTRKHQATAEWLKPTVRIFKNMRNRLIRDGKIKSGVAPSYFIEGMLYNVPVSEFGVSYANTVDKCWGWLNSPPDAGALMCANGIHPLVRDNSHTSWPIQGYLDFLAETQKLWVQWK

SEQ ID NO: 1522 - protein, 281 aa, Bradyrhizobium japonicum
MAIPETQLETWTHIGAAAQSAATYQSIKGVIEHKDAPYSSRRIDSFLQGSYGNDTNVYGADSDVDIVLRTRGLFHYNIDALSGPEKTAFKTAYPTPAEYTLESFRTDVVAWLDKQYGSDLDTSGKKALRLKANGTRRSSDILLVAPHKKYSRYFSEQDKECIEGVLFITTNGTEIVNYPKQHSENMTRKHQATAEWLKPTVRIFKNMRNRLIRDGKIKSGVAPSYFIEGMLYNVPVSEFGVSYANTVDKCWGWLNSPPDAGALMCANGIHPLVRDNSHTSW

SEQ ID NO: 1523 - protein, 301 aa, Afipia sp.
MAIPESQLETWTHIGAAAQSAATYQSIKAVIEHKDAPYSNRRVDSFLQGSYGNDTNVYGADSDVDIVLRTRGLFHYNIDALSGPEKTAFKSVYPTPAEYTLKSFRTDVIAWLDKQYGGDLDTSGKKAPRLKANGNRRSSDILLVAPHKKYSHYYSEQDNECVEGVLFITTNGTEIVNYPKHHSENMTRKHQATGEWLKPTVRIFKNMRNRLIRDGKIKSGVAPSYFIEGMLYNVPVSEFGVSYVNTVNKCWGWLNSPPDAGDLMCANGIHPLIRDNSHTSWPIQGYLDFLAETQKLWLYWK

SEQ ID NO: 1524 - protein, 302 aa, Bradyrhizobium elkanii
MAIPENQLETWTHIGAAAQSAATYQSIKGVIESSNAPYASRRIDSFLQGSYGNDTNVYGADSDVDIVLRTKAFFHYNLDSLSEGEKTAFRTVHPTDSKYQLANFRDDAIKWLYDQYKTDLDTSGKKALRLKATDNRRSSDILLVAPHRKYTRYYSEQDKQCVDGVMFITTDGTSIINYPKQHSENMTWKHQNTEERLKPTVRIFKNMRNRLIRDGKLKSGSAPSYFIEGMLYNVPANQFVRSRQATVENCWGWINNCNSHADLTCANGIHPLVRDNTHTSWSVQGYIDFLEGVRRLWQGWPF

SEQ ID NO: 1525 - protein, 297 aa, Ochrobactrum lupini
MAIPKAQLETWSRIGAQQTSKDTHTNIRAIIDSPDSPHYQRQPSTFLQGSYRNDTNIWAESDVDIVAKVQSIYYYDISALSAIDQEDFRRKSPPTEYTLQKFKVEVIAWLQKHYGTDLELSSNKAVTIAARGNRRKADILISSTFRRYHYAGFMGAQAAEGIMFVTNEGKWIENYPVYHSNNLTARHQETDNWLKPAIRIFKNMRNEARDQGILPEGIAPSYFVEGLLYNVPVHVFGQSYFETVRQTLIWLLQADRNAFICANGQHQLVASNSPVSWHPDHCRDFLAGLVNLWDSWR

SEQ ID NO: 1526 - protein, 296 aa, Duganella sp.
MAIPEADLKTMAAIGAQITSKETYSTVKLALEANDTGYASKNYNVFLQGSYGNDTNIYRESDVDVVVCLDSIFTYDLTNLPLEQSQAFTAVHGPAKYTYTHFRDDVLAALYARFGEYVKPGSKAILIEPLHNRRKADVLIAIQHRRYNRYVSASDQSFVQGISFHKQDGNRVANYPKQHKANMITKNQSTNEWFKHIVRIFKNSRQKLIEQGMIGKGVAPSYYLEGLLYNVPLEMFGTSYDESMVKCINWLLAADRRKFVCANEQYNLLNDNSDVSWNSESCDTFLNGLVHLWNNW

SEQ ID NO: 1527 - protein, 286 aa, Duganella sp.
MAAIGAQITSKETYSTVKLALEANDTGYASKNYNVFLQGSYGNDTNIYRESDVDVVVCLDSIFTYDLTNLPLEQSQAFTAVHGPAKYTYTHFRDDVLAALYARFGEYVKPGSKAILIEPLHNRRKADVLIAIQHRRYNRYVSASDQSFVQGISFHKQDGNRVANYPKQHKANMITKNQSTNEWFKHIVRIFKNSRQKLIEQGMIGKGVAPSYYLEGLLYNVPLEMFGTSYDESMVKCINWLLAADRRKFVCANEQYNLLNDNSDVSWNSESCDTFLNGLVHLWNNW

SEQ ID NO: 1528 - protein, 296 aa, Proteobacteria bacterium
MGIPEDDLIVMANIGAQVTSKETYATVKTALQSADAGYAGKSYDVFLQGSYGNDTNIWRESDVDVVIRLDAIFTYDIDNLPQDQKAAFHAAHPAATYTHRHFRDHVLEVLYRRFGEDVDPGTKAVRINPRNNRRKADVIIATQHKKYRSYHGQGHDDPTTGISFHRLDDTRIVNYPKHHRQNLIDKNQETGENFKRMVRIFKNARQKLIEQGALEVGVAPSYYIEGLLYNAPDHLYAGRYQDQFTGVVNYLWDADRSQFVCANEQYPLLDGNPDVTWNNRDCFTYLNGVVGLWNGW

SEQ ID NO: 1529 - protein, 306 aa, Methylocystis sp.
MTIPEFQLERWSHLGAVTTSKDTYATIKRALESPDAGYSGRSYKVFLQGSYGNDTNIYSESDVDIVICCADAFYYDLDHLSLEHKGAFNANRVSATYAYATFKADVQAALVAAFGSSVQVANKAFKIAAAGNRRSADVVAAFEHRRYIEFKNAISQSFYEGISFFTTDGRRINNFPNYHSNNLTAKHQATGNRFKPAVRIFKNIRSKATEIGLLEKGDAPSYFIEGLLYNVPNEKFISGFSDTTLGILSWLYENADRTQFVCANERYYLLRDNDSVCWPRAKGTKFINAAITLWNEWQDQSRTRFI

SEQ ID NO: 1530 - protein, 298 aa, Elusimicrobia bacterium
MTISESQLETWAKQGAVTTSASTYATIKAALESSTAGYAGKDYEIYLQGSYGNDTNIYKESDVDIVIQLNSTFFKDISKLPPDQVALYNQSFVTAEYLYATYKADVIKALKDTFGDDVVSGKKAIKIKAKGNRRSADVIPACQYRRYKHFRSHRDQDYTEGIYFKGSDGTSIKNYPKEHSKNLTQHHQATGQMLKPFTRILKNMRTRLVDEGAIDADLAPSYFIEGLLYNAPKSEFKGNYQDTFVAVMEWLRKADRTDFVCVNYQYYLLRGDSLVTWTPEKCQTFITAIIKMWNDGRV

SEQ ID NO: 1531 - protein, 296 aa, Pelagibacterium sp.
MAIPEEQLEVWSKQGSISGSRDTYAAIKGALEDANAPYSGHGFSTFLQGSYGNDTNVWSESDVDVVMRLDDAFQYDVDRLTDDSRARFDRAYAGVPYGYAEFKVEVASWMRAKYGNTVHVGTKAIRVDGNGNRRDADVLPCMRFRRYHRFNAMYDESYVEGICFYRNDGLRIENYPKQHADNCTTKHQGTNGWFKPMARVIKNMRNRMVSGGLIRDGLAPSYYIEGLLYNLPSPLFDHSFERTFLQFWNWTSRADKTNFVTANEQFYLLRNGFPTSWEPADCEDFLTALARFWDDW

SEQ ID NO: 1532 - protein, 297 aa, Neorhizobium galegae
MGIPEAQLNTWSAQGAAQQSRDTYATIKAALEDANAPYATHEHSSFLQGSYGNDTNVRGRDSDVDVVMRLDNRFLYDLEAVGEPGSTAFHQAFPNVDYGYDDFKRDVTAWMFQKFGVDVEPGTKAIRIKGRNNRRDADVLPCIRFRRYYNFKSASEQSYAEGICFFASDGTKIINYPILHKDNCTVKHQATNSYFKAMVRIIKNMRNRMVEEGLLEEGLAPSYYLEGLMYNVPNNSFGTSYSQTFINSMNWLVKTDRTKLVCANEQYYLLRPNSPVCWQEEKCKAFLDATIDYWNNW

SEQ ID NO: 1533 - protein, 296 aa, Sinorhizobium americanum
MAIPEAQLDVWSAQGSVTQSKNTYASLKAVLEDPASPYHAKSFTILLQGSYGNDTNVYADSDVDLVIRLDSTFNYSLENLSEMAKTDFDSAFANVEYGYADFKKDVLSWLFTKYGSAVHPGNKALYVAGNGNRRDADVLPCVSFRKYRKFNSMNDQDYVEGICFFFPDGTRIINYPRQHSDNLTWKHQQTGGWLKPAVRILKNMRNRMVNDGVIEEGLAPSYYLEGMLYNVPTDLFGTTYAHTLTHALAWLAKTDRSKLVCANEQYYLLWKDTRTSWDPDKCELFLDRVLDFWNNW

SEQ ID NO: 1534 - protein, 298 aa, Limnothrix sp.
MAIPESQLQTWSVQGSITQSATTYDTIKKVLNDSSSPYHLNDFSVFLQGSYGNNTNVWKDSDVDIIIRLNQTFYSDISQLEQVAKSSFGATYPDAQYGFHEFRTEVIDWLTKHFGSDVKPGKKAVFIKGNSGRRDADILVCAKLRRYRKGSSGTDSQYDEGICFFLPDKTRVINFPEQHRENCTTKHQNSNEWFKKLVRIYKNMRNRMIEDGYLADGVAPSYFIEGMLWNVPNNIFGTSFEDSFINSFNWVLNSDKTQLACANDLYWLIREAGGNCWKPADFETYISAAKKYWNEWNT

SEQ ID NO: 1535 - protein, 298 aa, Polaromonas sp.
MAIPESQLKTWSAQGSITQSAATYDTIKAVLDESLSPYYVKDFSLFLQGSYGNDTNVWKDSDVDIIIRLNQTFYSDLSQLEQGAKSSFGTKYPDVQYGVHEFRAEVIDWLTRHFGTDVKPGKKAIFIKGNSGRREADVLVCAKLRRYRKGSTGTDNQYDEGICFFLPDNTRVINFPEQHRDNCTSKHQNSNEWFKKMVRVYKNMRNRMVEDGYLADGVAPSYFIEGMLWNVPDSKFGTSFEDSFVNSFNWVNNSDKTRLACANDLYWLIREGEGNCWKSADFETYMGAVKKYWSVWNT

SEQ ID NO: 1536 - protein, 297 aa, Pseudacidovorax intermedius
MAIPESQLEVWSHQGSVTQSAQTYEAIRTVLNDSTSPYYPKQFSIFLQGSYGNNTNVYRDSDVDIVICLDQTYYSDKNALSESAKGSYDRAFSPATYSYDDFKADVLAWLTKKFGSSVVPGKKAILIKGNDTRRNADVLVCAKHRRYRAHSNGNDNQYDEGICFWTSSGMQIVNFPKQHADNCTTKHQNTNSWFKPVVRIYKNMRNRMIDDGYLVEEIAPSYFIEGMLWNVPALKFGASYGSSFVDTFNWVAEADKTKLACANDLFWLVRDNNHNCWPNANFGAYLAATKRYWNDCN

SEQ ID NO: 1537 - protein, 298 aa, Burkholderia sp.
MAISESQLETWSHLGSVQQSAKTYETIQKALNDGSSPYSAKDFSVFLQGSYGNGTNVYRDSDVDVVIQLNQTYYANTNALDPDAKANYDRAFSPATYTYREFKADVLAWLQEKFGSDVKPGKKAIFIKGNGSRRDADVIVCSQHRRYRAASTGIDYEYDEGIIFWANDGAEIVNFPKQHSESCTRKHQNTNSQFKRMVRICKNMRNRMIDDGYIADGVAPSYFLEGMLWNVPADQFVQSYEESFVNIFNWVLRADKTQLACANDLYWLVRDNANVCWSTGNFDAYLAAARTYWNDWKN

SEQ ID NO: 1538 - protein, 298 aa, Burkholderia cenocepacia
MAISESQLETWSHLGSVQQSAKTYETIQKALNDGSSPYSAKDFSVFLQGSYGNGTNVYRDSDVDVVIQLNQTYYANTNALDPDAKANYDRAFSPATYTYREFKADVLAWLQEKFGSDVKPGKKAIFIKGNGSRRDADVIVCSQHRRYRAASTGIDSEYDEGIIFWANDGAEIVNFPKQHSESCTRKHQNTNSQFKRMVRICKNMRNRMIDDGYIADGVAPSYFLEGMLWNVPTDQFVQSYEESFVNIFNWVLRADKTQLACANDLYWLVRDNANVCWSTGNFDAYLAAARTYWNDWKN

SEQ ID NO: 1539 - protein, 296 aa, Bradyrhizobium elkanii
MAISEAQLETWNKLGPTAQFTSTYEALRDVLNDSSSPYWPKSFEIFLQGSYKNSTNVYGDSDVDVVIRLDSIFYTDLYFLSEEEKQRYNSQRTEGNYSLEEFKTSVISWLTKKYGNDVQPGNKAVFIKGNGTSRRDADVLICAKLRRYYSFPEFGQPHYVDGICFFLPSGIRIENFPEKHAENCTTKHQDTRQWFKPTVRIFKNLRNTMIKNKIIEDGLAPSYFIEGMLYNVPPTKFGGSEQMNFKDVLNWLLSADRDKFVCANEQFKLLGGAHVTWPAANCTQFLNAVKSYNDAA

SEQ ID NO: 1540 - protein, 296 aa, Bradyrhizobium japonicum
MTISEDQLKTWAKQGPTAQFTATYDTLKNCLNDSNSPYYPKDFSVFLQGSYKNDSNVYGDSDVDVVIQLNQTYYSDLSNLSEEDKKLYNAARSGAGYTLDQFKKDVTGWLVKKYGTDVQPGTKAIYIKGNGSRRNADVLVCCKHRRYIRFKSWADQHYYEGISFFNSGGMRIDNFPTQHSDNCTKKHQDSKNWYKHTVRIYKNLRNTMIEKKLVEDSLAPSYFLEGLLWNVPLDHFGGKEQQNFRDTLEWLWMADRSKFTCANDLYYLCHPTSLVTWRAEQCEKFLSKAIDYWNEA

SEQ ID NO: 1541 - protein, 293 aa, Sinorhizobium sp.
MISESQLETWSQLGKAAQFTDTYNSIRNNLFHPSAPYPVDRIDVHLQGSYGNDTNVWGDSDVDVVLCHAGAFYYDVTNMGAQDQVFLKAAFSADAAYRYEDFRGDAQRYISGLYCDVDLSGKAIYIPGNNGRRNADILVCQQFRRYYSLKNGMHDYQPGIAFIRNGARIENFPKQHSENCTLKHQATNQNFKRMVRIFKNMRNSMITKDLLGHKVAPSYFIEGMLYNVPNDKFVGSYQDMWIKCFNWIVTADSSELTTASGLHWLVRDGSPVCWPSANFRAFTAALKYHWESS

SEQ ID NO: 1542 - protein, 293 aa, Unknown
  Description of Unknown: Alphaproteobacteria sequence
MAIAEAQLETWSQQGKTGQFTDTYNSIRGNLLDGSAFYPVKDIEVHLQGSYGNDTNVWADSDVDVVLCHNGAFYYDISAMSQAEQDAFKGVFSANAAYGYNEFKGDAERYINQLYNGVVAGGKALHVPGNNGRRNADILICQQFRRYYSYQSGVHGYHSGVAFYVNGSRIENFPKQHSDNCTAKHQATNQNFKRVVRIFKNMRNTMIGKGLLADKIAPSYFIEGMLSNVPNDKFVGSYQDMFVECFNWVVNADRTKLTTASQLHWLVRDGSSVCWSTASFDDFTAALKEFWES

SEQ ID NO: 1543 - protein, 295 aa, Afipia broomeae
MAIAESQLDTWSQQGKTAQFTTTYNSIREKLLDGHAPYPVKNVEIRLQGSYGNDTNVWADSDVDIVLKHTGAFYHDLSEMPAEKQQAFTKAYGADAAYGYHHFKTDALKWINGLYKDDVDSYGKKAVKVRGNGNRRNADIIICQEFRRYRDFNGIGHEEFAEGIAFYIGNQRIENFPKQHSDNCTAKHQETGNFKHMVRIFKNMRNRMIENGFLAEGIAPSYFIEGMLWNVPKDKFAGTYAEAWVACFNWIVTTDKTKLTTASGLHWLVRDNSPVCWPTANFNTFTAALKKYWES

SEQ ID NO: 1544 - protein, 296 aa, Afipia broomeae
MVAIAESQLDTWSQQGKTAQFTTTYNSIREKLLDGHAPYPVKNVEIRLQGSYGNDTNVWADSDVDIVLKHTGAFYHDLSEMPAEKQQAFTKAYGADAAYGYHHFKTDALKWINGLYKDDVDSYGKKAVKVRGNGNRRNADIIICQEFRRYRDFNGIGHEEFAEGIAFYIGNQRIENFPKQHSDNCTAKHQETGNFKHMVRIFKNMRNRMIENGFLAEGIAPSYFIEGMLWNVPKDKFAGTYAEAWVACFNWIVTTDKTKLTTASGLHWLVRDNSPVCWPTANFNTFTAALKKYWES

SEQ ID NO: 1545 - protein, 295 aa, Afipia broomeae; identical to SEQ ID NO: 1543

SEQ ID NO: 1546 - protein, 295 aa, Afipia broomeae
MAIAESQLETWSQQGKTAQFTTTYNSIREKLLDGRAPYPVKKVEIRLQGSYGNDTSVWADSDVDIVLKHTGAFYHDLSEMPAEKQQAFTKAYGADAAYGYHHFKKDALNWINELYKDDVDGSGKKAVKVSGNGNRRNADIIICQEFRRYRDFNGIGHEEFAEGIAFYVGNQRIENFPKQHSENCTAKHQGTGNFKHMVRIFKNMRNRMIENGLLAEGIAPSYFIEGMLWNVPKDKFAGTYVDAWVACFNWLVTTDKTKLTTASGLHWLVRNNSPVCWPMANFNTFTAALKKHWES

SEQ ID NO: 1547 - protein, 296 aa, Afipia broomeae
MVAIAESQLETWSQQGKTAQFTTTYNSIREKLLDGRAPYPVKKVEIRLQGSYGNDTSVWADSDVDIVLKHTGAFYHDLSEMPAEKQQAFTKAYGADAAYGYHHFKKDALNWINELYKDDVDGSGKKAVKVSGNGNRRNADIIICQEFRRYRDFNGIGHEEFAEGIAFYVGNQRIENFPKQHSENCTAKHQGTGNFKHMVRIFKNMRNRMIENGLLAEGIAPSYFIEGMLWNVPKDKFAGTYVDAWVACFNWLVTTDKTKLTTASGLHWLVRNNSPVCWPMANFNTFTAALKKHWES

SEQ ID NO: 1548 - protein, 293 aa, Rhodospirillales bacterium
MAIAERQLETWAKQGSTGQFTGTYNTMRGHLLDTSAPYRVANTEVFLQGSYGNDTNVYADSDVDVVLKHTGAYCYDLSHLSPEHRANYERASGGGVQYGYDQFKAHAEDYIKRLYNGVRVGKKAVFVPGNNGRRDADILICQEFRRYISYEPGNILYHEGVAFFSGGNRIDNFPKQHSANCTSKHQATNGNFKPMVRVFKNMRNTMIEKGYLADGVAPSYFIEGMLWNVPVDKFIGSYGYMFVACYNWIVNADVSKLACANNLYWLVQDNSSVCWPTVNFQTFTSALKAYWES

SEQ ID NO: 1549 - protein, 294 aa, Rhodospirillales bacterium
MVAIAERQLETWAKQGSTGQFTGTYNTMRGHLLDTSAPYRVANTEVFLQGSYGNDTNVYADSDVDVVLKHTGAYCYDLSHLSPEHRANYERASGGGVQYGYDQFKAHAEDYIKRLYNGVRVGKKAVFVPGNNGRRDADILICQEFRRYISYEPGNILYHEGVAFFSGGNRIDNFPKQHSANCTSKHQATNGNFKPMVRVFKNMRNTMIEKGYLADGVAPSYFIEGMLWNVPVDKFIGSYGYMFVACYNWIVNADVSKLACANNLYWLVQDNSSVCWPTVNFQTFTSALKAYWES

SEQ ID NO: 1550 - protein, 295 aa, Bradyrhizobium sp.
MIAESQLDIWASQGPTSQFTDTYDRIRSNLLDKGVPYPLAKTEVFLQGSYKNDTNVYGDSDVDIVLCYTGGFYKDLSRLSVEDRRAYDALSNGPAKYDYDDFKRDAAQYITRLYNSVNTGKKALYIPGNNSGRRNADVLIAYEFRRYYAFKSWQDQRFDEGVCFYPAGGSMIENFPKLHAQNCTTKHQNTKSYFKHMVRIFKNMRNTMIGKNLLANGVAPSYFIEGMLYNVPNDKFGGTYQETWINCFNHIVTANRDQLVCANNMHWLVRDNSPTSWPIANFNAFTAALKKYWES

SEQ ID NO: 1551 - protein, 293 aa, Methyloligella halotolerans
MAIAEARLERWSKQGKTGQFTDTYKSFRTHLMDKSAIYPVTDCEVFLQGSYANSTNVWADSDVDIVLKHNGAFYFDISGLPQQEKQAFNVRFSSNASYGYFDFKADAEKWVNQLFSGVRLGNKAVSILGNNSRRDVDVLIAQQFRHYYSTTLGNYSFHEGLAFYANGRRIVNFPKQHIENCTAKHQATNQNFKRIVRVYKNLRNEMIETGFLAKGIAPSYFLEGMLYNVPNEIFSGTYTDMLVNCFNWLVQADRTKLTCANELHWLVRDGSPTSWPIANFTAFFGAARQFWEN

SEQ ID NO: 1552 - protein, 295 aa, Aminobacter aminovorans
MPISDQQLQTWSHQGSVTQSKATHESIRAVLNSTESPYYLKSFDDFLQGSYANDTNIYADSDVDIVIRLTSTFYHNTDDLPPGEQAAYQRNHLPANYELPDFKRDVTAWLRRHYAGVTVGNKAIFIPGSGNRRDADVLVSAEHRYYKSYSGLVGPLYNEGIVFETANGRRIVNYPRLHRENLSNKNQATGSWVKRTVRVFKNMRNRMIEQGYLGAGVAPSYFIEGLLYNVPNNLYGHSHLVSVTNCLNFIQNSNRDDLTCANELHWLVRDYQDVCWSTANYERFRTSLRHFWNNY

SEQ ID NO: 1553 - protein, 298 aa, Rhodovulum sp.
MAISEDQLETWSHQGSVQQSSATYLSIKKVLEDSNAPYAGRRFDVFLQGSYGNKTNVWSESDVDVAICLTSVYYSDTGRLSADEKERYDANWSSANYSFKDFRAEVSAWLRANFGNSVTLGKKAIKVPGGSSRRDADVLACVQHRDYYSYPTNGRPSYHEGICFWTSDGDKIINYPHQHLANCTAKNGNANERFKPNIRVLKNMRNAMIDAGLIADGIAPSYFVEGMLYNIPNDHFNWTHQQTVENALTWLEGCNVPDLVCANERYYLVRDGSNVCWNSNDFRATLTAMRRYWNSSAR

SEQ ID NO: 1554 - protein, 298 aa, Leisingera sp.
MAISERQLETWSHQGSVQQSAATYEAIRRVLKDPRSPYANRDFKVFLQGSYGNDTNVWSESDVDIAICLSSVFYTDTSGLSADEQQRYDQNRSPAEYSLKQFKEEVTQWLRQHFGDGVTPGNKAIAVPGGNSRRDADVLACSEHRRYYSYPAYGQPGFHEGICFWTSRGSKIVNYPHQHMSNCTSMHQATSSRFKPNVRVLKNMRNAMIVDGFLEDGVAPSYFVEGMLYNVPNDQFVWAHQQTVENALAWLERCNVPDLLCANERYYLVREGSDVCWNNEDFHRTLTSMRRYWNSSRR

SEQ ID NO: 1555 - protein, 299 aa, Roseovarius tolerans
MAISENQLETWSHVGSQQQSAATYQTIRSVLEHPDAPYAGRGIDVFLQGSYGNDTNVRGSESDVDVVICLTDVFNSDISGLDPAEKEAYEANRSPAKYGLTEFKSEVVAWLKANFGGGVTPGRKAIAVPGEGNRRTADVLACIEHHRYTSYRSPSDNRHHIGISFITADGDRIVNFPRQHKQNCTSKHQATSNRFKPNVRVLKNMRNAMVDEGFLKKGVAPSYFLEGMLWSVPNQNFVAGYQQSFEDYLYWLERCNANELSCANDLYWLIRESSHVCWNMQNYQTFLAAVRRYWNSGHR

SEQ ID NO: 1556 - protein, 290 aa, Alphaproteobacteria bacterium
MTISEDQLTTWSHQGSISQSAATYEIIRNALNDPSAPYNNRAYNIFLQGSYGNNTNIYADSDVDIALCLTSTFYSNTNQLTPLEKEKYDERRMPGTYSYDEFKAHVLAWLKHKFGNSVRAGKKAIFIPGNGSRRDVDVLVCAEHRKYETKVANYHTGICFWTSDGHQIVNYPTQHKENCIAKHQATNNRFKPNVRILKNMRNSMKDKGLISDDLAPSYYLEGMIWNAPDQLFTYSYQQTFENYMNWLDDCVTTNLTCANDIHWLLRTDQPVCWRRDKFDEFRFAAIRFWS

SEQ ID NO: 1557 - protein, 294 aa, Sulfitobacter litoralis
MAVSEAQLATWAHQGSVTQSASTYQAVKAALEDTNAPFNNRSFDVFLQGSYGNDTNIYADSDVDIAIRLSSTVYSDTSELETSELQKYNGEFSRAEYQLSDFKTDVLAWLKYKFGNSVENGKKAIRIPANGARRDADVLVCAKHLQYGKTRQYFNDGIIFWTTDGVEIINYPKQHLQNCTTKHQATHNRFKSNVRVIKNMRNRMIDLGRLKGDVAPSYFLEGMLWNAPDHLFTNSYQSTFENYINWLDDANYMDLTCANGIHWLLRDGHPVCWRKEKFDAFRVAAVQYWNQPNQ

SEQ ID NO: 1558 - protein, 291 aa, Mesorhizobium sp.
MAISEQQLNTWSTQGSVTQSAETYQAVRNVLNDTRSPYHQKSFNIFLQGSYGNATNIYSDSDVDVVICLTSTYYHDKGDLSPNDRVELERVFVPATYELSDFKRDVASWLTQQFGNGVTGGSKAIYIPGNNYRRDADVLVAAEHRTYYSRTGYREGIVFETSSGRRIINYPHQHSDNCTSKHQATSNRFKPMVRVLKNMRNKMISDHYLAEGVAPSYYLEGLLSNAPNICFAQRFQDTYEHSMTYLRAAIRDQMMCANGIHYLVRDNSDVNWSNASFTAYMNAVDSFWKAN

SEQ ID NO: 1559 - protein, 297 aa, Mesorhizobium sp.
MIFGGTMAISEQQLNTWSTQGSVTQSAETYQAVRNVLNDTRSPYHQKSFNIFLQGSYGNATNIYSDSDVDVVICLTSTYYHDKGDLSPNDRVELERVFVPATYELSDFKRDVASWLTQQFGNGVTGGSKAIYIPGNNYRRDADVLVAAEHRTYYSRTGYREGIVFETSSGRRIINYPHQHSDNCTSKHQATSNRFKPMVRVLKNMRNKMISDHYLAEGVAPSYYLEGLLSNAPNICFAQRFQDTYEHSMTYLRAAIRDQMMCANGIHYLVRDNSDVNWSNASFTAYMNAVDSFWKAN

SEQ ID NO: 1560 - protein, 298 aa, Rhizobiales bacterium
MTVSENQLDTWAKQGSITQSQSTYATVRSVLLSTDAPYKDKSFEVFLQGSYGNDTNIFSDSDVDIVIRIDSVYYDDTDDLEPGELAAYKSAFSSASYSYNDFKKDVLVHLQRSFPGSVTAGKKAIFIKGNGTRRDTDVLVAAQFRKYTRFTSWSVNNYVEGICFWTPDGTRIVNYPKLHSENCTTKHQDTNKWFKPSVRILKNMRNSMISNNLLPEGLAPSYFLEGMLYNVPLSEFGSSYVNTISSSLNYIKNCNRGDLVCANEQYYLCHPTSPVTWRSESLQKYLNQTISFWNAWGS

SEQ ID NO: 1561 - protein, 296 aa, Mesorhizobium sp.
MTMAVSEAQLETWSHQGSETQSAATYETICNALNDASSPFYPKKFEIFLQGSYGNKTNIYADSDVDVVIRLDSVYYSDTSNLPAPDKGNFDQGFSKSAYQLSDFKREVFEWLSLRFGKDVKLGKKAIRIPGNGTRRDADVLACATHRTYFSYPTFGQPDTREGVIFWTTDGEEIINYPKQHLANCTTKHQSSNQLFKRNVRVFKNIRNKMIEDGLISKGLAPSYFLEGLLWNVPNQLFQLPYGTSVSNAIQFILNGDRSHFTCANGYHWLLRDGHSVCWAPASYEVFMYQLRKFWA

SEQ ID NO: 1562 - protein, 294 aa, Mesorhizobium sp.
MAVSEAQLETWSHQGSETQSAATYETICNALNDASSPFYPKKFEIFLQGSYGNKTNIYADSDVDVVIRLDSVYYSDTSNLPAPDKGNFDQGFSKSAYQLSDFKREVFEWLSLRFGKDVKLGKKAIRIPGNGTRRDADVLACATHRTYFSYPTFGQPDTREGVIFWTTDGEEIINYPKQHLANCTTKHQSSNQLFKRNVRVFKNIRNKMIEDGLISKGLAPSYFLEGLLWNVPNQLFQLPYGTSVSNAIQFILNGDRSHFTCANGYHWLLRDGHSVCWAPASYEVFMYQLRKFWA

SEQ ID NO: 1563 - protein, 294 aa, Mesorhizobium plurifarium
MAVSEAQLDTWSNQGSEQQSAATYQSIREVLDDPAAPYHSKSYEIFLQGSYGNKTNIWADSDVDIVICIDSVYYSDTSGLSAAEKQNFDRGFSRATYQLADFKREVFDWLRLKFGAGVRIGKKAIKIPGGNGRRDADVLVCAEHHNYISYPAQGVPQSRVGVVFWTTEGVEIVNYPKQHLENCTTKHQQTNQLFKRNVRVFKNMRNKMVDDGLIDKGLAPSYFLEGLLSNVPNQLFQMPYRTAVSNAIQFIINADRTEFTCANGYHWLLRDGHPVCWPPADYEVYMYQLRAFWA

SEQ ID NO: 1564 - protein, 297 aa, Cohaesibacter sp.
MAVNENQLETWSAQGSIQQSAATYKTISGVLNDTGSPYCLKSFDTFLQGSYGNDTNVWADSDVDVVIRLTSVFYSDTDALSQGDKANYDQNRSTAEYSLGTFKEEVTDWLTKNLGQGVKAGSKAIYVPGNNNRRDADVLACAEHRIYHNYPANGNPSYLEGIMFWSKDGEQIINYPKQHSSNCTTKHQNTNGYFKPTVRIFKNIRNRMINEGRLQDGIAPSYFLEGMLYNVPNNLFGTNFQQTVINCFNHIYGIQDKSQLTCANGIHWLLRQGHSVCWSPDNHNTFMEAFKQFWNDF

SEQ ID NO: 1565 - protein, 301 aa, Cohaesibacter sp.
MDTKMAVNENQLETWSAQGSIQQSAATYKTISGVLNDTGSPYCLKSFDTFLQGSYGNDTNVWADSDVDVVIRLTSVFYSDTDALSQGDKANYDQNRSTAEYSLGTFKEEVTDWLTKNLGQGVKAGSKAIYVPGNNNRRDADVLACAEHRIYHNYPANGNPSYLEGIMFWSKDGEQIINYPKQHSSNCTTKHQNTNGYFKPTVRIFKNIRNRMINEGRLQDGIAPSYFLEGMLYNVPNNLFGTNFQQTVINCFNHIYGIQDKSQLTCANGIHWLLRQGHSVCWSPDNHNTFMEAFKQFWNDF

SEQ ID NO: 1566 - protein, 297 aa, Sinorhizobium meliloti
MAINEAQLTTWSSLGSVQQSAATYQTIRGVLDHKDSAYYPKLYQIFLQGSYGNDTNVWRDSDVDVVMRLTSVYYPDTSSLAPTEKANYDHARLPTDYSWALFKQEVAGWLTKNFGAGVDASGKAIYVPGSGNRRDADVLACAEHRHFITYPAIGNPSYREGIIFWKADGTQIINYPKQHSENCTTKHQNTKSYFKPTVRIFKNIRNRMIEDGRLQEGIAPSYFLEGMLYNVPTNLFGGSYQQTVINCFNHIYGLQDKSQLTCANGIHYLLRHGHSVCWPPDDHNTFMEAFKQFWNDY

SEQ ID NO: 1567 - protein, 297 aa, Sphingobium sp.
MAVGEAQLETWSAQGSVQQSAATYKSISGVLNDSRSPYYPKNFDTFLQGSYGNDTNVWADSDVDIIIRLSSVYYSDTSELSVNDKANFDKGWTKAEYSLAKFKEEVTDWLAKNYGNSVDGSGKAIYIPGNASRRDADVLACAEHRHYISYPTYGQPIYREGIVFWIKDGKKIVNYPKQHSANCTTKHQQTNSYFKPTVRIFKNIRNRMIADGRLREGIAPSYFLEGMLWNVPYDLFGTSYQQTVINCFNHIYNMQDKSQLTCANGIHWLLRHGHSVCWSPDNHNTFMEAFKKFWNEF

SEQ ID NO: 1568 - protein, 297 aa, Rhizobium sp.
MAIGENQLNTWASIGSVQQSAATYQSIKGVLNDTSSPYRVRSFENFLQGSYGNDTNVWRDSDVDIVMRLSSVYYSDTSGLNPADKANYDRNFSRAEYSFALFKQEVASWLTRSFGRGVDASGKAIFVPGSGSRRDADVLACAEHREYITYPASGQPAYREGIVFWKADGGQIINYPKQHSANCTNKHQATGGYFKPTVRIFKNIRNRMVEDGWLKEGGAPSYFLEGMLYNVPTNLYGTSYQQTVINCFNHIDGMEDKSRLTCANGIHWLIRPGHSVCWSPDQHAVFMEAFKQYWNAF

SEQ ID NO: 1569 - protein, 296 aa, Rhizobium marinum
MAVSESQLDTWSAQGSIQQSAATYKTVRDVLNDTSSPYYQKSFDTFLQGSYGNDTNIWADSDVDVVIRLSSLYYTDTSDLTPDDKARYDSNFSASQYSLAKFKEEVTGWLSANFGAGVQAGGKAIYIPGTNSRRDTDVLVSADHRRYLSYPATGNPSYREGIVFWMKDGTKIVNYPKQHSTNCTAKHQNTNGYFKPTVRIFKNMRNRMIAHGRLKEGLAPSYFLEGLLSNVPNGLFGGTYQSTVVNCINHILSADTSNFYCANGFHYLLRSGHPVCWSPSDFQIFMAALKKFWEDS

SEQ ID NO: 1570 - protein, 294 aa, Agrobacterium sp.
MAVSEAQLETWSAQGSIQQSAATYQTISNVLNSQNSPYYQRNFDTFLQGSYGNHTNIWADSDVDIVIRLTSVWYSDISELTAAEKANYETNRSPAEYSLPKFKEEVTSWLTTNYGNGVDGSGKAIYVPGNGGRRDADVLACAEHRHYDSYPAYGSPSFREGIVFWLKDGTKIVNYPKQHSENCTRKHQDTNSYFKNTVRIFKNMRNRMINEGRIQDGIAPSYFLEGLLYNVPNNFFAGTYTQTVTNCINYVLVSDTSQFTCANKNHWLIRNAPVCWAPEKFEAYMKALRAFWWE

SEQ ID NO: 1571 - protein, 294 aa, Agrobacterium tumefaciens
MAVSEAQLETWSAQGSIQQSAATYQTISNVLNSQNSPYYQRNFDTFLQGSYGNHTNIWADSDVDIVIRLTSVWYSDISELTAAEKANYETNRSPAEYSLPKFKEEVTSWLTTNYGNGVDGSGKAIYVPGNGGRRDADVLACAEHRHYDSYPAYGSPRFREGIVFWLKDGTKIVNYPKQHSENCTRKHQDTNSYFKNTVRIFKNMRNRMINEGRIQDGMAPSYFLEGLLYNVPNNFFAGTYTQTVTNCINYVLVSDTSQFTCANKNHWLIRNAPVCWAPEKFEAYMKALRAFWWE

SEQ ID NO: 1572 - protein, 297 aa, Proteobacteria bacterium
MAINEAQLNTWSAIGATQQSAATYQTIRTVLNDTKSPYYAKWFSNFLQGSYGNDTNVWRDSDVDIVMRLSSVYYSDTSNLNAVEKANYDRMWSAADYSFAQFKREVAAWLADNYGVGVDASGKAIFVPGSGNRRDADVLACAEHRLYYSYPSAGDPTYMEGVVFWKADGTQIVNYPKQHSENCTTKHQNTNNWFKPTVRIFKNIRNRMIENGYLQEGVAPSYFLEGMLWNVPNTLFGTSYEDTVVACFNHIYGLQDKTQLKCANNYHWLLRQEFPTSWSPTDHNTFMEAFKQFWNDS

SEQ ID NO: 1573 - protein, 297 aa, Rhizobium flavum
MAINEAQLTTWSSIGATQQSAATYQTIRTVLNDTKSPYYAKWFSTFLQGSYGNDTNVWRDSDVDIVMRLSSVYYSDTSNLNPDDKANFERGWSAADYSFAQFKREVAAWLTASYGGGVDASGKAIFVPGTGNRRDADVLACAEHRLYFTYPSVGDPTYMEGVVFWKADGTQIVNYPKQHSENCTAKHQNTNSWFKPTVRIFKNIRNRMIDDGLLQDGVAPSYFLEGMLWNVPNSLFGKSYFETVVACFNHIYFMEDKSQLKCANDYHWLLRHEFPTSWSPTDHNTFMEAFKQFWNNY

SEQ ID NO: 1574 - protein, 297 aa, Rhizobium multihospitium
MAISEAQLTTWSSIGATQQSAATYQTIRTVLNDTESPYYAKWFSNFLQGSYGNDTNVWRDSDVDIVMRLSSVYYSDTSNLNPVEKANFDRGWSAADYSFNQFKREVAAWLTANYGSGVDASGKAIFVPGSGNRRDADVLACAEHRLYFTYPSVGDPTYREGVVFWKADGTQIVNYPKQHSENCTIKHQATNSWFKPTVRIFKNIRNRMIDDGLLEEGVAPSYFLEGMLWNVPNNLFGKSYFNTLVACFNHMYFMEDKSQLKCANDYHWLLRHEFPTSWSPTDHNTFMEAFKQFWNDF

SEQ ID NO: 1575 - protein, 254 aa, Sinorhizobium fredii
MAINEAQLTTWSSIGATQQSAATYQTIRTVLNDTKSPYYAKWFSNFLQGSYGNDTNVWRDSDVDIVMRLSSVYYSDTSNLNPDDKANFDRGWSAADYSFAQFKREVAAWLTANYGGDVDASGKAIFVPGSGNRRDADVLACAEHRLYFTYPSVGDPTYMEGVVFWKADGTQIVNYPKQHSENCTIKHQNTNSWFKPTVRIFKNIRNRMIDDGLLQEGVAPSYFLALSARSWDFGQVEERCGNIVSLIDECFAGE

SEQ ID NO: 1576 - protein, 224 aa, Sinorhizobium fredii
MAINEAQLTTWSSIGATQQSAATYQTIRTVLNDTKSPYYAKWFSNFLQGSYGNDTNVWRDSDVDIVMRLSSVYYSDTSNLNPDDKANFDRGWSAADYSFAQFKREVAAWLTANYGGDVDASGKAIFVPGSGNRRDADVLACAEHRLYFTYPSVGDPTYMEGVVFWKADGTQIVNYPKQHSENCTIKHQNTNSWFKPTVRIFKNIRNRMIDDGLLQEGVAPSYFL

SEQ ID NO: 1577 - protein, 272 aa, Acetobacter malorum
MTISEMQLNIWSRQGSITQSAATYQALRNVLDRDDAPYAHRSYLTFLQGSYGNDTNIYADSDVDIVMRLDSIFYSDLSELSASDKASYETNSSPAQYSWTEFREEVIAQLTKAYGSGVQPGTKAIYIAGSGGRRDGDVLPAAEFRRYFRYASPSDQHYAEGICFWLPNGTQIVNYPKQHSANCTAKHQRTGSWFKPTVRILKNMRNTMVDQGRLADGIAPSYFIEGMLYNVPDANFGSSYCDTLVNVLNWLNGCDRGKLECANEMYFLLHPT

SEQ ID NO: 1578 - protein, 267 aa, Acetobacter malorum
MQLNIWSRQGSITQSAATYQALRNVLDRDDAPYAHRSYLTFLQGSYGNDTNIYADSDVDIVMRLDSIFYSDLSELSASDKASYETNSSPAQYSWTEFREEVIAQLTKAYGSGVQPGTKAIYIAGSGGRRDGDVLPAAEFRRYFRYASPSDQHYAEGICFWLPNGTQIVNYPKQHSANCTAKHQRTGSWFKPTVRILKNMRNTMVDQGRLADGIAPSYFIEGMLYNVPDANFGSSYCDTLVNVLNWLNGCDRGKLECANEMYFLLHPT

SEQ ID NO: 1579 - protein, 297 aa, Gluconobacter albidus
MTISEMQLDIWSRQGSITQSAATYQALRNVLDRDDAPYAQRSYLTFLQGSYGNDTNIYADSDVDIVMRLDSIFYTDLSELSASDKANYETNRSPAQYSWTEFRKEVITQLVKAYGSAVQPRSKAIYVEGNGGRRDADVLPAAEFRRYFHYVSPSDQHYAEGICFWLPNGTQVVNYPKLHSANCTGKHQRTGSWFKPTVRILKNMRNAMVNQGRLAEGIAPSYFIEGMLYNVPDANFGSSYRATLVKVLNWLNGCNRADLECANEQYFLLHPTSPVTWRREQFETFLTALINFWNDGG

SEQ ID NO: 1580 - protein, 145 aa, Komagataeibacter europaeus
MSISEKQLDIWSRQGSIIQSAATYQALRNVLERDDALYAHRSYSTFLQGSYGNDTNVYADSDVDIVMQLDSVFYTDLSELSASDKTNYETNRSPAQYSWTEFRKEVIAQLTKAYGSAVQPGSKAIYVAGNGGRDRALLFRRRHAL

SEQ ID NO: 1581 - protein, 301 aa, Kaistia sp.
MAISEDQLTTWAKPGANVGSAETYGIIKNALVGTDTGEQKFSVFLQGSYGNSTNVIRDSDVDVVVQMDTIHYRDTSRLPPPQLAAYKLVYKDAAYTYTDFKKAVTTQLTKKFESYIVPGKKATLIKGDNSGRRNADVLIAAKFRRYHAFHSLGNETYDEGLCFFLADGTRIANFPVLHADNCIAKNKDTGGYFKDTVRIFKNIRNHLIDKKKLAEGIAPSYYIEGLLCSAPNPHFGTNYATTFYNVFQWLWNVDRTTLMCAHGLDPLLGEGSPTAWPAQNCTDYLSAVAECWNNWGKARWI

SEQ ID NO: 1582 - protein, 301 aa, Rhodospirillaceae bacterium
MAISEDQLTAWAKPGANVGSAETYGIIKNALVGTDTGEQKFSVFLQGSYGNSTNVIRDSDVDVVVQLDTIHYRDTSRLPPPQLAAYKLVYKDAAYTYTDFKKAVTTQLTKKFESYIVPGKKATLIKGDNSGRRNADVLIAAKFRRYHAFHSLGNETYDEGLCFFLADGTRIANFPVLHADNCIAKNKDTGAYFKDTVRIFKNIRNHLIDKKKLAEGIAPSYYIEGLLCSAPNLHFGTNYATTFYNVFQWLWNVDRTTLMCAHGLDPLLGEGSPTAWPARNCTDYLSAVAECWNNWGKARWI

SEQ ID NO: 1583 - protein, 209 aa, Staphylococcus aureus
MTIPTKKLDYWSQKGATQAPKNLREKIEKVLTANESKIKRKNQLDIYLQGSYRNNTNIFGSSDVDIVVQSNATFFSNISKLEAYERKIYNQTFDEATYTWRYFKNDVIKTLQYAFGSSNVEIGNKSIKIFTEDYEADVIPCFEYRNYLSFGNSEEDREYIPGIKFFTTDKGESIINYPKKHYVFGVDKNERTNNYYKPTIRIFKNIKNN

SEQ ID NO: 1584 - protein, 211 aa, Staphylococcus haemolyticus
MTIPTKKLDYWSQKGATQAPKNLREKIEKVLTANESKIKRKNQLDIYLQGSYRNNTNIFGSSDVDIVVQSNATFFSNISKLEAYERKIYNQTFDEATYTWRYFKNDVIKTLQYAFGSSNVEIGNKSIKIFTEDYEADVIPCFEYRNYLSFGNSEEDREYIPGIKFFTTDKGESIINYPKKHYVFGVDKNERTNNYYKPTIRIFKNIKKTIN

SEQ ID NO: 1585 - protein, 219 aa, Staphylococcus haemolyticus
MTIPTKKLDYWSQKGATQAPKNLREKIEKVLTANESKIKRKNQLDIYLQGSYRNNTNIFGSSDVDIVVQSNATFFSNISKLEAYERKIYNQTFDEATYTWRYFKNDVIKTLQYAFGSSNVEIGNKSIKIFTEDYEADVIPCFEYRNYLSFGNSEEDREYIPGIKFFTTDKGESIINYPKKHYVFGVDKNERTNNYYKPTIRIFKNIKKQLIKKKELQKK

SEQ ID NO: 1586 - protein, 293 aa, Staphylococcus haemolyticus
MDYWSQKGATQAPKNLREKIEKVLTANESKIKRKNQLDIYLQGSYRNNTNIFGSSDVDIVVQSNATFFSNISKLEAYERKIYNQTFDEATYTWRYFKNDVIKTLQYAFGSSNVEIGNKSIKIFTEDYEADVIPCFEYRNYLSFGNSEEDREYIPGIKFFTTDKGESIINYPKKHYVFGVDKNERTNNYYKPTIRIFKNIKKQLIKKKRITKKVVSSYFIESLLYNVPDRYFCIDNASNRVADILNWLTKNQDSFSTFICQNEQMNLFASSQEQWNEEDADKFIFEINKFWNEW

SEQ ID NO: 1587 - protein, 300 aa, Staphylococcus haemolyticus
MTIPTKKLDYWSQKGATQAPKNLREKIEKVLTANESKIKRKNQLDIYLQGSYRNNTNIFGSSDVDIVVQSNATFFSNISKLEAYERKIYNQTFDEATYTWRYFKNDVIKTLQYAFGSSNVEIGNKSIKIFTEDYEADVIPCFEHRNYLSFGNSEEDREYIPGIKFFTTDKGESIINYPKKHYVFGVDKNERTNNYYKPTIRIFKNIKKQLIKQKRITKKVVSSYFIESLLYNVPDRYFCIDNASNRVADILNWLTKNQDSFSTFICQNEQMNLFGSSQEQWNEEDADKFIFEINKFWNEW

SEQ ID NO: 1588 - protein, 299 aa, Staphylococcus haemolyticus
MTIPTKKLDYWSQKGATQAPKNLREKIEKVLTANESKIKRKNQLDIYLQGPYRNNTNIFGSSDVDIVVQSNATFFSNISKLEAYERKIYNQTFDEATYTWRYFKNDVIKTLQYAFGSSNVEIGNKSIKIFTEDYEADVIPCFEYRNYLSFGNSEEDREYIPGIKFFTTDKGESIINYPKKHYVFGVDKNERTNNYYKPTIRIFKNIKKQLIKKRITKKVVSSYFIESLLYNVPDRYFCIDNASNRVADILNWLTKNQDSFSTFICQNEQMNLFASSQEQWNEEDADKFIFEINKFWNEW

SEQ ID NO: 1589 - protein, 151 aa, Staphylococcus haemolyticus
MTIPTKKLDYWSQKGATQAPKNLREKIEKVLTANESKIKRKNQLDIYLQGSYRNNTNIFGSSDVDIVVQSNATFFSNISKLEAYERKIYNQTFDEATYTWRYFKNDVIKTLQYAFGSSNVEIGNKSIKIFTEDYEADVIPCLVLLQSKKYS

SEQ ID NO: 1590 - protein, 300 aa, Staphylococcus haemolyticus
MTIPTKKLDYWSQKGATQAPKNLREKIEKVLTANESKIKRKNQLDIYLQGSYRNNTNIFGSSDVDIVVQSNATFFSNISKLEAYERKIYNQTFDEATYTWRYFKNDVIKTLQYAFGSSNVEIGNKSIKIFTEDYEADVIPCFEYRNYLSFGNSEEDREYIPGIKFFTTDKGESIINYPKKHYVFGVDKNERTNNYYKPTIRIFKNIKKQLIKKKRITKKVVSSYFIESLLYNVPDRYFCIDNASNRVADILNWLTKNQDSFSTFICQNEQMNLFASSQEQWNEEDADKFIFEINKFWNEW

SEQ ID NO: 1591 - protein, 300 aa, Staphylococcus haemolyticus
MTIPTKKLDYWSQKGATQAPKNLREKIEKVLTANESKIKRKNQLDIYLQGSYRNNTNIFGSSDVDIVVQSNATFFSNISKLEAYERKIYNQTFDEATYTWRYFKNDVIKTLQYAFGSSNVEIGNKSIKIFTEDYEADVIPCFEYRNYLSFGNSEEDREYIPGIKFFTTDKGESIINYPKKHYVFGVDKNERTNNYYKPTIRIFKNIKKQLIKQKRITKKVVSSYFIESLLYNVPDRYFCIDNASNRVADILNWLTKNQDSFSTFICQNEQMNLFASSQEQWNEEDADKFIFEINKFWNEW

SEQ ID NO: 1592 - protein, 300 aa, Staphylococcus haemolyticus
MTIPTKKLDYWSQKGATQAPKNLREKIEKVLTANESKIKRKNQLDIYLQGSYRNNTNIFGSSDVDIVVQSNATFFSNISKLEAYERKIYNQTFDEATYTWRYFKNDVIKTLQYAFGSSNVEIGNKSIKIFTEDYEADVIPCFEYRNYLSFGNSEEDREYIPGIKFFTTDKGESIINYPKKHYVFGVDKNERTNNYYKPTIRIFKNIKKQLIKQKRITKKVVSSYFIESLLYNVPDRYFCIDNASNRVADILNWLTKNQDSFSTFICQNEQMNLFGSSQEQWNEEDADKFIFEINKFWNEW

SEQ ID NO: 1593 - protein, 290 aa, Staphylococcus haemolyticus
MVSKGATQAPKNLREKIEKVLTANESKIKRKNQLDIYLQGSYRNNTNIFGSSDVDIVVQSNATFFSNISKLEAYERKIYNQTFDEATYTWRYFKNDVIKTLQYAFGSSNVEIGNKSIKIFTEDYEADVIPCFEYRNYLSFGNSEEDREYIPGIKFFTTDKGESIINYPKKHYVFGVDKNERTNNYYKPTIRIFKNIKKQLIKKKRITKKVVSSYFIESLLYNVPDRYFCIDNASNRVADILNWLTKNQDSFSTFICQNEQMNLFASSQEQWNEEDADKFIFEINKFWNEW

SEQ ID NO: 1594 - protein, 219 aa, Staphylococcus haemolyticus
MTIPTKKLDYWSQKGATQAPKNLREKIEKVLTANESKIKRKNQLDIYLQGSYRNNTNIFGSSDVDIVVQSNATFFSNISKLEAYERKIYNQTFDEATYTWRYFKNDVIKTLQYAFGSSNVEIGNKSIKIFTADYEADVIPCFEYRNYLSFGNSEEDREYIPGIKFFTTDKGESIINYPKKHYVFGVDKNERTNNYYKPTIRIFKNIKKQLIKKKELQKK

SEQ ID NO: 1595 - protein, 209 aa, Staphylococcus aureus; identical to SEQ ID NO: 1583

SEQ ID NO: 1596 - protein, 300 aa, Staphylococcus sp.
MTIHKEILDSWSKQGATKAPKILRERIEKVLTNDRSKIKKKNQLDIYLQGSYRNNTNILGSSDVDIVVQSNATFFSNISKLDTYEREIYNKTFDDATYTWRYFKNDVIETLKNAFGSSNVKVGNKSIKIITENYEADVIPCFEHRKYEYFGNNEKERTYIPGIQFYTTNENNIVINYPKKHYSFGVDKNNRTNNKYKPTVRIFKNIKKRLLEQKKITSKVTSSYFIENLLYNVPDRYFNIENSSIRVANILNWLISNVDSFPMFVCQNNQINLFGSTQEQWNEEDARNFIFEVNKFWDEC

SEQ ID NO: 1597 - protein, 300 aa, Staphylococcus warneri
MTIHKEILDSWSKQGATKAPKILRERIEKVLTNDRSKIKKKNQLDIYLQGSYRNNTNILGSSDVDIVVQSNATFFSNISKLDTYEREIYNKTFDDATYTWRYFKNDVIETLKNAFGSSNVKVGNKSIKIITENYEADVIPCFEHRKYEYFGNNEKERTYISGIQFYTTNENNIVINYPKKHYSFGVDKNNRTNNKYKPTVRIFKNIKKRLLEQKKITSKVTSSYFIENLLYNVPDRYFNIENSSIRVANILNWLISNVDSFPMFVCQNNQINLFGSTQEQWNEEDARNFIFEVNKFWDEC

SEQ ID NO: 1598 - protein, 300 aa, Bacillus sp.
MPIPTSTLETWSNQGAIQTPKSLRENIEKKLTGFKSKITKKNQLEIYLQGSYRNNTNIYGNSDVDIVVQHDATFFSDISNLDTHEVAIYKSVFNDATYTWQDFKTEVIETLEDAFGSNNVEVGNKSIKIDNGSYEADVIPCFEYRKYTSFGQNEEDRDYIPGIKFYTTNQNREVVNYPKEHYSKGAYKNQRVNKRYKPTIRIFKNLKKKLVEKDLLDKEQVPSYFIENLLYNVPDECFDNSNLSTRVYSVIKWLQDNNESFSQFSCQNEQINLFGPSQEQWNEEDAHSFLTQTIKLWNEW

SEQ ID NO: 1599 - protein, 300 aa, Tenuibacillus multivorans
MAIPASTLETWSNQGATQTPKSLREKIERKLTGSQSKVQRKNQLEIYLQGSYRNSTNIYGNSDVDVVVQSDATFFSDVSDLDTLEKAIYERAFSEATYTWEDYKSEVIETLEDSFGVHNVEVGNKSIKIDDGTYEADVVPCFEYRKYTSFGESAEEREYIPGIKFYTTTEKRSVVNYPKEHFSKGATKNQRVSMRYKPTIRIFKNFKKKLIEKDMINKEQVPSYFVENLLYNVSDHCYDEPSIATRVYNVLKWLQDNRESMSQFICQNEQIYLFGNSQEQWNEDDARTFINQAITLWNEW

SEQ ID NO: 1600 - protein, 302 aa, Bacillus flexus
MTIQNSQLETWSNQGATATPKALREKIEGVLKGENSLITNKNEVSIYLQGSYRNSTNIYGNSDVDIVIQTNHVFYGDASGLSEYKKGIYESQRNPSQYNWKTYKKEVLDTLVNYFGADNVVIGNKSIKIDTGSYEADVVPCIQYKKYTNFGYSESEKQYIEGMKFFTTEDHREVINFPKLHYAFGAEKNKQTDGMYKKTIRIFKNIKSRLVSLEKINKKTAPSYFVENLLYNIPNNKFVKNDFSTTTFNILKWLHDNKSDMASFVCQNEVLYLFGDTPEQWNDSDAKKFISEVIVLWNEWGK

SEQ ID NO: 1601 - protein, 286 aa, Paenibacillus assamensis
KGAIVTSKLTHEKIRDVISESTVLKGKSFEIYLQGSYKNSTNIRGDSDVDIVVQLNSTFYRDLSNLSENEKQTYTSQHSSATYEWKDFKSDLITVLENYFGKSYVKVGNKSIKILPSNGRLPADVVPCAQYRRYKRYTGVSNKSDYVEGICFWTSTENRFVVNYPKVHYDNGVSKNQITDQMYKHMIRIFKNARTYMDNRDLFDKSLAPGYFIEGLLYNVTNNNFKNTYNQSMFEILNWLHKADFDAFVCQNEQTMLFGPSPEQWNPENAQKFLTSMIKLWNDWGK

SEQ ID NO: 1602 - protein, 307 aa, Paenibacillus assamensis
MLYCSYSTSPYFFCPTKCSRSKGAIVTSKLTHEKIRDVISESTVLKGKSFEIYLQGSYKNSTNIRGDSDVDIVVQLNSTFYRDLSNLSENEKQTYTSQHSSATYEWKDFKSDLITVLENYFGKSYVKVGNKSIKILPSNGRLPADVVPCAQYRRYKRYTGVSNKSDYVEGICFWTSTENRFVVNYPKVHYDNGVSKNQITDQMYKHMIRIFKNARTYMDNRDLFDKSLAPGYFIEGLLYNVTNNNFKNTYNQSMFEILNWLHKADFDAFVCQNEQTMLFGPSPEQWNPENAQKFLTSMIKLWNDWGK

SEQ ID NO: 1603 - protein, 299 aa, Paenibacillus campinasensis
MSIPESQLETWAHQGAITSSKLTHERIRGVIDSSPVFKNKGVEIDTYLQGSYRNSTNIRGDSDVDIVVQLNSTYAYNIDQLDVNERVWFDMELSPATYSWEEFKKDLIDVLEDYYGRLSIKVGNKSIKILPGNGRLPADVVPSLQYRHYTQFTGESTDFVEGISFWTTKENRQVINFPKVHYSNGVTKHQNTREKYKAMIRIFKNARSYMHDKGLFDKSLAPGYFIEGLLYNVPNNKFQSSYSNSMYEILNWFHSADFTPFLCQNKQLYLFGSAPEQWQIKNAERFLSAIINLWNDWGK

SEQ ID NO: 1604 - protein, 282 aa, Candidatus Nomurabacteria bacterium
MPIPESQLETWARPGASTTAKTTADSIKNALNSYRSWPSGVEFDVYLQGSYKNDTHIRGDSDVDVVVQLNSTFHSNLSEEQKGTLGLSPASYHLSDFRVEVLKVLRNYYGQGFITEGTKTLKLRAGNGRLSADIVVCGQYRKYKTVNSYDYVEGMCFWSGSRQIINYPKIHYENGVTKHKNTSEWYKPTVRIFKNLRSNLLGDNPPSYFLECLVYNAPHLKFGNGYQNSFCNIVNWLNEADLDTFMCKNGQHKLFGDSPEQWNTIEARSFIANVISIWNDWQ

SEQ ID NO: 1605 - protein, 283 aa, Nitrospirae bacterium
MAIPESQLEAWSHQGAVTTSKATADSIKNALNAYNNWPEGIDFEVYLQGSYKNDTNIRGDSDVDVVAQLNSTFYSNLSEDQKRTLGLSPASYSWSNFRSDVLKVLKDYYGQSQITEGNKSIKIKANNGRLPADIVVCSQYRRYKTVSSNDFVEGMCFWTRNDDRQVINYPKVHYDNGVSKHQNSSKWYKPVVRLFKNSRGNISGDATPSYFLECMLYNVPNSKFGTSYQDTFCNVVNWLNEINLDNFICQNGQLILFGSTQEQWNTNQAKAFIKNLISLWNNW

SEQ ID NO: 1606 - protein, 283 aa, Candidatus Roizmanbacteria bacterium
MAIPETQLETWANQGAITTAKSTADSVKNALNSYTEWPEGIDFEVYLQGSYKNDTNIRGDSDVDVVIQLNSTFYSNLSEDQKGVLGLTPASYGLPNFRANVLNILKSYYGQDQIVEGNKSIKVKATNGRLPADVVVCSQYRQYKTVNSYDYIEGICFWTQNDNRQVINYPKTHYDNGVSKHQNSNKWHKPVVRLFKNFRGSISGDATPSYFLECMLYNTPNSKFGTSYGDTFCNIVNWLNENSLDNFVCQNGQLNLFGTSQEQWSTGEAKIFIKNLISLWNNW

SEQ ID NO: 1607 - protein, 288 aa, Deltaproteobacteria bacterium
MGIPESRLKTWSHQGAITTAKATHESIRNALDSYEWPDGINFEVYLQGSYKNDTNIRGDMDVDLVVQLNLSFYSNLSEEQKRYLELFPASYGWDDFRPNVLRALKDYYGSPMITEGNKSIKVKATGGRLPADVVVCAQYRKYRSLNGYDYVEGMTFWTRNESRQVINYPKIHYDNGIKKHQNTNNRYKSVVRMFKNIRNYIKENYYISNDLAPSYFLECLLYNVPNNKYSGSYQDVFCYIVNWLNNAKLEDFVCQNGQLKLFGNTPEQWSVYNAKTLIQKLVELWNNW

SEQ ID NO: 1608 - protein, 277 aa, Deltaproteobacteria bacterium
MGIPESRLKTWSHQGAITTAKATHESIRNALDSYEWPDGINFEVYLQGSYKNDTNIRGDMDVDLVVQLNLSFYSNLSEEQKRYLELFPASYGWDDFRPNVLRALKDYYGSPMITEGNKSIKVKATGGRLPADVVVCAQYRKYRSLNGYDYVEGMTFWTRNESRQVINYPKIHYDNGIKKHQNTNNRYKSVVRMFKNIRNYIKENYYISNDLAPSYFLECLLYNVPNNKYSGSYQDVFCYIVNWLNNAKLEDFVCQNGQLKLFGNTPEQWSVYNAKTL

SEQ ID NO: 1609 - protein, 292 aa, Thermoanaerobaculum aquaticum
MPIPESQLERWSHQGAVTTARQTHESIREALSAYQLWPPGIDYEVYLQGSYKNATNIRGDSDVDVVVQLKSTFLSNLSENQQRLFRITPATYDWQTFKSDVLHALRNYFKREKVSEGRKSIKVQTSYLPADVVVCLQYRKYPQYPKNADDYLEGITFCVLGEGRWVINYPKLHYDNGVQKNAPSRTNGWYKPTVRLFKNARTYLVERKVIPSDLAPSYFLECFLYNVPDSKYGSSFRDTFCNVVKWLVTADFGRFVSQNEQLPLFGDSPEQWSEEKACRFVKAMVDLWNNWR

SEQ ID NO: 1610 - protein, 311 aa, Chthonomonas calidirosea
MAIPESQLESWSSKGADTTAKQTHESIRKALQQYERLKSKDFEVYLQGSYKNDTNIRGNSDVDIVVQLNSTFRDNLSEEQKGGFSSTDATYGWNEFRSDVLMALRDYYAEPLCYRLLGLLLEGRFRDWDKVREGRKCLKVQTQYLPADAVVCIQYRKYPPSPRDPDKYTEGMTFYVQSENRWVINYPKLHYENGVRKNKNTNGLYKPTIRLFKNARTHLIKRGNIAADIAPSYFLECLLYNVPDDKFDESLQKTFCNVVNWLHHWLSQANLSQFVCQNEQLPLFGNSPEQWSADKARQFVRQMIDLWKNWS

SEQ ID NO: 1611 - protein, 309 aa, Chthonomonas calidirosea
MPIPESQLEIWSRKGADTTAKRTHESIRKALQQCERLKSKDFEVYLQGSYKNDTNIRGNSDVDIVVQLNSTFRDNLSEEQKGGFSSTDATYGWNEFRSDVLMALRDYYAEPLCYRLLGLLLDGRFRDWDKVRERRKCLKVQTQYLPADAVVCIQYRKYPPSPRDTDKYTEGMTFYVQSENRWVINYPKLHYENGVRKNKNTNGLYKPTIRLFKNARTYLRGNIAADIAPSYFLECLLYNVPDDKFGESLQKTFCNVVNWLYHWLSQANLSQFVCQNEQLPLFGNSPEQWSEDKARQFVREMIDLWKNWS

SEQ ID NO: 1612 - protein, 298 aa, Nitrolancea hollandica
MPIPEDKLKTWSHQGAVATAKSTRESIYNALRSCSALEDVNWDVYLQGSYGNDTNIYGETDVDIIVQLNSTFRRELGLLTAAEAASYKAAFSPATYHWDDFRTDVLATLREYYGALAITEGKHCINVAGKQGRLPADVVVALQYRSYRRFKSLADQDYVEGILFYTHPEEREVINYPKQHYDSGVNKMSKSRTNGWFKPTVRVFKNLRSFMVDQGAISDGLAPSYFLQGLIYNVPDNLFGASYQQTMVNILNFLRKATFNDFVCQNEQLPLFGASHEQWTTSDAKSFVGSAIAVWNDW

SEQ ID NO: 1613 - protein, 296 aa, Moorella thermoacetica
MPIPEKQLETWAHQGAISTAKSTHESVRNALFESKSLRQMDLDVYLQGSYKNSTNIRGDSDVDIIVQLNSVFIPDTSGLSSSEREQFVMTYGDAAYSWDNFRTDVLKALREYYGSKAITESNKSIKVAGVSGRLPSDVVVCLQYRKYRRFRGIGDEDYIEGIIFYTLVERRKVINYPKKHYVNGVNKQKRTDNFYKRTVRMFKNARTYLVDNGTVDAKLAPSYFLECLLYNVPDRFFTTSYQETFYQVLKWLCQTNLSGFTCQNEQLPLFGSSPEQWSETRAQKLIESLVKLWNQW

SEQ ID NO: 1614 - protein, 296 aa, Moorella thermoacetica
MPIPEKQLETWAHQGAISTAKSTHESVRNALFESKSLRQMDLDVYLQGSYKNSTNIRGDSDVDIIVQLNSVFIPDTSGLSSSEREQFVMTYGDAAYSWDNFRMDVLKALREYYGSKAITESNKSIKVAGVSGRLPSDVVVCLQYRKYRRFRGIGDEDYIEGIIFYTLVERRKVINYPKKHYVNGVNKQKRTDNFYKRTVRMFKNARTYLVDNGTVDAKLAPSYFLECLLYNVPDRFFTTSYQETFYQVLKWLCQTNLSGFTCQNEQLPLFGSSPEQWSETRAQKLIESLIKLWNQW

SEQ ID NO: 1615 - protein, 301 aa, Unknown
  Description of Unknown: candidate division CPR1 bacterium sequence
MAINESQLQTWSNAPASAKIQFTHEQVRKALEQSDALRGRSYEVYLQGSYANSTNTRVDSDVDVVVQLSSTFNHDISKLSLDQQQLFHQTFPNATYHWADFRRDVISALNSYFGSASVKPGNKSIKLVGDDSRVNADVVPCLQHRQYQSFATWNHDDFVEGMKFWTAAETPSREITNFPKIHIENGEDKNADHRTDTMYKGLVRVVKNIRRQLVERHNFDPKIAPSYFVECMIYNVPDNHFQNDFKSSLEYTHNFILRQCNPATLLTASHQHLLFGSEPWQWNQQDAATFFQAAENFYNSN

SEQ ID NO: 1616 - protein, 304 aa, Candidatus Nomurabacteria bacterium
MSIPANQLDTWAKQGSKDLSSTTYQSVRNALSGSSSPIREMITSGKVKIDLQGSYANDTNTRGDSDVDVLVRLDVFQSNKLLLPREQYLLHEQTYFTADYILAHLRRDVLIALKAYYGNAFIDETGNKSIKLLKNSGRLKADIVPVIAHRTYSYFLGLHNHSKVEGILLNHKATGETIINYPDQHYNNGVAKHQATSNLFKRVVRIIKNARSYAVEKGLLSEETAPSYFLQSLVYNVPNEMFTGDNNTAVFNILKYLNEHDISSFVTQSNQHQLFGTSKHQWNITDANTTINALVNLWDNWNTI

SEQ ID NO: 1617 - protein, 291 aa, Mucilaginibacter paludis
MSISENQLDTWSHQGSITNSANTANAIKDAINSYASFPTGVSFDVYLSGSYKNDTNIFGESDVDVVVELTSSFYSNLTDEQKSTFSLTGSSYRYDDFKKDVINCLEANFSKKHIEVGNKAIKVYPAHNGRLHADVLVCYSYRLYTDFTRITGYHQGVSFFRADNNAEVINFPKKHSEIDTIKHQNTNGYFKPTVRIFKNIKKTLVNDSVIEKKLAPSYFIECLLSNVPNDCYGTNYSQTVFKVLTYLQTNNWDNFRCVNGLTPLWGDTTETWELDSAKKFVSAVIAKWNKS

SEQ ID NO: 1618 - protein, 333 aa, Psychroflexus sp.
MLIRKIIAYFQRYFSYTKRYLQAKKNRHRERIMAITENQLSTWSNQGATKTSQLTYNSIKTCINNISWNDDIKYNIYLQGSYKNYTNIRANSDIDVVVEFTSVFYSNRDELSSEELDDFNEVYDDGKYSLNDFRGALIESLNEYYDEKNIEIGDKAIRIDGFNGRLDADIVCCATYRNYQSFKKNKTTDYIEGITFFGSESNDQIINFPNKHYKNGATKNSNCNTNFKSTVRIIKNIKTKLIEGNQITKEKCPSYYIECLLYNVPDKAFKENNYSSIIFSVLKFWEDSIKNDNLENFVCQNEIIDLFGPSEQQWSIKNAKKFINKSITFWNNY

SEQ ID NO: 1619 - protein, 296 aa, Kaistia sp.
MAIPESQLETWSHQGAVTSASAIYQRIRDALQADTTLSVRNFDVFLQGSYRNSTNIRGDSDVDVVVKLEDTFQPDYDQLDELTKAKVKAGHRDATYTLADFRRDVSSAIQRAFPNHNITEGGKSIKIPRTANNIPADVVPCLEYRLYRPPQTFLSDATYIDGIWLWDVQRNHSVISFPKQSYDNGVAKHERTNQWYKPTVRIFKNARGWMEDNGLIRIGTASSHAIECLLYNVPDQQFGSSYGSTFVNVVNWLSSADLTNFVCQNGIQRLFGDGRWTEANARAFIAGLIQMWNQWR

SEQ ID NO: 1620 - protein, 294 aa, Luteimonas huabeiensis
MAIPESQLETWSHQGAVTSASAIYQRIRDALQADTTLSVRNFDVFLQGSYRNSTNIRGDSDVDVVVRLNETYMPDYSLLDVYTKGIVEGHSSPATYTLADFRRDVSSAIRRAFPNHNITEGGKSIKIPRTTNNIPADVVPCLEYRLYYKTQSGAVDHASGIWLRDVQRNHEVTSFPTQSYENGVAKHGRTSNWYKPTVRIFKNARGWMEDNGLIRSGTASSHAIECLLYNVPDQQFGSRCGSTFVNVVNWLSSADLTNFVCQNGIQRLFSDGRWTEANARAFIAGLIQMWNQWR

SEQ ID NO: 1621 - protein, 278 aa, Luteimonas huabeiensis
MTSASAIYQRIRDALQADTTLSVRNFDVFLQGSYRNSTNIRGDSDVDVVVRLNETYMPDYSLLDVYTKGIVEGHSSPATYTLADFRRDVSSAIRRAFPNHNITEGGKSIKIPRTTNNIPADVVPCLEYRLYYKTQSGAVDHASGIWLRDVQRNHEVTSFPTQSYENGVAKHGRTSNWYKPTVRIFKNARGWMEDNGLIRSGTASSHAIECLLYNVPDQQFGSRCGSTFVNVVNWLSSADLTNFVCQNGIQRLFSDGRWTEANARAFIAGLIQMWNQWR

SEQ ID NO: 1622 - protein, 304 aa, Sulfurifustis variabilis
MGIPENQLDTWSRQGATASASAIYERIRTALLADVALSSQNFDVFLQGSYRNSTNIRGDSDVDVVVKLKDIFQPDYSQLDEFTKGKVKAGHRDATYTLTDFRRDVSGAIRRAFPNHHITEGGKSIKIPRTANNIPADVVPCLEYRLYRPLQTLLGDATYIEGIWLSDVQRNYAVTSFPRQSYENGVAKHGRTNDWYKPTVRIFKNARGWMEDNGLIQSGMASSHAIECLLYNVPDQQFGQSCRDTFVNVVNWLNAADMRNFVCQNGIQRLFDPGRWTTQNARAFIGALIQMWNQWGQQYARVRI

SEQ ID NO: 1623 - protein, 237 aa, Serratia odorifera
MAQSASTYSIIKNALESANTKYHGKNFKVFLQGSYGNDTNIYAESDVDVVICLDDVYYSDLTQLSPEDKEAYDRAFVPATYSYTQFKQDVLEALTERFGSDVKVGDKAIVVAANGSRRKADVIASMQFRRYWKFKGHYDSQYDEGICFFNGAGERIANYPKQHSENLTLKHQASNKWLKPMVRVLKNLRSKLIADGKLKPGLAPSYYLEGLLYNVPNEKFGTSYADCFVNAINWIQT

SEQ ID NO: 1624 - protein, 241 aa, Xenorhabdus nematophila
MSQEAFSDVYSRTYNTIKGALEAASAAYHGKNYQVFLQGSYGNDTNIYSESDVDVVIRLDDVYYDDLTSLSPENKTAYDHAHVPATYPYDQYKKDVIKALTDRFGSDIKVGDKAIAVAANGSRRKADVIAAMQFRRYWKFKSIYDAQYTEGICFFNGAGELIANYPNQHSDNLTTKHQGSNQWLKLMVRILKNIRSKLVDDGALQPGIAPSYYLEGLLYNVPNEKFGSSYADSFVNAINWI

SEQ ID NO: 1625 - protein, 241 aa, Xenorhabdus nematophila
MSQEAFSDVYSRTYNTIKGTLEAASAAYHGKNYQVFLQGSYGNDTNIYSESDVDVVIRLDDVYYDDLTSLSPENKTAYDHAHVPATYPYDQYKKDVIKALTDRFGSDIKVGDKAIAVAANGSRRKADVIAAMQFRRYWKFKSIYDAQYTEGICFFNGAGELIANYPNQHSDNLTTKHQGSNQWLKLMVRILKNIRSKLVDDGALQPGIAPSYYLEGLLYNVPNEKFGSSYADSFVNAINWI

SEQ ID NO: 1626 - protein, 289 aa, Tetrasphaera elongata
MASTPQERRDWTAAGSDVTAKNTYSSIKRALAILESAYNVEIFLQGSYANATNIRADSDVDIVVMTKRTFQGSRSRLSSSQQARWDALPAATFTESDLRAEVLSALSQYYGQSRVHSRNKCITVDAAPGYVDADVVPCLQYRHYPGPNSDISAGFVEGIAIHPLRGGQIVNFPKEHIKNGQAKNAECSKTYKATVRQVKRLRNRAVRNGMLRDGIAPGYLLECMVYNVPSSRFIADDSRRLLEVLSWLRVSSKASFKSCDGIHDLFATDPGGFSVSVAQEILDALWEAY

SEQ ID NO: 1627 - protein, 296 aa, Corynebacterium lubricantis
MATKHDEHVAWTAQGSVEASKRTYASICEAISRSTELQVVNPEVFLQGSYANNTNTRGDSDVDVVVMMTSTFMPETSRLSGSEKGNFELNRVPGTTSASDFRRMVERALHEYYGSARLQNKNKCITVAKSDGYVAADVVPAMQHRLFTRYSPTGHSNWVEGISITPLQGNRIVNYPKEHISQGQAKNKAANGNYKATVRQVKRLRRKAVSLGLLNPGDAPGYLLECLVSNLPDQLFVNDPSERLTKVMARLSVLSPDTLRSVMWSGDRIHKLFVDDPGQHNEYTTARVINILWDLL

SEQ ID NO: 1628 - protein, 327 aa, Amycolatopsis alba
MAAAVVRRSLTLGPAAESWHARRTVAEKNAAWTSQPDTFLLAWAEGVLRDALRRSPLLDARSYEIFGQGSRVNNTYIEQASDIDLVLMVKMPFESNVDALDEPSMDNFRESYQVGPYSWEEFREDVMAALGESYLVRMGRRCVNVDAPNSIFGAMVDILVATEYRLYSAFPSPGVEVYEQGVFFRDREGRRIVNFPKQHRRNGDQKDLCTGGRFKEAVRTAKRARRLAERERMIAEGAAPSYLLECLLYNVPDIVYRTSSPGDAYRGALEWLRRSHREDPMFFAELPCQNGINRLFGESPDQWEACEAGGIVDVLHEIRSPRPVVAA

SEQ ID NO: 1629 - protein, 323 aa, Amycolatopsis alba
MVRRSLTLGPAAESWHARRTVAEKNAAWTSQPDTFLLAWAEGVLRDALRRSPLLDARSYEIFGQGSRVNNTYIEQASDIDLVLMVKMPFESNVDALDEPSMDNFRESYQVGPYSWEEFREDVMAALGESYLVRMGRRCVNVDAPNSIFGAMVDILVATEYRLYSAFPSPGVEVYEQGVFFRDREGRRIVNFPKQHRRNGDQKDLCTGGRFKEAVRTAKRARRLAERERMIAEGAAPSYLLECLLYNVPDIVYRTSSPGDAYRGALEWLRRSHREDPMFFAELPCQNGINRLFGESPDQWEACEAGGIVDVLHEIRSPRPVVAA

SEQ ID NO: 1630 - protein, 254 aa, Actinoplanes awajinensis
MLPASGAFLLPWAESVLDGALRRSGLIDPRTYEIFGQGSRVNNTFIDEASDIDLVLMLRSPVASPGGWTGFRDEVMAALGESFVVRMGRRCLNVDNPDSLFGEMVDILVATEFRRYTGDRYEQGVYFLDREGRPIVNFPKQHRRYGDAKDLRTGGRFKEAIRTAKRARRGADFFAEGIAPSYLIECLLYNVPDEVYLRGSYQDAWEWLGRCWREDPVGFGALPCQNGINRLFGPGPDQWDAGAAGRIIDVLHQI

SEQ ID NO: 1631 - protein, 239 aa, Actinoplanes derwentensis
MLDGRPFEIFGQGSRVNDTHLDQGSDIDLVLMLTAPAPGYGWEEFRDDVLTVLGKSYTVRMGRRCLNVDDPGSLFGEMVDVLVATEHRWYPVPGADYYEQGVFFRDQDGRAIVNFPRQHRRNGDAKDRCTEGRFKAAVRSAKRARRLGGADLMIDGWLAPSYLIECLLFNVPDRVYRSAASPSAAYRDALAWLRRTHRDDPATFAALPCQNGINRLFGPGPDQWDPGAAARIIGVLHQL

SEQ ID NO: 1632 - protein, 253 aa, Actinoplanes philippinensis
MDGEFLLSWAASELRRELGPYSRPFEIFGQGSRVNGTHLGHDSDIDLVLMLTEPGHGWERFRDDVLTVLGESHIVRMGRRCLNVDDPDSLFAEMVDILVATEHRWYPVPGSPHYEQGVFFRDQQGRPIVNFPKQHRLHGDVKDLRTGGRFKQAVRAVKRARRWAEAEHLLEEGTAPSYLVECLLFNVPDPVYLSAPGPAHREAVAWLSRHHREDPESFAALPCQNGINRLFGPGPDQWEPGAAARIIDVLHQI

SEQ ID NO: 1633 - protein, 238 aa, Actinoplanes rectilineatus
MALRSSEFWLPWAEKELRDALGRSTLLDTRRYEIFVQGSRANGTALDDTSDIDLVLMLTGPHDPGYGWEEFRDDVLTTMGKSYRVRMGRRCLNVDEPDSLFGEMVDVLVATEHRGGVFFRDENGLPIVNFPKQHRRNGDAKDLRTGGRFKQAVRAAKRARVENGVPAPSYLLECLLYNVPDNVFNLVSYRSALGWLREHRDELDGLYCQNGINRLFGPGPDQWDADQVARIIDVLHQI

SEQ ID NO: 1634 - protein, 330 aa, Staphylococcus aureus
MNGGANLLFTEEQLKLYSKPLSESEKEKCENAIRIIQESLESLGYEIKKGIHRNNEDTLSYQIKMTNSSKDYELSIFVKGSYATNTNVRQNSDVDIAVVKESEFFDKYREGKTRENYKFISSNKPPYYFKDEVEEALIEKFGRSEVRRGNKAIRINGNTYRKETDCVPCFRYRDYSNDYMDDPNNFIGGITIYSDKGERIINYPEQHINNSVIKNNNTNYKYKKMVRIIKEIRYQLIDSKNRNAEQTSSFGVEGLFWNIPDYKYSNDEMLGDTFNALIAFLIDNIDKLSEFKEPNDILYLCDSQEKNNVYKNFILDVKNYFEYSGEKKNE

SEQ ID NO: 1635 - protein, 330 aa, Staphylococcus epidermidis
MNGGANLLFTEEQLKLYSKPLSESEKEKCENAIRIIQESLESLGYEIKKGIHRNNEDTLSYQIKMTNPSKDYELSIFVKGSYATNTNVRQNSDVDIAVVKESEFFDKYREGKTRENYNFISSNKPPYHFKDEVEEALIERFGRSEVRRGNKAIRINGNTYRKETDCVPCFRYRDYSNDYMDDPNNFIGGITIYSDKGERIINYPEQHINNSVIKNNNTNYKYKKMVRIIKEIRYQLIDSKNRNAEQTSSFGVEGLFWNIPDYKYSNDEMLGDTFNALIAFLIDNIDKLSEFKEPNDILYLCDSQEKINVYKNFILDVKNYFEYSGEKKYE

SEQ ID NO: 1636 - protein, 324 aa, Staphylococcus epidermidis
MLFTEEQLKLYSKPLSESEKEKCENAIRIIQESLESLGYEIKKGIHRNNEDTLSYQIKMTNPSKDYELSIFVKGSYATNTNVRQNSDVDIAVVKESEFFDKYREGKTRENYNFISSNKPPYHFKDEVEEALIERFGRSEVRRGNKAIRINGNTYRKETDCVPCFRYRDYSNDYMDDPNNFIGGITIYSDKGERIINYPEQHINNSVIKNNNTNYKYKKMVRIIKEIRYQLIDSKNRNAEQTSSFGVEGLFWNIPDYKYSNDEMLGDTFNALIAFLIDNIDKLSEFKEPNDILYLCDSQEKINVYKNFILDVKNYFEYSGEKKYE

SEQ ID NO: 1637 - protein, 324 aa, Unknown
  Description of Unknown: Staphylococcus sequence
MLFTEEQLKLYSKPLSESEKEKCENAIRIIQESLESLGYETKKGIHRNNEDTLSYQIKMTNPSKNYELSIFVKGSYATNTNVRQNSDVDIAVVKESEFFDKYREGKTRENYKFISSNKPPYHFKDEVEEALIERFGRSEVRRGNKAIRINGNTYRKETDCVPCFRYRDYSNDYMDDPNNFIGGITIYSDKGERIINYPEQHINNSVIKNNNTNYKYKKMVRIIKEIRYQLIDSKNRNAEQTSSFGVEGLFWNIPDYKYSNDEMLGDTFNALIAFLIDNIDKLSEFKEPNDILYLCDSQEKNNVYKNFILDVKNYFEYSGEKKYE

SEQ ID NO: 1638 - protein, 324 aa, Staphylococcus aureus
MLFTEEQLKLYSKPLSESEKEKCENAIRIIQESLESLGYEIKKGIHRNNEDTLSYQIKMTNPSKDYELSIFVKGSYATNTNVRQNSDVDIAVVKESEFFGKYREGKTRENYKFISSNKSPYHFKDEVEEALIERFGRSEVRRGNKAIRINGNTYRKETDCVPCFRYRDYSNDYMDDPNNFIGGITIYSDKGERIINYPEQHINNSVIKNNNTNYKYKKMVRIIKEIRYQLIDSKNRNAEQTSSFGVEGLFWNIPDYKYSNDEMLGDTFNALIAFLIDNIDKLSEFKEPNDILYLCDSQEKNNVYKNFILDVKNYFEYSGEKKYE

SEQ ID NO: 1639 - protein, 324 aa, Staphylococcus epidermidis
MLFTEEQLKLYSKPLSESEKEKCENAIRIIQESLESLGYEIKKGIHRNNEDTLSYQIKMTNPSKDYELSIFVKGSYATNTNVRQNSDVDIAVVKESEFFDKYREGKTRENYKFISSNKPPYHFKDEVEEALIERFGRSEVRRGNKAIRINGNTYRKETDCVPCFRYRDYSNDYMDDPNNFIGGITIYSDKGERIINYPEQHINNSVIKNNNTNYKYKKMVRIIKEIRYQLIDSKNRNAEQTSSFGVEGLFWNIPDYKYSNDEMLGDTFNALIAFLIDNIDKLSEFKEPNDILYLCDSQEKNNVYKNFILDVKNYFEYSGEKKYE

SEQ ID NO: 1640 - protein, 324 aa, Staphylococcus epidermidis
MLFTEEQLKLYSKPLSESEKEKCENAIRIIQESLESLGYETKKGIHRNNEDTLSYQIKMTNPSKNYELSIFVKGSYATNTNVRQNSDVDIAVVKESEFFDKYREGKTRENYKFISSNKPPYHFKDEVEEALIERFGRSEVRRGNKAIRINGNTYRKETDCVPCFRYRDYSNDYMDDPNNFIGGITIYSDKGERIINYPEQHINNSVIKNNNTNYKYKKMVRIIKEIRYQLIDSKNRNAEQTSSFGVEGLFWNIPDYKYSNDEMLGDIFNASIAFLIDNIDKLSEFKEPNDILYLCDSQEKNNVYKNFILDVKNYFEYSGEKKYE

SEQ ID NO: 1641 - protein, 324 aa, Staphylococcus sp.
MLFTEEQLKLYSKPLSESEKEKCENAIRIIQESLESLGYEIKKGIHRNNEDTLSYQIKMTNPSKDYELSIFVKGSYATNTNVRQNSDVDIAVVKESEFFDKYREGKTRENYKFISSNKPPYHFKDEVEEALIERFGRSEVRRGNKAIRINGNTYRKETDCVPCFRYRDYSNDYMDDPNNFIGGITIYSDKGERIINYPEQHINNSVIKNNNTNYKYKKMVRIIKEIRYQLIDSKNRNAEQTSSFGVEGLFWNIPDYKYSNDEMLGDTFNALIAFLIDNIDKLSEFKEPNDILYLCDSQEKNNIYKNFILDVKNYFEYSGEKKYE

SEQ ID NO: 1642 - protein, 324 aa, Staphylococcus aureus
MLFTEEQLKLYSKPLSESEKEKCENAIRIIQESLESLGYEIKKGLHRNNEDTLSYQIKMTNPSKDYELSIFVKGSYATNTNVRQNSDVDIAVVKESEFFDKYREGKTRENYKFISSNKPPYHFKDEVEEALIERFGRSEVRRGNKAIRINGNTYRKETDCVPCFRYRDYSNDYMDDPNNFIGGITIYSDKGERIINYPEQHINNSVIKNNNTNYKYKKMVRIIKEIRYQLIDSKNRNAEQTSSFGVEGLFWNIPDYKYSNDEMLGDTFNTLIAFLIDNIDKLSEFKEPNDILYLCDSQEKNNVYKNFILDVKNYFEYSGEKKYE

SEQ ID NO: 1643 - protein, 331 aa, Staphylococcus aureus
MLFTEEQLKLYSKPLSESEKEKCENAIRIIQESLESLGYEIKKGLHRNNEDTLSYQIKMTNPSKDYELSIFVKGSYATNTNVRQNSDVDIAVVKESEFFDKYREGKTRENYKFISSNKPPYHFKDEVEEALIERFGRSEVRRGNKAIRINGNTYRKETDCVPCFRYRDYSNDYMDDPNNFIGGITIYSDKGERIINYPEQHINNSVIKNNNTNYKYKKMVRIIKEIRYQLIDSKNRNAEQTSSFGVEGLFWNIPDYKYSNDEMLGDTFNTLIAFLIDNIDKLSEFKEPNDILYLCDSQEKNNVYKNFILDVKNYFEYSGEKKYEWQNKSFD

SEQ ID NO: 1644 - protein, 324 aa, Staphylococcus aureus
MLFTEEQLKLYSKPLSESEKEKCENAIRIIQESLESLGYEIKKGIHRNNEDTLSYQIKMTNPSKDYELSIFVKGSYATNTNVRRNSDVDIAVVKESEFFDKYREGKTRENYKFISSNKPPYHFKDEVEEALIERFGRSEVRRGNKAIRINGNTYRKETDCVPCFRYRDYSNDYMDDPNNFIGGITIYSDKGERIINYPEQHINNSVIKNNNTNYKYKKMVRIIKEIRYQLIDSKNRNAEQTSSFGVEGLFWNIPDYKYSNDEMLGDTFNALIAFLIDNIDKLSEFKEPNDILYLCDSQEKNNVYKNFILDVKNYFEYSGEKKYE

SEQ ID NO: 1645 - protein, 324 aa, Staphylococcus aureus
  MOD_RES (296)..(296): Any amino acid
MLFTEEQLKLYSKPLSESEKEKCENAIRIIQESLESLGYETKKGIHRNNEDTLSYQIKMTNPSKNYELSIFVKGSYATNTNVRQNSDVDIAVVKESEFFDKYREGKTRENYKFISSNKPPYHFKDEVEEALIERFGRSEVRRGNKAIRINGNTYRKETDCVPCFRYRDYSNDYMDDPNNFIGGITIYSDKGERIINYPEQHINNSVIKNNNTNYKYKKMVRIIKEIRYQLIDSENRNAEQTSSFGVEGLFWNIPDYKYSNDEMLGDTFNALIAFLIDNIDKLSEFKEPNDILYLCXSQEKNNVYKNFILDVKNYFEYSGEKKYE

SEQ ID NO: 1646 - protein, 324 aa, Staphylococcus schleiferi
MLFTEEQLKLYSKPLSESEKEKCENAIRIIQESLESLGYETKKGIHRNNEDTLSYQIKMTNPSKDYELSIFVKGSYATNTNVRQNSDVDIAVVKESEFFDKYREGKTRENYKFVSSNKPPYHFKDEVEEALIERFGRSEVRRGNKAIRINGNTYRKETDCVPCFRYRDYSNDYMDDPNNFIGGITIYSDKGERIINYPEQHINNSVIKNNNTNYKYKKMVRIIKEIRYQLIDSKNENAKQTSSFGVEGLFWNIPDYKYSNDEMLGDTFNALIAFLIDNIDKLREFKEPNDILNLCDSQEKNNVYKNFILDVKNYFEYSGEKKYE

SEQ ID NO: 1647 - protein, 324 aa, Staphylococcus stepanovicii
MLFTEEQLKLYSKPLSESEKEKCENAIRIIQESLESLGYETKKGIHRNNEDTLSYQIKMTNPSKDYELSIFVKGSYATNTNVRQNSDVDIAVVKESEFFDKYREGKTRENYKFVSSNKPPYHFKDEVEEALIERFGRSEVRRGNKAIRINGNTYRKETDCVPCFRYRDYSNDYMDDPNNFIGGITIYSDKGERIINYPEQHINNSVIKNNNTNYKYKKMVRIIKEIRYQLIDSKNGNAKQTSSFGVEGLFWNIPDYKYSSGRTLGDTFNALITFLIVNIDKLSEFKEPNDILYLCDSQEKNNVYKNFILDVKNYFEYSGEKKYE

SEQ ID NO: 1648 - protein, 324 aa, Staphylococcus aureus
MLFTEEQLKLYSKPLSESEKEKCENAIRIIQESLESLGYETKMGIRRNNEDTLSYQIKMTNPSKDYELSIFVKGSYATNTNVRQNSDVDIAVVKESEFFDKYREGKTRENYKFVSSNNPPYHFKDEVEEALIERFGRSEVRRGNKAIRINGNTYRKETDCVPCFRYRDYSNDYMDDPNNFIEGITIYSDKGERIINYPEQHINNSVIKNNNTNYKYKKMVRIIKEIRYQLIDSKNGNAKQTSSFGVEGLFWNIPDYKYSNDEKLGDTFNALIAFLIDNIDKLSEFKEPNDILDLCDSQEKNNVYKKFILDVKNYFEYSGEEKYE

SEQ ID NO: 1649 - protein, 324 aa, Staphylococcus chromogenes
MLFTEEQLKLYSKPLSESEKEKCENAIRIIQESLESLGYETKMGIRRNNEDTLSYQIKMTNPSKDYELSIFVKGSYATNTNVRQNSDVDIAVVKESEFFDKYREGKTRENYKFVSSNNPPYHFKDEVEEALIERFGRSEVRRGNKAIRINGNTYRKETDCVPCFRYRDYSNDYMDDPNNFIEGITIYSDKGERIINYPEQHINNSVIKNNNTNYKYKKMVRIIKEIRYQLIDSKNGNAKQTSSFGVEGLFWNIPDYKYSNDEKLGDTFNALIAFLIDNIDKLSEFKEPNDILYLCDSQEKNNVYKNFILDVKNYFEYSGEKKYE

SEQ ID NO: 1650 - protein, 323 aa, Staphylococcus cohnii
MLFNEEQLKFYSKPLSDLEEEKCENAIRIIQESLESLGYETKKGIHRNNEDTLSYQIKMTNPSKDYELSIFVKGSYATNTNVRQNSDVDIAVVKESEFFDKYREGKTRENYKFVSSNKPPYHFKDEVEEALIERFGRSEVRRGNKAIRINGNTYRKETDCVPCFRYRDYSNDYMDDPNNFIGGITIYSDKGERIINYPEQHINNSVIKNNNTNYKYKKMVRLIKEIRYQLIDSKNGNAEQTSSFGVEGLFWNIPDYKYSNDELLGDTFNALIAFLIDNIDKLSEFKEPNDILYLCDSHEKNNVYKNFILDVKNYFEYSGEKKI

SEQ ID NO: 1651 - protein, 297 aa, Staphylococcus aureus
MNGGANLLFTEEQLKLYSKPLSESEKEKCENAIRIIQESLESLGYEIKKGIHRNNEDTLSYQIKMTNSSKDYELSIFVKGSYATNTNVRQNSDVDIAVVKESEFFDKYREGKTRENYKFISSNKPPYYFKDEVEEALIEKFGRSEVRRGNKAIRINGNTYRKETDCVPCFRYRDYSNDYMDDPNNFIGGITIYSDKGERIINYPEQHINNSVIKNNNTNYKYKKMVRIIKEIRYQLIDSKNRNAEQTSSFGVEGLFWNIPDYKYSNDEMLGDTFNALIAFLIDNIDKLSEFKEPNDR

SEQ ID NO: 1652 - protein, 308 aa, Staphylococcus aureus
MLFTEEQLKLYSKPLSESEKEKCENAIRIIQKSLESLGYEIKKGIHRNNEDTLSYQIKMTNPSKDYELSIFVKGSYATNTNVRQNSDVDIAVVKESEFFDKYREGKTRENYKFISSNKPPYHFKDEVEEALIERFGRSEVRRGNKAIRIKGNTYRKETDCVPCFRYRDYSNDYMDDPNNFIGGITIYSDKGERIINYPEQHINNSVIKNNNTNYKYKKMVRIIKEIRYQLIDSKNRNAEQTSSFGVEGLFWNIPDYKYSNDEMLGDTFNALIAFLIDNIDKLSEFKEPNDILYLCDSQEKIMFIKILF

SEQ ID NO: 1653 - protein, 324 aa, Staphylococcus vitulinus
MLFTEEQLKSYSKPLSESEKEKCENAIRIIQESLESLGYETKNGIHRNNEDTLSYQIKMTNSSKDYELSIFVKGSYATNTNVRQNSDVDIAVVKENEFFGKYREGKTRENYKFVSSNKLPYHFKDEVEEALIKRFGRSEVRRGNKAIRINGNTYRKETDCVPCFRYRDYSNDYIDDPNNFIGGITIYSDKGERIINYPEQHINNSVIKNKNTNSKYKKMVRIIKEIRYQLIDSKNENAEQTSSFGVEGLFWNIPDYKYSSGLTLGDTFNALITFLIDNIDKLSEFKEPNDILYLCDSQEKNSAYKNFILDVKNYFEYSGEKKYE

SEQ ID NO: 1654 - protein, 324 aa, Staphylococcus sciuri
MLFTEEQLKSYSKPLSESEKEKCENAIRIIQESLESLGYETKNGIHRNIEDTLSYQIKMTNSSKDYELSIFVKGSYATNTNVRQNSDVDIAVVKENEFFGKYREGKTRENYKFVSSNKPPYHFKDEVEEALIKRFGRSEVRRGNKAIRINGNTYRKETDCVPCFRYRDYSNDYIDDPNNFIGGITIYSDKGERIINYPEQHIKNSVIKNKNTNYRYKKMVRIIKEIRYQLIDSKNENAEQTSSFGVEGLFWNIPDYKYSSGLTLGDTFNALITFLIDNIDKLSEFKEPNDILYLCDSQEKNSAYKNFILDVKNYFEYSGEKKYE

SEQ ID NO: 1655 - protein, 320 aa, Staphylococcus haemolyticus
MLFSEEQLKTYTKPLSNSEKEKCKNAIKMIQKSLEYLGYSTKEENNDENDSVFSYKIKMNNSSNSYHLSIFIKGSYATNTNVRQNSDVDIAVVKEHEFSTEHREGITDRDYKFIESNLPPRDFKDEVEQALIKHFGNQKVKRGNKAIRINGNSYRIDADCVPCFRHRNYRNDFYQDVNNYLQGIAIYSDDGQKVINYPQQHIEKSIEKNKDTNYSYKKMVRIIKELRYQLIENQNENAKNTSSFGVEGLLWNIPNNIFLDENSLGSSFNILIDYLINNIYKLENFKEPNDILYLCTSYEKLNIYKNFILDLRKYYEYKGE

SEQ ID NO: 1656 - protein, 320 aa, Unknown
  Description of Unknown: Staphylococcus sequence
MLFSEEQLKTYTKPLSNSEKEKCKNAIKMIQKSLEYLGYSTNEENNDENDSVFSYKIKMNNPSNSYHLSIFIKGSYATNTNVRQNSDVDIAVVKEHEFSTEHRAGVTDRDYKFIESNVPPRYFKDEVEQALIKHFGNQKVKRGNKAIRINGNSYRIDADCVPCFRHRNYRNDFYQDVNNYLQGIAIYSDDGQKVINYPQQHIEKSIEKNKDTNYRYKKMVRIIKELRYQLIENQNENAKNTSSFGVEGLLWNIPNNVFLDENSLGSSFNILIDYLINNIYKLENFKEPNNILYLCTSYEKLNIYKNFILDLRKYYEYKGE

SEQ ID NO: 1657 - protein, 271 aa, Staphylococcus epidermidis
MLFSEEQLKTYTKPLSNSEKEKCKNAIKMIQKSLEYLGYSTNEENNDENDSVFSYKIKMNNPSNSYHLSIFIKGSYATNTNVRQNSDVDIAVVKEHEFSTEHRAGVTDRDYKFIESNVPPRYFKDEVEQALIKHFGNQKVKRGNKAIRINGNSYRIDADCVPCFRHRNYRNDFYQDVNNYLQGIAIYSDDGQKVINYPQQHIEKSIEKNKDTNYRYKKMVRIIKELRYQLIENQNENAKNTSSFGVEGLLWNIPNNVFLDENSLGSSFNIL

SEQ ID NO: 1658 - protein, 325 aa, Staphylococcus equorum
MHFTEEQLKRYAKPLSDTEKNMCKNVIKMVRESLQTLGFEAEGDIDVLNEDTFSYRIKMKKSSASYKINIFVKGSYANNTNVRQNSDVDIAVVREDVFYTEFRTGVSRESYNLTQANESFFAYKDEVEEALKQKFGSTEVQRGNKAIRINGNTYRKEADCVPCLRYRDYQKDFSFNTENYVGGIKIFSDKGEKIINYPEQHIDNGVIKNKSTSYNYKKMVRIIKEMRYQLIEQENKNAKNTSSFGVEGLIWNVPNSYFTKYSSYGFIFEELINYLERNLCDIIYFKEANGILNLCNTSEKINIYQQFVRDLGKYFNYKYGVSNGA

SEQ ID NO: 1659 - protein, 318 aa, Peptoniphilus sp.
MKFTEEQLKNYAKPISETEENQCKNAIRMVADALKELGLKESNIINKMYSDIPSYQLRMSGENGYEVKIFLQGSYANNTNVRSNSDVDVAVVQEDRFRPKYRQGVSRENYGFVTATPRERSFKDDVEIVLRKKFGYDVHRKNKSIKINGNSYRKDTDSVPALRFRDYTADYSYNENNYVGGILIIPDIGNEIINYPEQHMENGIEKNKKTNYYFKKMVRIAKEMRYKMIDEGYKSAKDVSSFLVECLVWNVPDEYFTKYTSYRFIFDEIVDFLYNSLTLISNFKEVNGIKLIGSDDSERIDYCSKFIKDLYRFYEYEI

SEQ ID NO: 1660 - protein, 318 aa, Asaccharospora irregularis
MIFTEEQLRSYAKPLSETEENQCKNAIRMVSNALKDLGLKENEMDTLYGASTAYEIRMTGGATGYDIKLFLQGSYANNTNVRGHSDIDIAVVQEDTFRPAYRLNVSGADYGFTNATPRIKSFKDEVEDILRNYFGKDVERKNKSIKINGNSYRKDTDSVPSMRHRDYRQDYTFDKENYIGGILIKADDGQEIINYPEQHIKNGVEKNNDTNYYFKKMVRVAKELRYQMKDLGYSYAQKASSFGVECLLWNIPNKYFTKYSTYCYVFDDIVKYLYDNRFSLLDFMEVNNIKKLCDDSLDRRDIYKGFIEELKGFYKYEI

SEQ ID NO: 1661 - protein, 318 aa, Anaerosalibacter sp.
MIFTEEQLKDYAKPLSETEENQCKNAIRMVSNALKDLGLSENEMETIYGASTAYQIRMSGGLSGYDIKLFLQGSYANNTNVRGHSDVDIAVVQEDIFRPAYRLNVSGADYGFTNATPRIKSFKDEVEDILRNHFGKDVERKNKSIKINGNSYRKDTDSVPSMRHRDYRQDYTFDKENYIGGILIKADDGQEIINYPEQHIKNGVEKNNATNYYFKKMVRIAKELRYQMKDLRYPYAQKASSFGVECLLWNVPNEYFTKYSTYRYAFDEIVGYLYDNRYSTLNFMEVNNIKKLCDDSPDRRDIYKGFIEELKGFYEYEI

SEQ ID NO: 1662 - protein, 318 aa, Clostridium tepidum
MIFTEEQLKDYAKPLSETEENQCKNAIRMVSNALKDLGLSENEMETIYGASTAYQIRMSGGLSGYDIKLFLQGSYANNTNVRGHSDVDIAVVQEDIFRPAYRLNVSGADYGFTNATPRIKSFKDEVEDILRNHFGKDVERKNKSIKINGNSYRKDTDSVPSMRHRDYRQDYTFDKENYIGGILIKADDGQEIINYPEQHIKNGVEKNNATNYYFKKMVRIAKELRYQMKDLRYPYAQKASSFGVECLLWNVPNEYFTKYSTYRYVFDEIVGYLYDNRYSTLNFMEVNNIKKLCDDSPDRRDIYKGFIEELKGFYEYEI

SEQ ID NO: 1663 - protein, 318 aa, Fusobacterium nucleatum
MIFTEEQLRKYAKPLSETEENQCKNAIRMVVDALKTIGFNERTSIQKMYSETPSFEVMMKSNDDYEVKIFLQGSYANNTNVRQHSDVDIAVVQIDQFRPKYRVGVSKTNYGFISAISKSKTFKDIVQSALENKFGDDVERKNKSIKIHGNSYRKDADSVPALRYRDYSYDYRFDPENYVGGILIKADDGTEVINYPEQHIKNGIDKNKRTNLYFKKMVRIAKEMRYQMQDEGYEFAQKTSSFAIECLLYNVPDEIFTKYDCYKYIFDDIVEFLYDNKHNINSFVEVNGIKKLCYDSADREKVYKGFIDELKGFYSYEI

SEQ ID NO: 1664 - protein, 318 aa, Eggerthia catenaformis
MIFTEEQLRKYAKPLSETEENQCKNAIRMVVDALKTIGFNERTSIQKMYSETPSFEVMMKSNDDYEVKIFLQGSYANNTNARQHSDVDIAVVQIDQFRPKYRVGVSKTNYGFISAISKSKTFKDIVQSALENKFGDDVERKNKSIKIHGNSYRKDADSVPALRYRDYSYDYRFDPENYVGGILIKADDGTEVINYPEQHIKNGIDKNKRTNLYFKKMVRIAKEMRYQMQDEGYEFAQKASSFGIECLLYNVPDEIFTKYDCYKYIFDDIVEFLYDNKHNINSFVEVNGIKKLCYDSADREKIYKGFIDELKGFYSYEI

SEQ ID NO: 1665 - protein, 318 aa, Anaerococcus tetradius
MIFTEEQLRKYAKPLSETEENQCKNAIRMVVDALKTIGFNERTSIQKMYSETPSFEVMMKSNDDYEVKIFLQGSYANNTNVRQHSDVDIAVVQIDQFRPKYRVGVSKTNYGFISAISKSKTFKDIVQSALENKFGDDVERKNKSIKIHGNSYRKDADSVPALRYRDYSYDYRFDPENYIGGILIKADDGTEVINYPEQHIKNGIDKNKRTNLYFKKMVRIAKEMRYQMQDEGYEFAQKASSFGIECLLYNVPDEIFTKYDCYKYIFDDIVEFLYDNKHNINNFIEVNGIKKLCYDSADREKVYKGFIDELKGFYSYEI

SEQ ID NO: 1666 - protein, 319 aa, Veillonella sp.
MIFTEEMLKNYARPLSETEETMCKNAISMVMDALKELGFHAKDNIIKAYENTASFEVKMSREEEGYDVKIFLQGSYANNTNVRGHSDVDIAVVQEDRFIPLYRPGVSREDYGFWTVNPNTKVFKDLVFDSLRNKFIDDVVRKNKSIKINGNTYRKDTDVVPAMRYRDYSKDERLDPNNFTGGIRIDTDNGEVIINYPEQHIKNGIEKNKRTKHYFKKMVRIGKEIRYQMNDLGYKYASDISSFGIESLFYNVPDYVYLSSKEYRYIFQMAINYLYFNKSKVVEFYEINGIKELCKKYSEDETKYLGFIDELKMYYEYEE

SEQ ID NO: 1667 - protein, 329 aa, Unknown
  Description of Unknown: uncultured Clostridium sp. sequence
MKFTESMLTNYSQPLSATEDGQCKNAIRMVADALKTLGFTDDNAAITPLYTDTFAYSLRMRRSSDSRNIKLFVQGSYANNTNVRTESDVDVAVIQEETFLPEYRKDSVYPQSGADYGFTPAPAAAKTFKDEVQEALKCKFGTDVERKNKSIKVHGNTYRKDADTVPCRRYRDYRQDYRRDASNFVGGVVIYPDNGGMIINYPEQHIANGRKKNNDTNHHYKKMVRIMKKMRYLMEDSYITAYSSAAKNVSSFMLESLLWNIEDSWYRTYCGTYRKVYAFSQLIATLQNRKNDFWGYKEANGIKELCPKPSDYTNLCNFIDQLASFYEYE

SEQ ID NO: 1668 - protein, 319 aa, Bacillus ginsengihumi
MKFSEDQLKLFAAPLSETEDQKCKNAIGMVRDALKNLGFNDEGKAIEKMYSDTYAYSLEMRSATKNRKVRLFVKGSYANNTNVRTESDVDIAVVLESTFKVKYRPNINDSLYGFSDSTDSVQTFKDEVEIALKRKFGKDVERKNKSIKIHGNTYRVDADTVPCMRHRDYTNDYSSDPNNFLGGIFIQSDDGQTIVNYPEQHIKNGREKNNRTKTYYKKMVRIIKKMRYIMQDEKYESSNSVSSFGLESLLWNLPDEVFTKYSIYRYAFGEVMDYLVKNTNMLANYKEANGIKPLCNSSIEIENYIRFIKDLYYFNEYDI

SEQ ID NO: 1669 - protein, 319 aa, Bacillus lentus
MKFTEDRLKSFAAPLSDTEDQKCKNAIGMVRDALKNIGFSDEGKNIEKMYLDTYSYSIEMRNAARNRKVKLFVQGSYANNTNVRTESDVDIAVVLESTFRTKYRPTTSDSTYGFSSSNDNVQTFKDEVEIALREKFGSDVERKNKSIKIHGNTYRVDADGVPCMRHRDYSNDYSSNPDNYIGGILIRSDEGQTIINYPEQHIRNGREKNNQTRTYYKKMVRIVKKMRYIMKDEGYESADIISSFGLESLLWNLPNEIFTKYSTYRYAFGEITNYLHRNVGMIPDYKEANGIKPLCSSSTEIESYKRFINDLYYFYEYDI

SEQ ID NO: 1670 - protein, 319 aa, Virgibacillus sp.
MKFTEERLKLFAAPLSETEDQKCKNAIGMVRDALKGIGFSDEGKNIEKMYMDTYSYSLEMRSTTNNRKVKLFVKGSYANNTNVRTESDVDIAVVLESTFKVKYRPAISDSSYGFSNSSDNVQTFKDEVEIALRDKFGSDVERKNKSIKIHGNTYRVDADGVPCMRHRDYSNDYSSNPDNYLGGISIRSDDGERIVNYPEQHIKNGREKNNQTKTYYKKMVRIIKKMRYIMQDENYESVNKVSSFGLESLLWNLPNEAFTKYTSYRFVFGDVMEYLKENIDKLASYKEANGIKSLCSSSVEIENYKRFINDLYYFYEYDI

SEQ ID NO: 1671 - protein, 319 aa, Paenibacillus sp.
MKFTETMLNNYSQPLSQTEDQQCKNAISMVVNALKPLGFQEKRNSVEPMYAETYAYFQELESSSGKKIKVFLQGSYANNTNVRTQSDVDIAVVEEDVFQTHYRAGVSNSNYGFVTVQAQAKTFKDEIEDALRERFGSDVKRKNKSIKINGNSYRKDADSVPCRRYKDFRYDYSNNPMNYVGGITIIADSGEEIINYPEQHIKNGKEKNVATNHYYKKMVRIIKKIRYLMDENGIPSANNVSSFALESLLWNIPTEYYLEYKEHRKVFMFYMLMRHLQNKQSELTYYKEANGIKLLCPTSDSIEKMKLFISDLTEFYEYD

SEQ ID NO: 1672 - protein, 319 aa, Paenibacillus odorifer
MKFTETMLNNYSLPLSQTEDQQCKNAINMVINALKPLGFHEKRTSVEPMYAETYAYFQELESSSGKKIKVFLQGSYANNTNVRTQSDVDIAVVEEDVFQTHYRAGVSNSNYGFVTVQAQAKTFKDEIEDALRERFGSDVKRKNKSIKINGNSYRKDADSVPCRRYKDFSCDYSNNPMNYVGGITIIADSGEEIINYPEQHIKNGKDKNVATNHYYKKMVRIIKKIRYLMGENGISSATNVSSFALESLLWNIPTEYYLEYKEHRKVFMFYMLTRHLQNNQSAINYYKEANGIKLLCPSNDSIEKMKLFISDLTKFYEYD

SEQ ID NO: 1673 - protein, 320 aa, Bacillus wiedmannii
MIFTESMLNNYAQPLSQTEDQQCKNAINMVVNSLKPLGFKEKRFNVEPMYTGTYSYFQELESEYGSRRIKVFLQGSYANNTNVRTQSDVDIAVVEEDIFQTQYRVGVSDSNYGFTTATPRPKSFKDEVENALKETFGHDVQRANKSIKINGNTYRKDADSVPCRRYKNYSQDFSNNPENFIGGIAITADTGERIINYPEQHIKNGKEKNVSTNYYYKKMVRIIKKIRYLMKENNIIAANGISSFALESLLWNIPNDKYLEYKYYRNVYMFDMLIKYLKEHNYLLSSYKEANGINLLCPTPSDVDNMNSFINALVEFYEYV

SEQ ID NO: 1674 - protein, 320 aa, Bacillus thuringiensis
MIFTESMLNNYAQPLSQTEDQQCKNAINMVVNALKPLGFKEKRFNVEPMYTGTYSYFQELESEYGSRRLKVFLQGSYANNTNVRTQSDVDIAVVEEDIFQTQYRVGVSDSNYGFTTATPRPKSFKDEVENALKGTFGNDVQRANKSIKINGNTYRKDADSVPCRRYKNYSQDFSNNPENFIGGIVITADTGERIINYPEQHIKNGKEKNVSTNYYYKKMVRIIKKIRYLMKENDIIAANGVSSFALESLLWNIPNDKYLEYKYYRNVYMFDMLIKYLKEHNYLLSSYKEANGINLLCPTPSDVDNMNSFINALVEFYEYV

SEQ ID NO: 1675 - protein, 269 aa, Paenibacillus sp.
MKFTEQVLNDYAQPLSATEEQQCKNAIRMVIDALKNLGFHEVRSTIDTMYNETNAYFQEMSSPTRKIKVFLQGSYANNTNVRTQSDVDIAVVQEEVFITKYRHGATEKDYQFQTVPNPPITFKDEVEYALKEKFGSSVSRENKSIKIHGNTYRKDADAVPCKRYKDFSYDFSNNPLNFVGGIYISADSGETIINYPEQHIKNGKEKNIATNYYYKKMVRILKMMRYLMKDLNIKSAGTISSFALESLFWNIPNNYYLENSDYRKVFFFK

SEQ ID NO: 1676 - protein, 127 aa, Paenibacillus odorifer
MGISYGGRQIKIFLQGSYANNTNVRTQSDVDIAVVEEDTFRTQYRSGVSDSNYGFVNAPSRSKTFKDEIEEALKDKFGTDVSRENKSIKIYGNTYRKDAEYLFFHLYSLDTEPILIFSSSVNESIYI

SEQ ID NO: 1677 - protein, 318 aa, Unknown
  Description of Unknown: uncultured Flavonifractor sp. sequence
MKFKESTLKLYAAPLSSTEDAKCKRAIEAIRDALKDLGYTDDQKDIGLLESDTLSYSIAMRNRYSTDKITIFIQGSYANNTCVRNESDVDIAVVRDDIFEYAFGEKFAGSSTDQKNAAVALKNAVERVLRTHFPYQVHRGNKSIKVDGNTYRKNADTVPSVAVHYYYRSHLKDYSTFWDGIVIYADDGQIIRNFPKQHIANGKAKNNQTKYYYKRMVRIIKKMRYLMSDLGYACANNVSSFGLESLLWNLPDSCFTKWTNYGFAFEEIVDYLYKNKYMLSVYKEANGIKQLCPTQRDVDSYVAFVDQLKSFFEYDYSS

SEQ ID NO: 1678 - protein, 284 aa, Roseburia inulinivorans
MVGYSDGDKEIRTIESDTYAFALDLNTKSGDKKIILLVQGSYANKTNITSQSDVDVAVILESTFMPEYRANVTGENYGFTKGTYTATELKDEVERALNIKFNYDGIERHDKSIRVYGNTYRVDADVVPAYRFRDYTNDFRFDANNYVAGIEIRPDSGGRIINYPEQHIKNGIEKNLKTNYQFKRCVRVMKNIREDMNDNGFRISDQISSFGLESLLWNIPDGIFTKYSSMKYIFEELVDYLYKNMGSFSMYYEANGIKKLFSKSEIQIAYTNFVKDLKAFYAYE

SEQ ID NO: 1679 - protein, 286 aa, Roseburia inulinivorans
MKMVGYSDGDKEIRTIESDTYAFALDLNTKSGDKKIILLVQGSYANKTNITSQSDVDVAVILESTFMPEYRANVTGENYGFTKGTYTATELKDEVERALNIKFNYDGIERHDKSIRVYGNTYRVDADVVPAYRFRDYTNDFRFDANNYVAGIEIRPDSGGRIINYPEQHIKNGIEKNLKTNYQFKRCVRVMKNIREDMNDNGFRISDQISSFGLESLLWNIPDGIFTKYSSMKYIFEELVDYLYKNMGSFSMYYEANGIKKLFSKSEIQIAYTNFVKDLKAFYAYE

SEQ ID NO: 1680 - protein, 331 aa, Peptococcaceae bacterium
MIVRGGIALNFKESQLITYATPLSATEEERCKNAIRMIRDAMKLVGYTDNNKEIRSYETDTWAFSLDLHGDMGKKIVLLVQGSYANNTNIRTQSDVDVAVILESTFIPEYRIEVTKKSYNFTDGTFTAQKLKDEVESALKRKFNGEGVERKDKSIKVHGNSYRVDADVVPAYRFRDYREDYHFDANNYVGGIEIRPDSGGNIINYPEQHIKNGRAKNNATNYCFKKHVRIMKKMKQLMLDYEYSSPKNVSSFGLESLLWNIPNAVYAKYPSVYRYTFDELIIHLRGDFDNFGTCKEANGIKTLFPTTSDRENYKTFIIALSDFYQYDIQEA

SEQ ID NO: 1681 - protein, 331 aa, Desulfosporosinus sp.; identical to SEQ ID NO: 1680

SEQ ID NO: 1682 - protein, 323 aa, Paenibacillus terrae
MKFTERQLQTYAAPLSESEEERCKNAIRMIRDAMKLIGYSDNNKEIYKYEGETPAYALELNAASNGRKLFLLVQGSYANNTNVRTQSDVDVAVILESTFIPEYRANVSKDKYGFSDGTFTVEGLKDEVERALKLKFNNDGIERNDKSIKVNGNSYRVDSDVVPAYRHRDYRGDYTFDANNYVGGIEIRPDSGGRIINFPEQHIKNGKRKNSETNHKYKKHVRIMKKMKSLMAESGYSITSSISSFGLESLLWNIPNSVYEKYTAHRFVFDEILKYLKNNFENFEGYKEANGVKPLFTSTTQQDDYKAFIRMLSEYYQYDITET

SEQ ID NO: 1683 - protein, 323 aa, Paenibacillus sp.
MKFTERQLQTYAAPLSESEEERCKNAIRMIRDAMKLIGYSDNNKEIYKYEGETPAYALELNAASNGRKLFLLVQGSYANNTNVRTQSDVDVAVILESTFIPKYRADVSRDKYGFSEGTFTVEGLKDEVERALKLKFNNEGIERNDKSIKVNGNTYRVDSDVVPAYRYRDYRGDYTFDANNYVGGIEIRPDSGGKIINFPEQHIKNGKRKNSETNHKYKKHVRIIKKIKSLMAESGYSIPSSISSFGLESLLWNIPNSVYEKYTLLRYVFDEIIKYLKNNFEHFEGYKEANGVKPLFASTTQQDDYKAFIRMLSEYYQYDITET

SEQ ID NO: 1684 - protein, 323 aa, Megamonas sp.
MKYTEKQISKMASPISQSENEKCKNAIRMVRDAMKKLNYTDDGKDIRSYMTESYSYALDLRQQYTGKKITLLVQGSYANKTNIPTESDVDVAVILESTFIAKYRAGATDSNYGFTDGTFSASELKDEVEKALKQHFGYQGVKRHDKCIKVIGNTYRVDADIVPAYRYRDYSNDYINDSNNYIGGIEIRPDSGGRIINYPEQHIKLGIAKNKVTKYNFKKCVRIIKSMREDMEENGYAVSSKISSFGLESLLWNVDVSAYTKYSNILRYTFDEVISFFKNDFWKFDDYTEANGIKPLFPDIATKSAYQKFINDLYDFYEYDIKE

SEQ ID NO: 1685 - protein, 323 aa, Peptostreptococcaceae bacterium
MKFTEKQINSMASPISQSEDEKCRNAIRMVRDAMKKLDYTDDGKEIRSYMADTYSYALDLRQRYTSKKITLLVQGSYANRTNITTESDVDVAVILESTFIPKYRNGVTGSDYGFSDGTFSVYELKNEVQDALNQHFRGQGVERHDKCIKVVGNTYRVDADVVPAYRYRDYSDDYRYDDGNYVGGIEIRPDSGGKIINYPEQHIRLGIAKNKVTKYNFKKCVRIIKSMRERMEENGYRVNSKVSSFGLESLLWNVDVSAYTKYSSILRYTFGEIVSFLKNDFVNFGTYVEINGIKSLFPDLVTQNAYQNFINDLYNFYEYDIQE

SEQ ID NO: 1686 - protein, 317 aa, Lachnospiraceae bacterium
MKYSEDDLEKFASPIGKTEEEKCKNAIRMVRDALKNIGYTDDGKEIRSLTEGTYAFALDMRSGSKNIVLLTQGSYANKTNIPKQSDVDVAVILESTFTTKYRTGITDKVYGFTDGTFSAKELKDEVENALKDYYSNGVERHDKSIKVYGNTYRVDADVVPAYRFRDYSADYENNVNNYEKAIEIRPDSGGRIINYPEQHIALGRAKNKATDYRYKRIVRIVKNIKEDMLDDGIYISDRISSFGIESLLWNVDVGVYNKYSSLRFILDEVLDFLNKDRCNFGNYVEANGIKPLFPDMDSKYAYESFVEKLGNYYEYEV

SEQ ID NO: 1687 - protein, 324 aa, Lactobacillus parabuchneri
MIFSESRLVYFSAPLSVTEDAKCKHAIQQVRDSLKNLGFVEDVNGITKSFEGASSYETRMENISSGEKIKVFIQGSYANNTNIKAESDVDIAVVRETPFHAEYRSVQPHPQTDATFNFIVAAPDTVTFKDRVESCLRASFPGQVGRHNKSIRVSGNTYRKDADTVPAMRYRNYKWNFSDDPEEYIGGIRIKPDQGETIVNYPEQHILEGRKKNVATNHSYKKQVRIMKSVCGEMVNAGYASAGKMSSFGLESLTWNVPDAEFTRYSSLGSTFETVIQYLFQNYQSLSLYKEANGIKPLCKNDSEVQEYRNFLQELLKYFNYTGE

SEQ ID NO: 1688 - protein, 324 aa, Lactobacillus parabuchneri
MIFSESRLVYFSAPLSVTEDAKCKHAIQQVRDSLKNLGFVEDVNGITKSFEGASSYETRMENISSGEKIKVFIQGSYANNTNIKAESDVDIAVVRETPFHAEYRSVQPHPQTDATFNFIVAAPDTVTFKDRVESCLRASFPGQVGRHNKSIRVSGNTYRKDADTVPSMRYRNYKWNFSDDPEEYIGGIRIKPDQGETIVNYPEQHILEGRKKNVATNHSYKKQVRIMKSVCGEMVNAGYTSAGKMSSFGLESLTWNVPDAEFTRYSSLGSTFETVIQYLFQNYQSLSLYKEANGIKPLCKNDSEVQEYRNFLQELLKYFNYTGE

SEQ ID NO: 1689 - protein, 324 aa, Lactobacillus sakei
MIFSESRLVYFSAPLSVTEDAKCKHAIQQVRDSLKNLGFVEDVNGITKSFEGASSYETRMENISSGEKIKVFIQGSYANNTNIKAESDVDIAVVRETPFHAEYRSVQPHPQTDATFNFIVAAPDTVTFKDRVESCLRASFPGQVGRHNKSIRVSGNTYRKDADTVPAMRYRNYKWNFSDDPEEYIRGIRIKPDQGETIVNYPEQHILEGRKKNVATNHSYKKQVRIMKSVCGEMVNAGYASAGKMSSFGLESLTWNVPDAEFTRYSSLGSTFETVIQYLFQNYQSLSLYKEANGIKPLCKNDSEVQEYRNFLQELLKYFNYTGE

SEQ ID NO: 1690 - protein, 327 aa, Lactobacillus plantarum
MIFSESRLVYFSAPLSVTEDVKCKHAIQQVRDSLKNLGFVEDINGITKSFEGASSYETRMENISSGEKIKVFIQGSYANNTNIKAESDVDVAVVRETPFHTEYRSVQPHPQTDDTFNFTVAAPDTATFKDRVESCLRASFPGQVERHNKSIKVSGNTYRKDADTVPAMRYRNYKWNFSDDPEEYIGGIRIKPDQGKTIVNYPEQHILEGRKKNVATNHSYKKQVRIMKNVCSEMVNTGYTSAGKMSSFGLESLTWNVPDAEFTRYNSLGSTFETIIQYLFQDYQRLSLYKEANGIKPLCKNDSEVQEYRIFLQDLLRFFNYTGELFE

SEQ ID NO: 1691 - protein, 252 aa, Lactobacillus sakei
MIFSESRLVYFSAPLSVTEDAKCKHAIQQVRDSLKNLGFVEDVNGITKSFEGASSYETRMENISSGEKIKVFIQGSYANNTNIKAESDVDIAVVRETPFHAEYRSVQPHPQTDATFNFIVAAPDTVTFKDRVESCLRASFPGQVGRHNKSIRVSGNTYRKDADTVPAMRYRNYKWNFSDDPEEYIRGIRIKPDQGETIVNYPEQHILEGRKKNVATNHSYKKQVRIMKSVCGKWLMLDTLLLGKCHPLDWNH

SEQ ID NO: 1692 - protein, 213 aa, Lactobacillus plantarum
MNFTEKKLKSFSMPLSDTEDQKCKHAIQEVRNSMANLGFEESSNGITRVFDNTSSYQTFMKNNESGEKIKIFLQGSYANNTNIKAESDVDVAIVREEIFNTLFRSEGIYPQNNETFGFYNVPQKPITFKDRVDTCLRASFHEQVIRHNKSIRVLGNSYRKNADTVPANRYRNYRGNYSNDPEDYVGGIIIKPDHGTSIINYPEQHIRMGSRKT

SEQ ID NO: 1693 - protein, 299 aa, Entomoplasmatales bacterium
MIKEEQLIEYSKETEFNQEINEKFEEIRKMLTEYRNSNFENLKTYLQGSSKNKTNIKNKSDIDILIRCDRYFESNLNNEADNKLILKKIDFNYSQNEKINHLINTKKEYTTFKNSLFKYLKDNKNFKVKVGSKTIKCRIKKANFKFDIVCAFGYRFYYSKREYIDGNYLQNKRNKKIISFGKYTYINQEIKNKRTNENYKKIIRVFKNISKRHLKKSNRLSSFEIESLLYNVNDEIYLTNNNFKECCIKIINELKDLLDNSWNNLVEPNELRAFKDIENISKKKVKKFIMKIQRKLTIN

SEQ ID NO: 1694 - protein, 300 aa, Entomoplasmatales bacterium
MNKLDQNVLERYAEGNENKQYIKDSYQNLKELLEKFKFHNKSIKVFLQGSYKNDTDINFDSDIDIVVYYEEMFNENVRHQNDNNEFHKETNLTPTDVDKFNQHFSNSEYTQQEYKQAIKTWIESNSNDYVVTNGDKTLKCKIKNSKYNFDIVCAIQYRLYTNFDNPDKFDYGNFLRGVEGERVINFPKQTYKNSMEKNKNTGKYKETVRIIKNIMKRNYDKNLWIPSFALESILYNVSDKSYNIDTKHERVKTVIEEALSLVNNNWSSLLEPNKILYVKNIKRVDQNKVLNILNLMNSML

SEQ ID NO: 1695 - protein, 374 aa, Paracoccus denitrificans
MPRNFDERLARLRTRRMDDQNTVLASRGFGESYEKRSANKATKYVLGAMQEVDPRSTQISHEEAQKVERNLKEGLEAEGLFPNFRLQGSVPLNVHIRGVSDVDLLVIEGCYLRYESCEGSRKSYLPYTGRGQLVDDVLFLRSKSEEILERRFWGATVDKSPAKSIQLSDGAFRRKVDVVPSNWLDTVNYQRTLVDAHRGIQIVNKYTREHISNYPFVYIAEITSKARQTNEGARMGIRLAKNVKNDAEAEIALSSYDIGSLIYHCPNHYVTHLVARDLMILSGVERWFDELSRDRVRATSLMTPDGTRRILDGTAKWEGLLKLSSELTDLAQAVERELASPYDYAPPDRDTLRKRLNDNAIPLAPELIVGGVRF

SEQ ID NO: 1696 - protein, 358 aa, Paracoccus denitrificans
MDDQNTVLASRGFGESYEKRSANKATKYVLGAMQEVDPRSTQISHEEAQKVERNLKEGLEAEGLFPNFRLQGSVPLNVHIRGVSDVDLLVIEGCYLRYESCEGSRKSYLPYTGRGQLVDDVLFLRSKSEEILERRFWGATVDKSPAKSIQLSDGAFRRKVDVVPSNWLDTVNYQRTLVDAHRGIQIVNKYTREHISNYPFVYIAEITSKARQTNEGARMGIRLAKNVKNDAEAEIALSSYDIGSLIYHCPNHYVTHLVARDLMILSGVERWFDELSRDRVRATSLMTPDGTRRILDGTAKWEGLLKLSSELTDLAQAVERELASPYDYAPPDRDTLRKRLNDNAIPLAPELIVGGVRF

SEQ ID NO: 1697 - protein, 361 aa, Rhodobacterales bacterium
MRRIDDQNIVLNSQGFGEAYEKRTTSKATKYALGAMQEVDPRSTQISHEEAEKVERNLKEGLSSEGKYPAFRLQGSVPLNVHIRGVSDVDLLVIEGVCLRRQYCEGSLKSYLPYSGVGTVADDVLLLRAKSEEVLERRFWGAKVDKTPAKSIQLSDGAFRRKIDVVPSNWLDTANYQQTLEEAQRGVEIVNKYTREHITNYPFLYIAEITVKAHQTNDGARMGIRLAKNVKNDAEMEIALSSYDIGSLIYHCPNHYITHLVARDLMILSGVERWLDELSRDYSRATSLMTPDGTRRILDEAVKWEGLVKLSGELTSLAQAVERELASPYDITLPDRDTLRKRLNDNAIPLSPEIVGGGFKF

SEQ ID NO: 1698 - protein, 370 aa, Sulfitobacter pseudonitzschiae
MPRDFDERLSRLRSRRMDDNNTVLMSAGHGEAYEKRTANKATKYALGSMQEVDPRSTQISHEEAEKVERNLSEGLRDEHLYPEFKLQGSVPLNVHIRGASDVDLLVMEGRCLRVSPCVSSLKSYVDFSGNVKDTVLDLRRKSEIVLDRRFWGATVDKTPAKSIALSDGGFRRKVDVVPANWLDSADYQRSLDEASRGVEIVNKYTLEHIENYPFRYIAEIEAKAGLTNDGARMGIRLAKNLKNDSDADIELSSYDIGSLIYHCPSHYITHQVARDLMVLSGVERWLDELSKDRSTAIALMTPDKTRRILDEDAKWTGLLRLASDVTDLAKAVEKELVGPYYFDHSDRETIRKHLNENAIPLAPEFVGSRF

SEQ ID NO: 1699 - protein, 367 aa, Loktanella hongkongensis
MEYSIEDRLKRLKSRRMDASNVPLVNRGFVEEYDRRTNNQATRYALGAMQEVDFRSTEISIEEAQKVENALTERLLKHGYRPRFRLQGSVPMNTHIRGASDVDLLEIHGETITFAGSGPSACNYVVSTRPGTIADEVLAMRTASEEELTTHFWGAKVDRSNAKSIQLSEGGFRRKVDVVPSHWFDSVDYQRYQNEIFRGVGVINKDTKERHHNYPFLFRHHIDKKGKDTYGGAKMAIRLLKSLSADSKKDLTISSYDIASVVFHCPSNSIMRHVARDLAILSGISAFLNQLAVNRSQAEALMSPDGTRKIFDKSKKWNSFLTLVANTFQLAREVERELVGPSFLLDRDFSQVLKSLNESKIPIVPNH

SEQ ID NO: 1700 - protein, 366 aa, Donghicola sp.
MYNIDERISRLKSRRNDGWNEALLSRGYYENFESRTNQKATKYALGAMQEVNKRSTEISIEEFEKVRDGLKSCLPGRGFNPDFRLQGSVACNIHIKGVSDVDMLEVNGDLFTYSTGGARGNLYTPSQATASPASEVLKMRSITESELEKRYYAATIDKSNAKSIQLSGGSFRRKVDVVPSHWHDGEDYQLFREEKYRGIVIVNKKNLESIKNYPFLFADRINKKGSETADGSKMATRLLKSIKSDSEYENQLSSYDIASLMYSCPSDQIRSFEARDLSVFAGAEQWLDYLMKNKLIAMDLDTPDGTRKILDSEKKWEGLIVLAIETSALANEVFKETVGPYYWGDTGVSSVRKSLEEARVPLVPAY

SEQ ID NO: 1701 - protein, 378 aa, Burkholderia pseudomallei
MGMSYQDRLAKMRQRRRPSISTGTFVGKYEARADSALAMDSADVKEAYENKGNGDATRYALGAMEAVDGKYTSVSLGEADRVAKQIKDKLPIHMPVTTRLQGSLALDIHIRASSDVDILVLAEWFLTHDSPAAPSTSYTSLPGKTTIGELFALRQQCETILTGAYPAATVDISGAKSIALEGGSLARKVDVVPAHWHDTSDYQSTGLEAYRDVFIFNKDEFVRQSNRPFMHILLVNHRDTESGGGAKRAIRMLKCLIRDSDRDFALSSYDVASLIYHMTKDELTVPWYMPLQLLNRVENFLVRLETNLGYARQLWTPDGTRKILNESKKEVDVGALRTELTALIEAVGTDYISYLPFYQDKTIALDAARGALNEAVIQ

SEQ ID NO: 1702 - protein, 367 aa, Burkholderia pseudomallei
MRQRRRPSISTGTFVGKYEARADSALAMDSADVKEAYENKGNGDATRYALGAMEAVDGKYTSVSLGEADRVAKQIKDKLPIHMPVTTRLQGSLALDIHIRASSDVDILVLAEWFLTHDSPAAPSTSYTSLPGKTTIGELFALRQQCETILTGAYPAATVDISGAKSIALEGGSLARKVDVVPAHWHDTSDYQSTGLEAYRDVFIFNKDEFVRQSNRPFMHILLVNHRDTESGGGAKRAIRMLKCLIRDSDRDFALSSYDVASLIYHMTKDELTVPWYMPLQLLNRVENFLVRLETNLGYARQLWTPDGTRKILNESKKEVDVGALRTELTALIEAVGTDYISYLPFYQDKTIALDAARGALNEAVIQ

SEQ ID NO: 1703 - protein, 340 aa, Unknown
  Description of Unknown: pseudomallei group sequence
MDSADVKEAYENKGNGDATRYALGAMEAVDGKYTSVSLGEADRVAKQIKDKLPIHMPVTTRLQGSLALDIHIRASSDVDILVLAEWFLTHDSPAAPSTSYTSLPGKTTIGELFALRQQCETILTGAYPAATVDISGAKSIALEGGSLARKVDVVPAHWHDTSDYQSTGLEAYRDVFIFNKDEFVRQSNRPFMHILLVNHRDTESGGGAKRAIRMLKCLIRDSDRDFALSSYDVASLIYHMTKDELTVPWYMPLQLLNRVENFLVRLETNLGYARQLWTPDGTRKILNESKKEVDVGALRTELTALIEAVGTDYISYLPFYQDKTIALDAARGALNEAVIQ

SEQ ID NO: 1704 - protein, 340 aa, Burkholderia pseudomallei
MDSADVKEAYENKGNGDATRYALGAMEAVDGKYTSVSLGEADRVAKQIKDKLPLHMPVTTRLQGSLALDIHIRASSDVDILVLAEWFLTHDSPAAPSTSYTSLPGKTTIGELFALRQQCETILTGAYPAATVDISGAKSIALEGGSLARKVDVVPAHWHDTSDYQSTGLEAYRDVFIFNKDEFVRQSNRPFMHILLVNHRDTESGGGAKRAIRMLKCLIRDSDRDFALSSYDVASLIYHMTKDELTVPWYMPLQLLNRVENFLVRLETNLGYARQLWTPDGTRKILNESKKEVDVGALRTELTALIEAVGTDYISYLPFYQDKTIALDAARGALNEAVIQ

SEQ ID NO: 1705 - protein, 315 aa, Burkholderia pseudomallei
MEAVDGKYTSVSLGEADRVAKQIKDKLPIHMPVTTRLQGSLALDIHIRASSDVDILVLAEWFLTHDSPAAPSTSYTSLPGKTTIGELFALRQQCETILTGAYPAATVDISGAKSIALEGGSLARKVDVVPAHWHDTSDYQSTGLEAYRDVFIFNKDEFVRQSNRPFMHILLVNHRDTESGGGAKRAIRMLKCLIRDSDRDFALSSYDVASLIYHMTKDELTVPWYMPLQLLNRVENFLVRLETNLGYARQLWTPDGTRKILNESKKEVDVGALRTELTALIEAVGTDYISYLPFYQDKTIALDAARGALNEAVIQ

SEQ ID NO: 1706 - protein, 315 aa, Burkholderia pseudomallei
MEAVDGKYTSVSLGEADRVAKQIKDKLPLHMPVTTRLQGSLALDIHIRASSDVDILVLAEWFLTHDSPAAPSTSYTSLPGKTTIGELFALRQQCETILTGAYPAATVDISGAKSIALEGGSLARKVDVVPAHWHDTSDYQSTGLEAYRDVFIFNKDEFVRQSNRPFMHILLVNHRDTESGGGAKRAIRMLKCLIRDSDRDFALSSYDVASLIYHMTKDELTVPWYMPLQLLNRVENFLVRLETNLGYARQLWTPDGTRKILNESKKEVDVGALRTELTALIEAVGTDYISYLPFYQDKTIALDAARGALNEAVIQ

SEQ ID NO: 1707 - protein, 315 aa, Burkholderia glumae
MEAVDAKYTSVSLGEGDRVAKQIKDKLPIDMPVTTRLQGSLALDIHIRASSDVDILVLAEWFLTHDSPAAPSKSYTALSGKTTIGELFALRQQCETILTAAYPAATVNIGGAKSIALEGGSLARKVDVVPAHWHDTGDYQSTGLEAYRDVFIFNKDEFARQSNRPFMHMLLVNHRDTESGGGAKRAIRMLKCLIRDSDRDFALSSYDVASLIYHMTKNELTVPWYMPLQLLNRIENFLFRLETNLGYARQLKTPDGTRKIINESKKEVDVGALRAELTALIEAVGTDYISYLPFYQDKTLALDAARGALNEAVIQ

SEQ ID NO: 1708 - protein, 340 aa, Burkholderia glumae
MDSADVKEAYESKGNGDATRYALGAMEAVDAKYTSVSLGEGDRVAKQIKDKLPIDMPVTTRLQGSLALDIHIRASSDVDILVLAEWFLTHDSPAAPSKSYTALSGKTTIGELFALRQQCETILTAAYPAATVNIGGAKSIALEGGSLARKVDVVPAHWHDTGDYQSTGLEAYRDVFIFNKDEFARQSNRPFMHMLLVNHRDTESGGGAKRAIRMLKCLIRDSDRDFALSSYDVASLIYHMTKNELTVPWYMPLQLLNRIENFLFRLETNLGYARQLKTPDGTRKIINESKKEVDVGALRAELTALIEAVGTDYISYLPFYQDKTLALDAARGALNEAVIQ

SEQ ID NO: 1709 - protein, 315 aa, Burkholderia sp.
MEAVDAKYTSVSLGDGDRVAKQIKDKLPSVMPVTTRLQGSLALDIHIRASSDVDILVLAEWFLTHDTPVAPSKSYTPLPGTTATAELFALRQQCEAILTGAYPAATVDVSKAKSIALEGGSLARKVDVVPAHWHDASDYQTTGLEALRDVYILNKDEFATQYNRPFMHMLLINHRDKESGGGAKRAIRLLKCLIRDSDREFALSSYDVASLIYHMTKEELTVPWYLPLQLLNRVESFLIRLETNPAYARQLKTPDGTRKILNEAKKEADVGALRAELTALIEAVGTDYITYLPFYQDKTLALDAARGALNEAVIQ

SEQ ID NO: 1710 - protein, 285 aa, Burkholderia pseudomallei
MPVTTRLQGSLALDIHIRASSDVDILVLAEWFLTHDAPTAPSKSYTSIPGTTTIGELYSLRQQCELILPVAYPAATVDINKAKSITLEGGSLARKVDVVPAHWHDTSDYQTTGYEAFRDVYIFNKEEFVRQSNRPFMHMSLINYRDGESGGGAKRAIRLLKCLIRDANRDYTLSSFDVASLIYHMTKEELTVPWYLPLQLLNRVERFLIRLETNAGLARQLETPDGTRKILNESTKEVDLGALRAELTTLIEAVGTDYITYLPFYQDKALALDAARGALNEAVIQ

SEQ ID NO: 1711 - protein, 343 aa, Burkholderia ubonensis
MTFDSARSDSLVESFEVQGKGVATKYALGCMAEVPPEYTAISLRDGQRISDQLTSQSTLKVSTKLQGSVPLNIHIYTSSDVDLLVFADWFISVDNPVLVPTKYDFNPSISPVNELSRLRKFCEEYLDARYPAAEVDITGAKSIAVSGGSLARKVDVVPAHWIDSVEYQNTSFDHTRDVAILNKHERTTLRNRPFMHMASIEAKDRTSSGYAKRAIRLLKCLSRDADMEIKLSSYDIAGLIYHMSDAELIGQQYFPLLLLDRVEAYLRRLEANPHVAFSLNTPDGTRKVLDSAEKFTSLIQLRRELTDAIDNIATEYNTALAFTVDRSKAAELARKTLRETAIY

SEQ ID NO: 1712 - protein, 371 aa, Burkholderia ubonensis
MSTKYSQKLEKLRQRRKPTDLAKSLTASMTFDSARSDSLVESFEVQGKGVATKYALGCMAEVPPEYTAISLRDGQRISDQLTSQSTLKVSTKLQGSVPLNIHIYTSSDVDLLVFADWFISVDNPVLVPTKYDFNPSISPVNELSRLRKFCEEYLDARYPAAEVDITGAKSIAVSGGSLARKVDVVPAHWIDSVEYQNTSFDHTRDVAILNKHERTTLRNRPFMHMASIEAKDRTSSGYAKRAIRLLKCLSRDADMEIKLSSYDIAGLIYHMSDAELIGQQYFPLLLLDRVEAYLRRLEANPHVAFSLNTPDGTRKVLDSAEKFTSLIQLRRELTDAIDNIATEYNTALAFTVDRSKAAELARKTLRETAIY

SEQ ID NO: 1713 - protein, 371 aa, Burkholderia ubonensis
MSTKYSQKLEKLRQRRKPTDLAKSLTASMTFDSARSDSLVESFEVQGKGVATKYALGCMAEVPPEYTAISLRDGQRISDQLTSQSTLKVSTKLQGSVPLNIHIYTSSDVDLLVFADWFISVDNPVLVPTKYDFNPSISPVNELSRLRKFCEEYLDARYPAAEVDITGAKSIAVSGGSLARKVDVVPAHWIDSVEYQNTSFDHTRDVAILNKHERTTLRNRPFMHMASIEAKDRTSSGYAKRAIRLLKCLSRDADMKIKLSSYDIAGLIYHMSDAELIGQQYFPLLLLDRVEAYLRRLEANPHVAFSLNTPDGTRKVLDSAEKFTSLIQLRRELTDAIDNIATEYNTALAFTVDRSKAAELARKTLRETAIY

SEQ ID NO: 1714 - protein, 371 aa, Paraburkholderia aspalathi
MASNYTQKLEKLRQRRAPTNLTKSLTAGLTFDSAEARHTVESFESKGKGDATRYALGCMAEVPPEYTEISIRDGQRISDQLTKQTEYGVLTRLQGSVPLNIHIYASSDVDLLVLADWFVTVDIPVVPPNTYNFRPGLSPVSELGKLRSFCERYLTSKYPVADVDVSGAKSIAVSGGSLARKVDVVPAHWVDTSDYQRTKNQTYRDVCILNKTDGSTMSNRPFLHMALIELKDSASDGYAKRAIRLLKCLSRDSDVEIKLSSYDIAGLVYHMSNDQLKVNQYLPLQLLNRVEEYLRYLEANPFYAASLKAPDDTRTLLDSADKVRSLSALRQELTDAIDNVAAEYNTELAYIFDRARAAEAARKTLKETVIF

SEQ ID NO: 1715 - protein, 371 aa, Burkholderia sp.
MASNYTEKLEKLRQRRAPTNLAKSLTAGLTFDSAETRPTVESFESKGKGDATRYALGCMSEVPPEYTEISIRDGQRISDQLTKQTEYGVFTQLQGSVPLNIHIYASSDVDLLVLADWFITVDSPVVPPNTYYFRPDLSPVMELGKLRSFCERYLTSKYPAADVDISGAKSIAVSGGSLARKVDVVPAHWVDTVDYQRTKNQTHRDVCILNKIDKSMLSNRPFLHMALIEFKDSASDGYAKRAIRLLKCLSRDSDADIKLSSYDIASLVYHMSDDQLKVNQYMPLQLLDRVEEYLRFLEANPFYAAALRAPDGTRAVFDSAEKIRSLSALRQELTDAIDNVAAEYNGELAYIFDRARAAQAARKTLRETVIF

SEQ ID NO: 1716 - protein, 372 aa, Paraburkholderia xenovorans
MNTKYTNKLDKLRARRTPRTKSASLSAGIAMDSADLRPALESFEEKGKGDATRYALGCMAEVPPQYTAISLRDGNRIADQLTGQSEFKVITRLQGSVPLNIHIYASSDVDLLVLADWFVNVKLPVVPPSTYDFANGPASSFDELVKLRSFCERFLPTKYPAADVDTSGAKSIAVSGGSLARKVDVVPSYWVDTVEYQQSKLEIHRDVAILDKVKKETVVNRPFMHMGLIDVKDTSSNGHAKRAIRLLKCLSRDADVDIALSSFDIAGLIYHMPNAELSVNPFFPLQLLDRVDLYLRRLESNYQYATSLQTPDGTRAVLDSSEKFFAVAMLRQELTEAIDNVAGEYNDTLPFIFDRSRALEAARKTLNETLIY

SEQ ID NO: 1717 - protein, 342 aa, Paraburkholderia xenovorans
MDSADLRPALESFEEKGKGDATRYALGCMAEVPPQYTAISLRDGNRIADQLTGQSEFKVITRLQGSVPLNIHIYASSDVDLLVLADWFVNVKLPVVPPSTYDFANGPASSFDELVKLRSFCERFLPTKYPAADVDTSGAKSIAVSGGSLARKVDVVPSYWVDTVEYQQSKLEIHRDVAILDKVKKETVVNRPFMHMGLIDVKDTSSNGHAKRAIRLLKCLSRDADVDIALSSFDIAGLIYHMPNAELSVNPFFPLQLLDRVDLYLRRLESNYQYATSLQTPDGTRAVLDSSEKFFAVAMLRQELTEAIDNVAGEYNDTLPFIFDRSRALEAARKTLNETLIY

SEQ ID NO: 1718 - protein, 265 aa, Providencia stuartii
MINFENRLANLKNRRQGTAERDRLEKGMYSYYGDLRPTEAYEKLHENAAIKYVIGSMAAVSQESTKVSKDEGERVASTLIDMLKTSGINAEAKMQGSVALDIHIEGHSDVDMLILKSDVITVQGPALPGTYYSDSSDTRPMVDIVRELRLQAEAKLKSRYHAAEVNISGAKSIALSGGSLRRKVDIVPSSWHDTHDYQRSKLEHFRAVKIYDKDNHVLIENKPFLHIKKVNDRDTQYGGNLKKVTRLMKNIIADMPDYKKSKAKN

SEQ ID NO: 1719 - protein, 370 aa, Providencia stuartii
MINFENRLANLKNRRQGTAERDRLEKGMYSYYGDLRPTEAYEKLHENAAIKYVIGSMAAVSQESTKVSKDEGERVASTLIDMLKTSGINAEAKMQGSVALDIHIEGHSDVDMLILKSDVITVQGPALPGTYYSDSSDTRPMVDIVRELRLQAEAKLKSRYHAAEVNISGAKSIALSGGSLRRKVDIVPSSWHDTHDYQRSKLEHFRAVKIYDKDNHVLIENKPFLHIKKVNDRDTQYGGNLKKVTRLMKNIIADMPDYKKSKAKKLTSYDIAAIAYSMNERLSCSQYLPLTLLDNLRSYLLIISHLDDERNALIVPDESRKIFNAEEKVEALRILYNEVNDLAEAVQKAINPLKEKYDGDVLRNRQVVFF

SEQ ID NO: 1720 - protein, 370 aa, Vibrio ordalii
MINFENRLANLKNRRQGTAERDRLEKGMYSHYGDLRPTEAHEKLHENAAIKYVIGSMAAVSQESTKVSKDEGERVASTLIDMLKTSGINAEAKMQGSVTLDIHIEGHSDVDMLILKSDVITVQGPALPGTYYSDSSDTRPMVDIVRELRLQAEAKLKSRYHAAEVNTSGAKSIALSGGSLRRKVDIVPSSWHDTHDYQRSKLEHFRAVKIYDKDNHALIENKPFLHIKKVNDRDTQYGGNLKKVTRLMKNIIADMPDYKKSKAKKLTSYDIAAIAYSMNERLSCSQYLPLTLLDNLRSYLLIISYLDDERNALIVPDESRKIFNAEEKVEALRILYNEVNDLAEAVQKAINPLKDKYDGDVLRNRQVVFF

SEQ ID NO: 1721 - protein, 370 aa, Shewanella xiamenensis
MINFENRLANLKNRRQGTAERDRLEKGMYSYYGDLRPTEAHEKLHENAAIKYVIGSMAAVSQESTKVSKDEGERVASTLIDMLKTSGINAEAKMQGSVTLDIHIEGHSDVDMLILKSDVITVQGPALPGTYYSDSSDIRPMVDIVRELRLQAEAKLKSRYHAAEVNTSGAKSIALSGGSLRRKVDIVPSSWHDTHDYQRSKLEHFRAVKIYDKDNHALIENKPFLHIKKVNDRDTQYGGNLKKVTRLMKNIIADKPDYKKSKAKKLTSYDIAAIAYSMNERLSCSQYLPLTLLDNLRSYLLIISYLDDERNALIVPDESRKIFNNEEKVDALRILYNEVNELAEAVQKAINPFQDKYDGDVLKNRQVVFF

SEQ ID NO: 1722 - protein, 370 aa, Vibrio cholerae
MINFENRLANLKNRRQGTAERDRLEKGMYSYYGDLRPIEAHEKLHENAAIKYVIGSMAAVSQESTKVSKDEGERVASTLIDMLKTSGINAEAKMQGSVALDIHIEGHSDVDMLILKSDVITVQGPALPGTYYSDSSDTRPMVDIVRELRLQAEAKLKSRYHAAEVNTSGAKSIALSGGSLRRKVDIVPSSWHDTHDYQRSKLEHFRAVKIYDKDNHALIENKPFLHIKKVNDRDTQYGGNLKKVTRLMKNIIADMPDYKKSKAKKLTSYDIAAIAYSMNERLSCSQYLPLTLLDNLRSYLLIISYLDDERNALIVPDESRKIFNAEEKVEALRILYNEVNDLAEAVQKAINPLKDKYDGDVLRNRQVVFF

SEQ ID NO: 1723 - protein, 370 aa, Providencia stuartii
MINFENRLANLKNRRQGTAERDRLEKGMYSYYGDLRPTEAHEKLHENAAIKYVIGSMAAVSQESTKVSKDEGERVASTLIDMLKTSGINTEARMQGSVALDIHIEGHSDVDMLILKSDVITVQRPALPGTYYSDSSDTRPMVDIVRELRLQAEAKLKSRYHAAEVNTSGAKSIALSGGSLRRKVDIVPSSWHDTHEYQRSKLEHFRAVKIYDKDNHALIENKPFLHIKKVNDRDTQYGGNLKKVTRLMKNIIADMPDYKKSKAKKLTSYDIAAIAYSMNERLSCSQYLPLTLLDNLRSYLLIISYLDDERNALIVPDESRKIFNAEEKVEALRILYNEVNDLAEAVQKAINPLKDKYDGDVLRNRQVVFF

SEQ ID NO: 1724 - protein, 370 aa, Vibrio cholerae
MINFENRLANLKNRRQGTAERDRLEKGMYSYYGDLRPTEAHEKLHENAAIKYVIGSMAAVSQESTKVSKDEGERVASTLIDMLKTSGINAEARMQGSVALDIHIEGHSDVDMLILKSDVITVQGPALPGTYYSDSSDTRPMVDIVRELRLQSEAKLKSRYHAAEVNTSGAKSIALSGGSLRRKVDIVPSSWHDTHDYQRSKLAHFRAVKIYDKDNHDLIENKPFLHIKKVNDRDTQYSGNLKKVTRLMKNIIADMPDYKKSKAKKLTSYDIAAIAYSMNERLSCSQYLPLTLLDNLRSYLLIISYLDDERNALIVPDESRKIFNAEEKVEALRILYNEVNDLAEAVQKAINPLKDKYDGNVLRNRQVVFF

SEQ ID NO: 1725 - protein, 370 aa, Vibrio cholerae
MINFESRLANLKNRRQGTAERDRLEKGMYSYYGDLRPAEAHEKLHENAAIKYVIGSMAAVSQESTKVSKDEGERVASTLIDMLKTSGINAEARMQGSVALDIHIEGHSDVDMLILKSDVITVQGPALPGTYYSDSSDTRPMVDIVRELRLQSEAKLKSRYHAAEVNTSGAKSIALSGGSLRRKVDIVPSSWHDTHDYQRSKLAHFRAVKIYDKDNHDLIENKPFLHIKKVNDRDTQYSGNLKKVTRLMKNIIADMPDYKKSKAKKLTSYDIAAIAYSMNERLSCSQYLPLTLLDNLRSYLLIISYLDDERNALIVPDESRKIFNAEEKVEALRILYNEVNDLAEAVQKAINPLKDKYDGNVLRNRQVVFF

SEQ ID NO: 1726 - protein, 370 aa, Vibrio cholerae
MINFESRLANLKNRRQGTAERDRLEKGMYSYYGDLRPAEAHEKLHENAAIKYVIGSMAAVSQESTKVSKDEGERVASTLIDMLKTSGINAEARMQGSVALDIHIEGHSDVDMLILKSDVITVQGPALPGTYYSDSSDTRPMVDIVRELRLQSEAKLKSRYHAAEVNTSGAKSIALSGGSLRRKVDIVPSSWHDTHDYQRSKLAHFRAVKIYDKDNHDLIENKPFLHIKKVNDRDTQYSGNLKKVTRLMKNIIADMPDYKKSKAKKLTSYDIAAIAYSMNESLYCSQYLPLTLLENLRSYLLIISYIDERRNSLIVPDESRKIFNAEEKVEALRILYNEVNDLAEAVQKAINPLKEKYDGDVLRNRQVVFF

SEQ ID NO: 1727 - protein, 370 aa, Serratia oryzae
MINFENRLANLKNRRQGTAERDRLEKGMYSYYGDLRLTEAHEKLHENAAIKYVVGSMAAVSSESTKVSKDEGERVASTLLDMLRTSGIYAEAKMQGSVALDIHIEGHSDVDMLILKSDIITIQGPALPGTDYSEPSDTRPMVDIVKELRLQSEAKLKSRYHAAEVNTRGAKSIALSGGSLKRKVDIVPSSWHDTHDYQRTKLEHFRAVKIYDKDNHALIENKPFLHIKKVNDRDAQYSGNLKKVTRLMKNIIADMPDYKKSKAKKLTSYDIAAIAYSMNESLYCSQYLPLTLLENLRSYLLIISYIDDRRDSLIVPDESRKIFNTEEKVEALRILYNEVNDLAEAVQKAINPLKEKYDGDVLRNRQVVFF

SEQ ID NO: 1728 - protein, 370 aa, Pseudomonas peli
MINFENRLASLKNRRQGTAERDRIEKGLYSFAGDQRPTEAHEKLRENAAIKYVIGAMAAVSSESTRISKDEGERVASTLIDLLKTSGISAEMRMQGSVALDIHIEGHSDVDMLILKADIITIQRPALPGTNYVDASDTRPIVEIVSELRKQSEEKLKSRYYAAEVNISGSKSIALSGGSLKRKVDIVPSIWHDTHDYQRTKLDHFRVVQIYDKENHTLIDNKPLLHIKKINERDALYTGNLKKTVRLMKNIIADMPDYKKNKAKKLTSYDIAGIAFAMNEKLNCSQYFPLVLLENLRSFLLVLTYLEEPRNSLMAPDESRKIFNTDEKTDALRILYEEVNSLAIAVQTAISPYQEKYDGELLKRKQVIFF

SEQ ID NO: 1729 - protein, 370 aa, Enterobacter cancerogenus
MIDFEKRLSRLKNRRQGTAELDRLEKGYFNLSGDFRSTEDYEKLNENAAIKYVIGAMAAVSAESTRVSKDEGVRVATTLVDMLRTSGINTEMRLQGSVALNIHIEGHSDVDMLILKTDVITVEGPELPGTNYVDASDKRLMVDIIRELRLLAEEKLTSRYYAADVNINGSKSIALNGGSLRRKVDIVPACWHDTHDYQRNKIESLRAVKIYDKSNNVLIENKPFLHIEKVNVRDSLYFGNLKKVVRLMKNVIADMPEYKKTKAKALTSFDIAAIAYAMNESLYCSQFSPLTLLENLRVFLLLISYIDERRENLLVPDESRVIFNTEDKLEAVRILYAEVSDLAESVQKAINPYKDKYDGDLLKNKQVLFF

SEQ ID NO: 1730 - protein, 369 aa, Providencia alcalifaciens
MINFAERLKKMKNRRQGTAEINRLLEGLESFGVDIRGIEDYERLDENEAIRYVIGAMAPVSPESTQTSISEGERVADTLIRLLKAVGIDTERRMQGSVALDIHIEGHSDVDMLIIKHGLVTYHSPALNGAAYTPSPETRTMEEIVQEIRLESENKLSSRYHAANVDCTGNKSISISGGSLKRKVDIVPSSWLDTHEYQNTRKEYHRVIRIYDKKTHTLLENKPFLHIKNVNDKDTINSGNLKKVVRLMKNIIADMPDYKKSKAKKLSSYDLTGIAYSMDRELVCPNYLPLLLLENLRSYLAQLQSSFTLRDSLYVPDETRKIFNDDSKIEALNILSNEVNELAISVVKSLQPHSSIYSVNVLKNKPIYI

SEQ ID NO: 1731 - protein, 369 aa, Vibrio parahaemolyticus
MINFSNRLTKLKDRRQGTAERNRLEKGFTAIGADIRTSESYESLKENDAIRYVVGSMAPVSPESTRISVEEGERVANTLIELLNTEGISTTKRMQGSVALDIHIEGHSDVDMLILKEDIITYETPAIDSSMYSPASDPRSMVDMVKEIRIESERKLTSRYYAANVDCSGSKSIALSGGSLRRKVDIVPSSWYDTLDYQRTRQESDRTVRIYHKDNHQLLDNKPFLHIKNVNDRDAQYNGNLKKAVRLMKNLVADMPDYKKSKAKKLSSYDLTGIAYAMDKSLDCNPYLPLALLENLRSYLLILLASEVLRDLLEVPDKTRKIFNEESKVEALSILAVEVNELALEVQKSLRPLATTYDSSVLNNKVVVW

SEQ ID NO: 1732 - protein, 370 aa, Vibrio campbellii
MINFDNRLKSLKDRRQGTRERVLLENSLSQFDSRDLRTQESYERLSESAAIKYAIGAMAAVDSDSTRISIQEGERVADTLISMLGNAGIRATKEIQGSVALDIHIQGHSDVDMLILKEDIVLVQTPKLDGSSCVASDQRPMKDIIRELRLTSEQKLTSRYYEATVDCSGNKSIALSGGSLKRKVDIVPACWYHTHDYQRSGLKHDKEVQIYHKANHDLVGNKPFMHIKKVNDKDSIYSGNLKKVTRLMKNLVADMPDYKKGKAKKLSSYDLTALAYDMDGQLSCPSYMSLALVERLRAHLSLLVSSETLRDLILVPDGSRKVFNEESKLEALQIISNEVDDLAKAIYKSIAPLSHMVYDSSALNHRHVYI

SEQ ID NO: 1733 - protein, 370 aa, Vibrio vulnificus
MINFDNRLKSLKDRRQGTRERVLLENSLSQYDPRDLRTQESYERLSESAAIKYTVGAMAAVDSDSTRISIQEGDRVADTLISMLGNAGIRATKEIQGSVALDIHIQGHSDVDMLILKEDIVLVQTPKLDGSSCAASDQRPMKDIIRELRLTSEQKLTSRYYEATVDCSGNKSIALSGGSLKRKVDIVPACWYHTHDYQRSGLKHDKEVQIYHKANHELVGNKPFMHIKKVNDKDSIYSGNLKKVTRLMKNLVADMPDYKKRKAKKLSSYDLTALAYDMDGQLSCPPYMSLALVERLRAHLSLLVSSETLRDRILVPDGSRKVFNEESKLEALQIISNEVDDLAKAIYKSIAPSSHMVYDSAALNHRYVYL

SEQ ID NO: 1734 - protein, 370 aa, Edwardsiella tarda
MISFENRLKSLKDRRQGTKERVLFENNMSIHAAIDLRGQESYELLAENAAIKYTIGAMAEVDPVSTRVSIDEGERVANTLIGLLNTVGILATKEIQGSVALNIHIEGHSDVDMLILKDDIVLVQMPRVSGVSSTPDDRRPMVDIIRELRLQSEAKLTSRYHQATVDCNGNKSIALSGGSLKRKVDIVPACWYHTHAYQQSRQKHDQEVKIYHKAEHVLYGNHPFLHIKKVNDKDSMYTGNLKRVVRLMKNVVADMPDYKKRVVKKLSSYDLTAIGYEMNEQLRCPTYMSLALVERLRAHLALLVSSKVLRDRLIVPDGSRNVFDSEEKVDALNILYNEISDLAVSIYRSLQPFSYLPYDSSTLTQKHVYL

SEQ ID NO: 1735 - protein, 368 aa, Vibrio cholerae
MIDFNKRLTKLKDRRQGTRERILLENSRSVFDSADLRQREDYEALNESSGIKYAIGAMAPVSAESTRVSIREGERVANTLIRMLNTDDIPATSEIQGSVALDIHIEGHSDVDMLILHDRTVLVEDAKNCSSFIPSSDPRPMVDIIKELRLKSEQKLTTRYPEATVDCSGSKSIAMEGGSLQRKVDIVPSCWLDTKDYQRSGLKHDRAVKIYHKAEHCLVGNKPFLHMKKVNDRDQHYSGNLKRVIRLMKNIVADMPDDKKRKAKKLSSYDLTAIGYNFCDDLRAPSYQTLSLVEKTRSNLALLVSSEILRGAAMVPDGSRKVFDNEDKVEALKVLSAEVEALARAIHKDMRPLDFAYDSKALTEKYIF

SEQ ID NO: 1736 - protein, 368 aa, Vibrio metoecus
MIDFNKRLTKLKDRRQGTRERILLENSRSVFDSADLRQREDYEALNESSGIKYAIGAMAPVSAESTRVSIREGERVANTLIRMLNTDDIPATSEIQGSVALDIHIEGHSDVDMLILHDRTVLVEDAKNCSSFIPSSDPRPMVDIIKELRLKSEQKLTTRYPEATVDCSGSKSIAMEGGSLQRKVDIVPSCWLDTKDYQRSGLKHDRAVKIYNKADHCLVGNKPFLHMKKVNDRDQHYSGNLKRVIRLMKNIVADMPDDKKRKAKKLSSYDLTAIGYNFCDDLRAPSYQTLSLVEKTRSNLALLVSSEILRGAAMVPDGSRKVFDNEDKVEALKVLSAEVEALARAIHKDMRPLDFAYDSKALTEKYIF

SEQ ID NO: 1737 - protein, 369 aa, Vibrio parahaemolyticus
MIDFNTRLKKLKDRRQGTRELHLAESGYNSWDSRDYRIQEKYEKLQESAGVRYAIGAMAAVSEQSTKVSISEGNRVADTLIDLLKNAGIRTVKRMQGSVALDIHIEGHSDVDMLILHDEIVLVETPKIDGTPCYPPEDKRPMVDIIADLRALSEEKLTTRYWQANVDCTNGKSISLEGGSLKRKVDIVPSCWYLTQDYQRSNQEKDAGVKIFNKKEHVLIGNYPFKHIARVNERDALYSGNLKKVTRLFKNVVADMPDYKKKTAKALTSYDLAGIAYHMEQNLNVPSYMSLSLVEKAREYLQLLTQSSFHRESLMVPDDTRKIFDNDTKVEALEVLHKEMSELAVSIFLELQPSATMYDANVIKSKYVW

SEQ ID NO: 1738 - protein, 369 aa, Vibrio harveyi
MIDFNTRLKKLKDRRQGTRELYLIENGYNSWDISDYRTQEAYERLGESAGVRYALGAMAAVSEQSTRVSISEGNRVADTLIDMLNNAGVRTVKRMQGSVALDIHIEGHSDVDMLILHDEIVLVETPKVDGNPCYPPADKRPMVEIIAELRTLSEEKLTTRYWQADVDCSNGKSISMEGGSLKRKVDIVPSCWYYTQDYQRSDEEKDAGVKIYNKKEHKLIGNFPFKHIARVNERDSLYGGNLKKVTRLLKNVVADMPDSKKKTAKALTSYDLAGIAYHMNENLNVPSYMSLSLVEKTREYLQLLTLSNLYRETLMVPDDTRKIFDNDEKVEALEILHKEVSDLAFSIFRELQPTATTYDADIIKAKAVW

SEQ ID NO: 1739 - protein, 367 aa, Pseudohongiella nitratireducens
MINFDARLKRLKDRRQGTRELVLLEKGFHSWDTGDYRIRESYEELSESPGVRYAIGSMSAVNPESTKVSINEGNRVSDTLISMLKTEGIGATKRIQGSVALDIHIEGHSDVDMLIICEDTILVQTPKLDGSTCYAADNRPMVEIIAELRNKSEQKLTTRYYETDVDCTNSKSISLVGGSLKRKVDIVPSCWYHTHDYQRSRQERDIGIKIYHKKEHRLLGNFPFKHIARVNDKDTQYSGNLKKVIRLLKNLVADMPDYKKGKAKKLTSYDLAGIAYHMDQRLNVPSYMPLALVEQTRDFLSLLNASETYRNTLTVPDDTRKIFDDESKKEALEIITKEVEDLAYSIFRELRPLSQVYDGSVIESKVI

SEQ ID NO: 1740 - protein, 367 aa, Chromohalobacter japonicus
MINFDARLKRLKDRRQGTRELVLLEKGYYSWDSGDYRIRETYEKLSESPGVRYTVGAMSAVDPQSTQVSINEGNRVSDTLISMLKTNGIGATKRMQGSVALDIHIEGHSDVDMLIICEDTILVQTPKLDGSACYAPDKRPMVDIVAELRNASEQKLTTRYHQAEVNCSNSKSISLKGGSLKRKVDIVPSCWHHTHDYQNSWQERDIGVKIYHKKDHCLLGNFPFKHISRVGEKDAQYSGNLKKVIRLFKNLVADMPDYKKGKAKALTSYDLAGIAYHMDQRLNVPSYMSLALVEKAREFLSFLNSYESYRNTLKVPDDTRVIFDGKEKSEALEIIFKEVEDLAFSVFKELRPLSSVYDENVIKSKVI

SEQ ID NO: 1741 - protein, 374 aa, Pectobacterium carotovorum
MINFGDRLKKLKDRRQGSAQLFALNSGNESFSSFYDSRPNEFYENVRESDSIKYVIGAMAPVNPTSTNVSIQEGERVANTLISMLNTSGISTEFKLQGSVALDIHIEGHSDVDMLILKKDVLLVQQPILSSTSYIDAPDKRDMITQVKEIRLVSEEKLTSRYHQANVNCSNRKSISISGGSLARKVDIVPGCWFDTHDYQRSRQQHDRIVKIYDKSEHKFIENRPFLHIKKVEDKDQYYSGNLKKIVRLMKNIVADMPDYKKNKAKKLSSFDLTSIAYHMDEKLNCSEYLPLLLVERLHIWLEKLIDDKHLRDSLLVPDATRAVFNNDEKNEALDILSNEVSDLFSSIYQDIYPNDFTKDVSKLITKSIVTGFS

SEQ ID NO: 1742 - protein, 371 aa, Pectobacterium carotovorum
MINFGERLKKLKDRRQGSAQLFALNSGNESLAYFSDLRPSEFYENVRESDSIKYVIGAMAPVNPTSTSVSIQEGERVANTLISMLNTSGISTEFKLQGSVALDIHIEGHSDVDMLILKKDVILVQRPTLPSTNYTAAPDQRDMITQIKEIRLVSEDKLTSRYHQAEVDCSNKKSISISGGSLARKVDIVPGCWFDTHDYQRSGQQYDRIVKIYDKSEHKFIENRPFLHIKKVEDRDYYYAGNLKKIVRLMKNIVADMPDYKKNKARKLSSFDLTSIAYHMDGKLSCSEHLPLLLVERLHLWLEELRGNENLRNSLLVPDTTRAIFNNNEKNEALDILSSEVSDLFTSIYQDLYPDDFIKDIRKLITKSVAI

SEQ ID NO: 1743 - protein, 371 aa, Aeromonas hydrophila
MINFSNRLQKLKDRRQGSAQRFAMDSGNESFSYYFDPRPIENYESVKESDSVKYVIGAMAPVSDISTKVSIQEGERVANTLISLLETDGIMTEYRLQGSVALDIHIEGHSDVDMLILKKNVLQIQRPALPSTYYTDASDQRDMILQVQELRLASEEKLTSRYHQAKVDCNNRKSISLSGGSLTRKVDIVPGSWFDTHDYQRSRQQHDRIVKIYDKEDHKFIENRPFLHIKRVDDKDQVYSGNLKKVVRLMKNIVADMPDNKNKIAKKLSSFDLTSIAYHMDERLACSIHLPLQLVGKLNDWLLLLKDDASLRESLLVPDATRAVFDADEKNDALDILSNEVNDLVLSIYKDIFPDDVIKDINKLRSKTVTF

SEQ ID NO: 1744 - protein, 371 aa, Aeromonas sp.
MINFSDRLKKLKERRQGTAQRYALDQGYTALSAAYDYRPQESYEKVKDSDAIKYVIGAMAPVSAKSTQVSIDEGERVANTLVGMLEKDRINTEFKLQGSVALDIHIEGHSDVDMLILKNDVILVQLPVLPSTNYTDAPDKRPMLDQVKEIRLASEVKLTSRYYQATVDCSNKKSISMSGGSLARKIDIVPSCWHDSHDYQRSGKQHDRCVRIYDKEKHEFIENKPFLHIKKVDDKDSIHGGNLKKVVRLMKNIVADMPDYKKKVAKKLTSFDLTSIAYHMDAQLTCPEYFPLLLLHRLDLWLQKLKDDKALRDSLKSPDEVQSIFNNVEKDDALEILSKEVSDLAASVYRDLYPYDREKDINKLVYKSIYI

SEQ ID NO: 1745 - protein, 356 aa, Aeromonas veronii
MINFSDRLKKLKERRQGTAQRYALDQGYTGLAAAYDYRPQESYEKVKDSDAIKYVIGAMAPVSSKSTQVSIDEGERVANTLVSMLETDRINTEFRLQGSVALDIHIEGHSDVDMLILKKDVVLIQLPVLPSTNYTDAPDKRPMLDQVKEIRLASEVKLTSRYYQATVDCSNKKSISMSGGSLARKIDIVPSCWHDSHDYQRSGQQHDRCVRIYDKEKHEFIENKPFLHIKKVDDKDFTYGGNLKKVVRLMKNIVADMPDYKKKVAKMLTSFDLTSIAYHMDAQLTCPEYFPLLLLHRLDLWLQKLKDDKTLRDSLKSPDEVQSIFNNVEKYDALEILSKEVSDLAASVYRDLYPYD

SEQ ID NO: 1746 - protein, 371 aa, Aeromonas veronii
MINFSDRLKKLKERRQGTAQRYALDQGYTGLAAAYDYRPQESYEKVKDSDAIKYVIGAMAPVSSKSTQVSIDEGERVANTLVSMLETDRINTEFRLQGSVALDIHIEGHSDVDMLILKKDVVLIQLPVLPSTNYTDAPDKRPMLDQVKEIRLASEVKLTSRYYQATVDCSNKKSISMSGGSLARKIDIVPSCWHDSHDYQRSGQQHDRCVRIYDKEKHEFIENKPFLHIKKVDDKDFTYGGNLKKVVRLMKNIVADMPDYKKKVAKMLTSFDLTSIAYHMDAQLTCPEYFPLLLLHRLDLWLQKLKDDKTLRDSLKSPDEVQSIFNNVEKYDALEILSKEVSDLAASVYRDLYPYDREKDISKLAYKFIYV

SEQ ID NO: 1747 - protein, 371 aa, Aeromonas caviae
MINFSDRLKKLKERRQGTAQRYALDQGYTALSAAYDYRPQESYEKVKDSDAIKYVIGAMAPVSSKSTQVSIDEGERVANTLVSMLETDRINTEFRLQGSVALDIHIEGHSDVDMLILKRDVVLVQQPALPSTNYTDTSDKRPMLDKVKEIRLASEVRLTSRYYQATVDCSNKKSISISGGSLARKVDIVPSCWYDTYDYQRSGQQHDRGVRIYDKGKHAFIENKPFLHIKKVDDKDFIYGGSLKKVVRLMKNIVADMPDYKKKVAKNLTSFDLTSIAYHMDAQLTCPDYFPLLLLHRLDLWLQKLKDDKTLRDSLKSPDEVQSIFNNVEKDDALEILSKEVSDLAASVYRDLYPYDREKDINKLVYKSIYI

SEQ ID NO: 1748 - protein, 376 aa, Vibrio cholerae
MIDFTNRLKSLKDRRQGALERATLEKMALNEAMGLESLSLDDRKKERYEQLNKSDAIKYTIGAMSPVEPQATKVSIEEGERIANTLIDLLATDGINTTSRMQGSVPLDIHIKGHSDVDMLILIDNVVQYENPCAPGVSYIPAKDPRTMVDIVKELREKCEEKLTRRYPAVDVDCQNAKSIAMSGGSLRRKVDIVPSNWFDNIDYQRTKDETERQVRIYNKKEHKLLGNSPFKHIKLVNQKDAIYKGNLKKCVRLLKNLVADMPDYKKVKAKKLSSFDIVGICYNMDSLLNVSEYTPLALVDATLTQLGRLRYIQEARDIRVPDNSRKVFDNEEKVSALEVIHEEILSLAEALYKDINGPSVDRYKAEPLREMQIAF

SEQ ID NO: 1749 - protein, 375 aa, Vibrio parahaemolyticus
MINFESRLKSLKDRRQGALERATLQKMALNEAMGLESLSLDGRKQETYEGLSQSAAIKYTIGAMSEVEEASTNISINEGTRVAETLQGMLETAGVPTYIEMQGSVPLNIHIKKHSDVDMLMLIKGTVLVQTPSPDESRYSPATDKRSMRDIVKELRMLSEEKLTTRYPEVHVDCSNAKSIAMSGGSLKRKVDIVPSCWFDTIEYQLSGKKHDRGVKILDKKADKLIGNSPFKHIKLVNDKDAIYNGNLKKCVRLIKNLIADMPDYKKSKAKKLSSFDIVGIVYNMNDLLSASVYTPLALVNALRIQFENLKLFEAARDIKVPDGSRKVFDSEEKIVALGVVCDEILALSEALNRDIAPESANYKPDHLTEKVIYF

SEQ ID NO: 1750 - protein, 376 aa, Vibrio splendidus
MIDFEKRLAKLKDRRQGALERATLDSMMILEKAGSFSSHLDNREREAYEKLGQSASIKYAIGAMSAVDDASTQVSIREGERVAETLSGLLKTAGINTTYRMQGSVPLNIHIKGHSDVDMLILEESTILVQNPVVDTFRYSEPTDKRPMVEIIKRLREVSEEKLTTRYHEVEVDCDNAKSIAMSGGSLQRKIDIVPSCWLDTAEYQNTNDESERGVKIYDKKSHILLGNAPFKHIKLVDEKDKIYRGNLKKCVRLLKTLVADMPDYKKVKAKELSSFDLVAIVYHMNDLLNVNAYTPLALVAAIETQLGNLRYIEVLRDISVPDGSRKVFNSDKKLEALAIFHDEISALSRAIYKDLVPGVLHTYDSKVLNEKVIAL

SEQ ID NO: 1751 - protein, 374 aa, Vibrio splendidus
MINFENRLTKLKERRHGHYSDDVLKSIGLESSKATFDSLQNLGESYESLTESAAIKYTIGAMSQVDPEYTKVSQRTGERVADTLTNLLKTDDKLVTSRMQGSVPLNIHIKGHSDVDMLMISTPVVLVQTPQSPNAHYLPPSDARPMEDILRDLRLTCEDRLTTRYPSVTVDCGNAKSIAMEGGSLQRKVDIVPACWFDTIEYQESKKEVDRGVEIYDKKNHKLIGNSPFKHMDLVEKKDAFYGGNLKKLVRLLKNLVADMPDAKNAQAKKLSSFDLVSIVYSMDDLLICSSYTPLLLIDRLLTKLNQFLENVFLQASQKVPDNSRIIFDTDSKIVALRVIRDEIQSLRDAVYSDLTGGSIFFDANRLVEKRITV

SEQ ID NO: 1752 - protein, 376 aa, Methylobacter tundripaludum
MINFEDRLKKLKDRRQGTSAQAVFDSALTEQQRYVALESHSDVRPKEFFETLKESAGIKYTIGAMAAVDEKSTEVSINEGNRVADNLISKLKTHNIYADKRMQGSVPLDIHIKGHSDVDMLVIINNTILIERPVILPNNYSPATDTRSMVDIVKELRTKSEQILPNSFPKADVNINGCKSIALEGGSLARKVDIVPSCWYDSVKYQASKFEHERGIKIYHKDNHELVLNYPFTHINVVNKKDAEYSGNLKCVIRLMKNMIADMPDNKKRIAKKLSSYDLAAIAFHMNEDLRLPSYMRLGLIEKTKSHLIYLRINEYYRNSLDVPDGTRRIFDNNEKMSALEILSQEINDLAESIFKEIKPYASRYEPSIILEKIVA

SEQ ID NO: 1753 - protein, 375 aa, Oleispira antarctica
MIDFEKRLKSLKERRQGSRERAIYESMDSVTANSAVLRGVDVRKSESFESLNEVNGVKYTIGAMAPVESQSTKISIDEGNRVADSLIRSLQNNGESVTKRLQGSVALDVHIKGHSDVDMLIVVTNPVNVELPKVSPNGYSPSTDPRSLVNIARDVRVKSEKILPEKFPAAKVDAKGNKSISLEGGSLKRKVDIVPAIWFDSTSYQRSGQEYDRGIKIYHKEDHELILNYPFTHIKKVNDRDTRFSGNLKCVIRLMKNMIADMPDYKKRIAKKLSSYDLAAIAFHMNEDLNVPQYMRLSLVEKTRSHLSLLNNSKAYRDTLNVPDGSRKIFDTDDKSEALGILTSEITDLAKAIYNELKPYNVGYDSSVILSKSVF

SEQ ID NO: 1754 - protein, 375 aa, Vibrio cholerae
MIDFKKRLKSLKDRRQGTRERAIYDSMDSFSANNAIQRGVDIRKSESFENMNEVAGVKYAIGAMSAVETASTQVSIDEGNRVADSLINSLRNSGESVTKRLQGSVALDIHIKGHSDVDMLIIVTNPVEVELPQVNLNGYSPAKDPRTLINIAKDVRLKSERILPVNFPKAEVDSSGNKSIALEGGSLRRKVDIVPAIWFDTIKYQHSGLESDRGIKIYHKADHEFHLNYPFTHIKMINDRDSLYSGNLKSVIRLLKNMIADMPDYKKRTVKSLSSYDLAAIAFHMNTDLNVPSYMKLALVEKTRAHLALLNSLKYYRDTLNVPDGSRKIFNEESKAKALEILTNEITDLAKAIYEELKPFSQSYDANVILNKSVF

SEQ ID NO: 1755 - protein, 375 aa, Halomonas nigrificans
MIDFEKRLKSLKERRQGTRERAIYESMEYFSANNAIQRGVDVRKPESFESLNEVAGVKYTIGAMAAVEPASTKVSISEGNRVADSLINSLQNSGESVTKRLQGSVALDIHIRGHSDVDMLIIVTNPVNIELPEVNPNGYSPATDPRSLIDIAKDVRSKSERILPVNFPKAEVDSTGNKSIALEGGSLKRKVDIVPAIWFDTIKYQRSGQESDRGIKIYHKSDHELHLNYPFTHIKMINDRDLFYAGNLKSVIRLLKNMIADMPDYKKRTVKNLSSYDLAAIAFHMNTDLNVPSYMKLALVEKTRAHLALLNSVKTYRDTLDVPDGSRKIFNEENKTEALEILTNEISALAKAIYEELRPFSTSYDADVILNKSVF

SEQ ID NO: 1756 - protein, 375 aa, Pseudomonas stutzeri
MIDFENRLKSLKERRQGSRERAIFESMDSFAANQAILTGRDVRKREFFETLNESAGVKYAIGAMAAVDEAATKVSIREGERVADSLIKSLSSEGESVTRRLQGSVALDIHIKGHSDVDMLILVTNPVNVELPKVVPNGYLPSSDPRSLLQIIRDIRAKSERILAVNFPKANVDCSSSKCICVSGGSLAREVDVVPAIWFDTIKYQSSSQDHDRGVKIYNKSDDEFLLNFPFTHIKLVNDRDALYGGNLKSVIRLMKNMIADMPDYKKRVVKQLSSYDLAAIGYHMNENLYAPYYMKLSLVEKTRAHLAFLLAAKDYRSSLSVPDQSRKIFDNDGKVEALSILSKEMDDLAVSIFKELQPLRSAYDSSAILTKSIF

SEQ ID NO: 1757 - protein, 375 aa, Pseudomonas toyotomiensis
MIDFENRLKSLKERRQGSRERAIFESMDSFAANQAILTGRDVRKREFFETLNESAGVKYAIGAMAAVDEAATKVSIREGERVADSLIKSLSSEGESVTKRLQGSVALDIHIKGHSDVDMLILVTNPVNVELPKVVPNGYLPSSDPRSLLQIIRDVRAKSERILPVNFPKANVDCSSSKCICVSGGSLAREVDVVPAIWFDTIKYQSSSQDHDRGVKIYNKSDDEFLLNFPFTHIKLVNDRDALYGGNLKSVIRLMKNMIADMPDYKKRVVKQLSSYDLAAIGYHMNENLYAPYYMKLSLVEKTRAHLAFLLAAKDYRSSLSVPDQSRKIFDNDGKVEALSILSKEMDDLAVSIFKELQPLRSAYDSSAILTKSIF

SEQ ID NO: 1758 - protein, 316 aa, Pseudomonas viridiflava
MAPVSKRGTEISKGEGQRVADSLIKSLEARGERVAGVLQGSVALNIHIKGASDVDMLIVERETLFVESPRVSSTAYVAASDSRSLLQIIKDIRKKSEIILPENFPAVDVKSNDKSIAMEGGSLRVPVDIVPAVWFDSVGYQRTRNQADRGIKIYSKSDDGFITNFPFMHIAEVNLKDSRYSGNVKCVIRLLKTLVSDMEEADKKVAKGLSSYDLTALAYHMGERLNVPVYQRVALVLRVEAFFTFLIGAPEYRNSLTVPNGTRKIFDTPARLPALILLRQELQELSLSVAKEIEPWNAVIDTSILEHRIVADTVFD

SEQ ID NO: 1759 - protein, 374 aa, Pseudomonas syringae
MDFNSRLTSLKNRRKGPQNPTFDGISESAYAELTKALSGQRYGVESFESLQEPDGIKYAVGAMAPVEKRYTEISIAEGERVANSLSKSLLNESVTVEYKLQGSVGLDVHIKGYSDVDMLVLIADTITVQSPSVNPSAYVDATDTRPTAEIISDLRYRSERILCNNFPKVNVNTEGGKSIALEGGSLARKIDIVPAFWFHSLDYQTHLLEHLKGVKIFNKLDLQFITNYPFLNRKLINDADQQCGGNLKRVVRLMKNLQADATGDIAESIVKLNSFDILSIAYDMRHLLSTPSYHQLTLVDTLADRLQYLIINKGWRENMETPDSTRKVFNDEDKLAGLAALYNECYRLAVDLAKEINPFQLVYNRDTLRDKMVF

SEQ ID NO: 1760 - protein, 374 aa, Pseudomonas amygdali
MDFNSRLTSLKNRRKGPQNPTFDGTSESDYAELTKALSGQRYGLESFESIQEPDGVKYAVGAMAPVEKRYTEISIAEGERVANSLSKSLLNESVTVEYKLQGSVGLDVHIKGYSDVDMLVLIADTITVQSPSVNPFAYVDATDTRPKAEIISDLRYRSERILCNNFPKVNVNTEGGKSIALEGGSLARKIDIVPAFWFHSLDYQTHLLEHLKGVKIFNKLDLQFITNYPFLNRKLINDADQQCGGNLKRIVRLMKNLQADATGDTAESIVKLNSFDILSIAYDMRHLLNTSSYHQLTLVDTLADRLQYLIINKGWRDNMETPDSTRKVFNDEDKLVGLASLFNECYRLAVDLAKEINPFQLVYNRDTLREKIVF

SEQ ID NO: 1761 - protein, 374 aa, Pseudomonas syringae
MDFNSRLDSLKKRRQGPQLATFDGISEAAYAELNKALKGEVSGVESFESIQEPDGVKYTVGAMAPVEKRYTEISIAEGERVATSLSKSLLAESVNVEYRLQGSVGLDVHIKGYSDVDMLVLIADTLTVQPPYVNPSSYADAKDMRPLTEIISDLRSRSERILTNNFPKVNVNVNGGKSIALEGGSLARKIDIVPAFWYHSRDYQTCLLEHYKGVRIFNKLDLQFITNYPFLNKRLVNDADEQCGGNLKRVVRLMKTLQADATGDVAESIVKLNSFDVLSIAYDMRSQLYTPYYHQLTLVDTLVDRLQYLIVNKEWRQNMETPDSTRKVFDNEEKLSGLVCLHRECQRLAVDLAKEINPLQVMYDRDVLRNKLVF

SEQ ID NO: 1762 - protein, 374 aa, Pseudomonas syringae
MDFNSRLDSLKKRRQGPQLATFDGISEAAYAELNKALKGEVTGVESFESIQEPDGVKYTVGAMAPVEKRYTEISIAEGERVATSLSKSLLAESVNVEYRLQGSVGLDVHIKGYSDVDMLVLIADTLTVQSPYVNPSSYSDAKDMRPLTEIISDLRSRSERILTNNFPKVNINVNGGKSIALEGGSLARKIDIVPAFWYHSRDYQSCLLEHYKGVRIFNKLDLQFITNYPFLNKRLVNDADEQCGGNLKRVVRLMKTLQADATGDVAESIVKLNSFDVLSIAYDMRSQLYTPYYHQLTLVDTLVDRLQYLIVNKEWRQNMETPDCTRKVFNDEGKLSGLVCLHRECQRLAVDLAKEINPLQVAYDRDVLRNKLVF

SEQ ID NO: 1763 - protein, 370 aa, Pseudomonas sp.
MDFSSRLDALKKRREGPSTAYSMEAYDSVTGTASNREVIAKSNIFESLKEPDGVKYAVIAMTAVDAKDTEISIKEGERVADSLAKSLSGEGVEVDTRLQGSVGLNVHIKGYSDVDMLVLVGSTILVERPHVRPGTYPPATDTRPMTEIVGDLRARSERILPKNFPAVDVNVDGPKSIALEGGSLKRKIDIVPATWYHTLTYQHSLLDHDKAVKIFNKADSSFIVNFPFLNRKIINDADALVNGNIKRIVRLMKTLQSDSDAEAIKKINSFDVLSIAYDMRHLLNIPAYLELALVEILRARLEFLMENKSHRELMDTPDKTRKVFDNTNKLEALTLLFIECRDLANSLVKEINPYLGQYSKDILLNKAIIR

SEQ ID NO: 1764 - protein, 365 aa, Pseudomonas sp.
MAKDVNRRLADLKSRRRGNSTVVMDSAYATASNRSEKFETRSTKQWAKYALGIMQEVDPTYTRNSVAEGERVKSQISNRVDRDIKFEYQGSVPLNVHIRGVSDIDILVLLGQYLTIDTQGVRANTAAYSDWVGPSGIDQLAALRNELEVALKAAYPAADVDITKDKAIALSGGSLARSVDVVPSHWHDSATYQVSQNKRDREVKIYQKNTHNTFLNRPFLHIDKINEKETYTRGGAKKIIRMLKNLKADSDNPTAILINSYEIAGLVYHFESSSMSVPVYNELALVAVAKQQLTRLIDSKLWAMGLNTPDGIRKIIDSEAKFNSIKLLRDEVSELGKNLAIELTSRYWMDDLETLKALRESYIAE

SEQ ID NO: 1765 - protein, 366 aa, Pseudomonas syringae
MGKDVYRRLSDLKSRRRGNSSTIAMDSITANSRSISEKFETRSSGQWAKYALGIMQEVDPTYTQNSVAEGERVKNQITTRISTEVKFEYQGSVPLNVHIRGVSDIDILVLLSGYLTIDLSGSRANTTDYSNWVGQSGTAQLAFLRSELESALKAAYPAADVDITKDKAIALSGGSLLRKVDVVPSHWHDSANYQTSKNKKDREVKIYQKVTDDTLLNRPFLHIDKINQKEAVTRGGAKKTIRMLKNLKADSENPSAILVNSYEIAGLVFHFEDTPMSVPAYNELALVAVAKQQLTRMMDNKLWAMGLMTPDGIRRIIDSEEKFKSLTLLRDEVSELGKNLAVELTSRYWIDDLETLKALRESYIAE

SEQ ID NO: 1766 - protein, 288 aa, Pseudomonas syringae
MREVNPNYTKNFMSEGERVKKQITHRISTDVQFEYQGSVPLNTHIQGASDIDILVLLGGYLTFDLHGYRACATDYSSCAGLSGVAQLASLRKELELALKAAYPAADVDITRDKAIALSGGSLSRKIDVVPSYWNDSATYQISRNKKDRETRVYRKNTGDTVLNRPFLHMDKINQKDGRTCGGTKKIIRLLKSLKADSDNPAAILVSGYDIAGLVYHFEEALMSVPVCDELTLVAVAKQQLARIIESKLWSMGLATPDGVRRIIDSEEKFKSIRLLWDEVNDLGKKLGY

SEQ ID NO: 1767 - protein, 358 aa, Azonexus hydrophilus
MRSRRMGLGNAALSANFREAVALDSISEEFSEAYEKRAKTDAIKYALGAMQALDAKYTAISFQEGDRVKNQLGPCLQSVGISATFEYQGSVPLDIHIRRASDIDLLVLHDRFVTVDHTGPRAQTYFTLPLSVLDEMLKLRSQCESILTQKFPAVTVDTSGAKSISLSGGSLQRKIDVVPSHWHDTAAYQVSKEKHDREVKVLDKHERTLITNRPFLHMRRIEEKDGRTNGCTKKVIRLLKNLKRDSSKDIKLSSYDIAALVWHFSDQALNKPYYLELSLVAETQNCLQFMLNNPGYARTLDVPDMSRKILDSDDKMSALRHLKAEVDELATNLVRELKPIYLDSQDFIRKSLAEAQVF

SEQ ID NO: 1768 - protein, 367 aa, Thalassospira sp.
MSRNYSDRLQRMHRRRSGSTYSADSLAAELLGEALDHKEAYERRTDREATKYCLGAMQEVDPKYTRISKDEAERVGSQLQIALQTKNIPIELELQGSVPLNVHIRGTSDVDLLALHRSFLTYDPNGSRRYSAAERTTKSYMQELRKESETILSQRYWSADVDTTGAKSIKLSGGSLARKIDVVPSYWHDTVDYQLYGLQEDRDVCIWDNVAQVPINNKPFKHMAMIDRKDREVNGGARKLIRFLKTVKRDMEKDDREVALSSYDIAALMWHCDGGLLQHTIVEELSLIANCDQYLEYLANNLNLARQLTTPDGSRTILEDEDKVLSLRELSSEVSELATDVAMEAQRISIPTADWRRSVLKETQIGA

SEQ ID NO: 1769 - protein, 368 aa, Deltaproteobacteria bacterium
MATDYSNRIGRVNARRTNTAVASLRKSASFAEDSAFGDSVTESYRSKTRSRNFQYALVSMQEVDAQYTAISYREAERIAKQIDSGLLRWGKSVAVELQGSLPLNVHLRRVSDVDMLVWPSTFFVFDTYGAAASTYSGSTSNAVSEITSLRAECCSVIRSAFPAAKVDDSGAKCITVSEGSLLREIDVVPSILYKTATYQRTNKDEDRGVQIYDKKAYELVTNYPFKVRALINVKEGRTGGGCKKAIRLLKNMKEDSDASIALSSFNIMSLVYAMQDSDLVHLSYYEGKIIASLQNWFFTLANDETYLRGLDTVDGSRKIVQSAADVVAVSQMSEELNVLVLRIAQELQSDIPTSFSAWRAKVESEFLI

SEQ ID NO: 1770 - protein, 368 aa, Betaproteobacteria bacterium
MATDFSSRLSRVNARRNGTGVAVLNKSFSFSEDSSLLDSVTQGYQNKTKSKSFQYALVSMQEVDAKYTAISFREAERVAKQLDSGLLRNGKVVTVELQGSLPLNVHLRRVSDVDMLVWPLNFFVYDIYGVAASSYTASASNAVSEISTLRSDSCSVLRSAFPAARVDDSGAKCIRMSEGSLLREIDVVPSVLYRAEAYQRSSNDDDRGVQIYDKKKYALVTNFPFKVRALINAKEARTGGGCKKAIRLLKNMKEDADSAIALSSFDIMSLVYAMQDFDLVHQSYYEGRIVASLQNWFFTLAHNESQLRTLDAVDGSRKIVQSAADVVAVAQMSEELNMLVLRIAQELQPDVPTSYPAWRAKVESELLI

SEQ ID NO: 1771 - protein, 362 aa, Cupriavidus sp.
MSKKDYKSRITKLRDRRQGSPSFTFDSAAGAAPIVESYEQRTRSESLKYGLGAMQEVDATYTHISGKTGERVKNQLVAGLERRGEVADIRFQGSLPLNIHIRRYSDVDLLVLPGSFLIYDCIGPLATTYCPSPLDRVEVVKKLRGDCYDILSSAFREVNIDNSGAKCIALSGGSLARKVDVVPALWYDTVEYQRTRAIEDRRVEILDLPKGILDGNFPFRYMARIEQKDRDTIGGARKAIRLLKTLKYDAETPVELSSFDIASIVWNMPDVSLRYPGYLETAIIVGALNYLSLLVADRTLAESLYVADGTRKIIRSTKDFEGLKALRDELVDLTESIASELKPLDHNAVQNSKQILVESQIY

SEQ ID NO: 1772 - protein, 372 aa, Xanthomonas euvesicatoria
MSADIDKRLANLSLRRNGRDRATMTFDSVASLESLKETYQERATGKNTRYALGAMQEVGKQYTDKGIEEAGRVQARINDGLAKEGLHCTFKLQGSVPGNIHIRGASDVDFLVLDPRFIKYDASGPGARQGYYREPYLGSPLVTLQSLRASIEQIIINAYPAATVDCSGGKAIQVSGGSLDRDIDVVTASWFDTPEYQSTRNEDFRGVDILDKKVPALIRNAPFLHLLRLKERDAETWGGLKKAIRLCKTLKADAANEGTHIDINSYDIASALWNADADSLRAGIIDELSILSAATRYFLYLASNLTHARNLQTPNGLRQVFDTEDKLKAIPVLAQELVELAKSVAQEQAPLLERNAQFEDWMGTLQRTKIPQ

SEQ ID NO: 1773 - protein, 349 aa, Unknown
  Description of Unknown: Xanthomonas sequence
MTFDSVASLESLKETYQERATGKNTRYALGAMQEVGKQYTDKGIEEAGRVQARINDGLAKEGLHCTFKLQGSVPGNIHIRGASDVDFLVLDPRFIKYDASGPGARQGYYREPYLGSPLVTLQSLRASIEQIIINAYPAATVDCSGGKAIQVSGGSLDRDIDVVTASWFDTPEYQSTRNEDFRGVDILDKKVPALIRNAPFLHLLRLKERDAETWGGLKKAIRLCKTLKADAANEGTHIDINSYDIASALWNADADSLRAGIIDELSILSAATRYFLYLASNLTHARNLQTPNGLRQVFDTEDKLKAIPVLAQELVELAKSVAQEQAPLLERNAQFEDWMGTLQRTKIPQ

SEQ ID NO: 1774 - protein, 377 aa, Stenotrophomonas maltophilia
MSADINKRLRALDARRHGFDRSSVIFDSASGFEARAHLSETYQKRSSGYHTRYALGAMQAVAASYTALSVAEAERVQAQIATRLDRDGLSCTFRLQGSVPGNIHIRGVSDVDFLVLEQRFHHYDATGVLALAGHYRNPYLPSAVDTLLDLRHRLEAALKDAYPAAEVDCTGAKAIRLSGGSLRREVDVVPASWNDTAEYQRTQSEDFRGVNILDKPARQLIHNLPFLYLRRLRERDDETWGGLKKAIRLCKTLKADAISDGKKVEISSYDIASALWNAAAGTLQAGIVKELSILAATTDYFVYLVANPAYAKTLQTPDGSRRVFDTQVKLDAAAVLAQELLELSRAVSEEHAPRTAHASLQNDWLNTLKQTSVPVVD

SEQ ID NO: 1775 - protein, 377 aa, Stenotrophomonas maltophilia
MSADINKRLRALDARRHGFDRSSVIFDSASGFEARAHLSETYQKRSSGYHTRYALGAMQAVAASYTALSVAEAERVQAQIATRLDRDGLSCTFRLQGSVPGNIHIRGVSDVDFLVLEQRFHHYDATGVLALAGHYRNPYLPSAVDTLLDLRHRLEAALKDAYPAAEVDCTGAKAIQLSGGSLRREVDVVPASWNDTAEYQRTQSEDFRGVNILDKPARQLIHNLPFLYLRRLRERDDETWGGLKKAIRLCKTLKADAISDGKKVEISSYDIASALWNAAAGTLQAGIVKELSILAATTDYFVYLVANPAYAKTLQTPDGSRRVFDTQVKLDAAAVLAQELLELSRAVSEEHAPRTAHASLQNDWLNTLKQTSVPVVD

SEQ ID NO: 1776 - protein, 377 aa, Stenotrophomonas maltophilia
MSADINKRLRALDARRHGFDRRSVIFDSASGFEARAHLSEAYQKRSNGHHTRYALGAMQAVAASYTALSIAEAERVQAQIATRLDRDGLSCTFRLQGSVPGNIHIRGVSDVDFLVLEQRFHHYDATGVLAQAGHYRNPYRPSAVDTLLDLRHRLEAALKDAYPAAEVDCAGAKAIQLSGGSLRREVDVVPASWNDTAEYQRTQAEDFRGVNILDKPARQLIHNLPFLYLRRLRERDDETWGGLKKAIRLCKTLKADAISDGKTVDISSYDIASALWNAAAGSLQAGIVKELSILAATTDYFVYLVANPAYAETLQTPDGSRKVFDTQAKLDAAAVLAQELLELSRAVSDEHAPRTAHASLQHDWLNTLKETSVPVFD

SEQ ID NO: 1777 - protein, 377 aa, Unknown
  Description of Unknown: Stenotrophomonas sequence
MSVDINQRLRALDARRRGLDRASLVFDSAAEFSAQRSFKESYEKRSSGRYTRYALGAMQEVERSYTALSFQEAERVQSQISTRFAKVGLGCTFRMQGSVPGNIHIRGISDVDFLVMEQRFLHYDAAGVLAQAGFYNSPYRRSAADTLLDLRQRLEAALKDAYPAVDVDCSGAKAIQLSGGSLRRDVDVVPASWNDTCEYQRTQIEDYRGVNVLDKPAHELIHNLPFLYLRRLKERDEETWGGLKKAIRLCKTLKADAISDGKAVDISSYDIASALWNAPANTLRVGIVHELSILASATDFFVYLTANPNYAKSLQTPDGSRKVFDSEVKLRAVAVLAQELLNLSRDVSAEHVSDTASVQLRDDWLNTLKRTSVPVID

SEQ ID NO: 1778 - protein, 366 aa, Sphingomonas sp.
MSIDYASSLSRLRNRRLGADRAGIALAQALPVVERYQKRASSEATRYTLGAMQEVDPDYTAKSNEEAERVIAALRSSLTAADRYAEFRQQGSVPANTHIRGASDVDLLVLGGVHTYDPGGVRARAGLYLPWNGSIVQEIDDLRCECEDILKRRYWAATIDTTKPKSIRMSEGSLTRDVDVVPAHWSDNVTYQASLLERDRGVCILDRSVPTTTMNLPFLHIDRLNVGDLPALGGLKMSIRLLKNLKADSSRTIGLSSYDMAGLMWNCDARLIRYHAGRELSVLLGTDQWLEWLVTNPAEAGRLMTPDGIRRVLDEGEKFKALTVLAGEVSALREAVAAEWMPILKSERGGFAADRRALLEDVTIPG

SEQ ID NO: 1779 - protein, 378 aa, Stenotrophomonas maltophilia
MIEDSDKLLGRLKDRRHGIGSSANFAMDSAGLESLQEALTRRARGEAYETRARGKPYTVYTLGAMQQVDAAYTQISIKTADRVQEQLHTRLSARGYALDFRHQGSVPLNVHIKGVSDIDLLTIEESVFLYDPNGLVGRSNGYVAARRSAVDVLADLRRDSETVLRDAYAAATIDTSGAKAIRISGGSLQREVDVVPSVWWNNIEYQRSGQAHDRGVAIFNKDDRSTIKNLPFLHIKMITDACNLTYGGLRKSIRLLKNVKADANEDHELIKLSSYDIAGLMYHADRERLRAGVMTELAILAETQRHLEYLVNNPSYAKSLQTPDNSRRILDSTRKFSDLEDLSREVTRLMDKVSAEQPELLYLIETPAKRAALSKIQI

SEQ ID NO: 1780 - protein, 378 aa, Pseudomonas sp.
MARNIQNRLSSLRSRRNGTEGLNRVSAFDTAQIIANSLNSEKYEKRTEKPYTRYAIGSMQEVDEQYTKISIAEAERVGKQLNTGLTELGFSVAFRLQGSVPCNIHIRGVSDVDLLVLDEDFFTYDRTGQNSRLGLYNNPISYTPLSALQLLRKNSENILIKQFPAVTVDTTGGKAITLSGGSLRRPVDVVPSHWHNTHNYQTTNKESDRAIYILDNKVPTTIFNKPFKHIEKITYKDALTLGGLKKSIRLCKHIKADAAKEGTNITLPSFDIAAALWHADSSALIAGFTNELAILLETKRHLTFLHNNRFHTQSLRTPDDTRLIFDTESKLKGLELLLSEVNDLAIEVAKEQNLSLLRGAYSWDKIDETLRNTRIPTL

SEQ ID NO: 1781 - protein, 344 aa, Janthinobacterium sp.
MGMDSLNEASWAPPEESYQRRTTQENTKYSLGAMQEVGPKYTQVSLAEANRVQGQLQTGFDAINISVAFKIQGSVAANLHIKGSSDVDMLLLDDRFYTYDITGSKAQSGGYDSPYIKGATESLQEIRTEAIKILRSKYLTVTVNDGPKAIGLSGGSLRRDIDVVPSHWHDTAEYQQRHQDYYRGVYILDNDKPDRLLNMPFLHIQRIDEKDQLASGSLRKSIRLCKNVKEDFNDEGGNIQLSSYDIAATMWHSNLHILKYSVYQELAILGETARHLQFLQKNQPYAQTLVVPDGTRKIFDRPEKLESLATLSHEITDLAIEVAIEQGGGGGWDEVERALRNSWV

SEQ ID NO: 1782 - protein, 353 aa, Alcaligenes faecalis
MEARAAEQELSKSIVESYVQRASYKPFTQWILGAMQAVDKQYTDISVQEAARVGEQLKKGLAKKGIGVEFRLQGSVPCDVHIRGASDVDLLVITKKFWRYDSSGTKAKRGYYSNPVDYCALQALVEFREQLETVATTAFPEAVVEIENSKAIALSGGSFQRKVDAVPANWFDSDKFQESESEADRGIEILDKKIPKRIRNLPFKHIVELDTADKKTKGGLKKAIRLLKNIKAEAEENGEEIKLTSYDIASFMWHADKEKLATDDGEELKLLAEVTSFVTLLLSDRMWAKELSTPNGTTKIFENDSKFDGLTSLSNALNEYVVQVAVENPNMEIAGSANINEVLNNLKNVFIPV

SEQ ID NO: 1783 - protein, 384 aa, Alcaligenes faecalis
MKKRDIKERLYALNARRTATPTYSSSLESYSIEARAAEQELSKSIVESYVQRASYKPFTQWILGAMQAVDKQYTDISVQEAARVGEQLKKGLAKKGIGVEFRLQGSVPCDVHIRGASDVDLLVITKKFWRYDSSGTKAKRGYYSNPVDYCALQALVEFREQLETVATTAFPEAVVEIENSKAIALSGGSFQRKVDAVPANWFDSDKFQESESEADRGIEILDKKIPKRIRNLPFKHIVELDTADKKTKGGLKKAIRLLKNIKAEAEENGEEIKLTSYDIASFMWHADKEKLATDDGEELKLLAEVTSFVTLLLSDRMWAKELSTPNGTTKIFENDSKFDGLTSLSNALNEYVVQVAVENPNMEIAGSANINEVLNNLKNVFIPV

SEQ ID NO: 1784 - protein, 379 aa, Xenorhabdus bovienii
MADYGQKIKRLSERRKLPRSYTATYDSAESIAAFESITANLNKAAFTEKWETRGKLDSATRYALGAMQEVDLNYTRICYETAERVENQLKSGLSKEGINASFHLQGSVPLNIHIKGVSDVDLITIDEALLLVDREGIKASSYPAATRSALDVLRTLRNKAADVLDAAFPAARVDRSGAKSLKITGGSLPREVDVVPAIWWDTSNYQRFQQEEYRGIAIYDSKNYEYICNLPFLHIKRIEDRCDRSFGGLRKAIRLLKNLRADAVIDDLHIDLSSYDIASIMYHADISNLSYNRFFELAVLAETQRWLRYLCDNFSFAQTLYVPNETRKIFEKASMYAELKKLSQITDNLVRAVVGENDTYGVYGINMDSSRKYLSSLDV

SEQ ID NO: 1785 - protein, 379 aa, Xenorhabdus bovienii; identical to SEQ ID NO: 1784

SEQ ID NO: 1786 - protein, 374 aa, Pluralibacter gergoviae
MAANFDTRVERLKARRKGTNQIAAMDAMLESTQILVNKSRQQEIWETRAAGKKATKYALGAMQEVDPVYTRVSIQTGERIENQLAKKLDARGLKTVYRLQGSVPLNIHIKGVSDVDILAIDEQMLMVATAGIRYNTYPSTDKDGLDVLHILRNHVEECLADAFPMAKVHTENAKSVKITGGSLARDVDVVPAIWWDTVNYQQTNDEKDRGVAILNKKIPERVYNTPFVHINLIETRCNQSYGGLRKSIRLLKNIKADAESEGTVINLSSFDIASIMYHSDVAALSRGRFFELAILGETQRWLDWLWHNYEEAKKLSVPDGTRKIFDSEEKKDQLLALSSQVDNLMRAVAFEINDAFGSDTPLHEIRSYVGASAY

SEQ ID NO: 1787 - protein, 347 aa, Pluralibacter gergoviae
MLESTQILVNKSRQQEIWETRAAGKKATKYALGAMQEVDPVYTRVSIQTGERIENQLAKKLDARGLKTVYRLQGSVPLNIHIKGVSDVDILAIDEQMLMVATAGIRYNTYPSTDKDGLDVLHILRNHVEECLADAFPMAKVHTENAKSVKITGGSLARDVDVVPAIWWDTVNYQQTNDEKDRGVAILNKKIPERVYNTPFVHINLIETRCNQSYGGLRKSIRLLKNIKADAESEGTVINLSSFDIASIMYHSDVAALSRGRFFELAILGETQRWLDWLWHNYEEAKKLSVPDGTRKIFDSEEKKDQLLALSSQVDNLMRAVAFEINDAFGSDTPLHEIRSYVGASAY

SEQ ID NO: 1788 - protein, 375 aa, Cronobacter dublinensis
MADNFSSRIERLRTRRRGINEIFAMDSGLESREILLAKSRQQEAWESRASGKSATKYALGAMQEVDPVYTKVSIETGKRIENQLANRLEKKEITASFRLQGSVPLNIHIKGVSDVDILTIDEQLFIFSNEGSKASSYIISKKKAVDVLQILREEIEDSLRAAFPAAKVHTENSKAVKITGGSLARDVDVVPAVWWNNARYQDTGNEVDRGVAILNIKNNQRIYNTPFLHIDYIESRCNTTLGGLRKSIRLLKNIKADAHEEGVEINLSSFDIASIMYHADMGNLLRGHFYELAILGETQRWLDWLSHNFDEAKKLEVPDGTRMIFDTDEKKGELLKLSLQVDTIMTAVHNEMNSLFHKDSIDEGMREYLRNSKVD

SEQ ID NO: 1789 - protein, 375 aa, Raoultella terrigena
MSDNFSSRIERLRTRRRGIKEIYAMDSGLESREILLEKSRQQETWESRASGKSATKYALGAMQEVDPVYTRVSIETGKRIENQLANRLEKKEITASFRLQGSVPLNIHIKGVSDVDILTIDEQLFIFSNEGSKASSYTLSKKQAVDVLQILREEIEDSLRTAFPAAKVHTENSKAVKITGGSLARDVDVVPAVWWNNARYQDTGNEVDRGVAILNIKNNQRIYNTPFLHIDYIESRCKTTLGGLRKSIRLLKNIKADAHEEGVDINLSSFDIASIMYHADMDNLLRGHFYELAILGETQRWLDWLCHNFDEAKKLEVPDGTRMIFDTDEKKGELLKLSLQVDAILTAVYNEMNSLFHKDSIDEGMREYLRNSKVD

SEQ ID NO: 1790 - protein, 375 aa, Pantoea vagans
MADNFSSRIERLRTRRRGINEIFAMDSGLESREILLEKSRQQEAWENRASGKSATKYALGAMQEVDPVYTRVSIETGKRIENQLANRLEKKEISASFRLQGSVPLNIHIKGVSDVDILTIDEQLFIFSSEGSKASSYIISKKQAVDVLQILREEIEDSLRAAFPAATVHTENSKAVKITGGSLARDVDVVPAVWWNNARYQDTGNEVDRGVTILNIKDNQRIFNTPFLHINYIESRCNTTMGGLRKSIRLLKNIKADAHEEGVEINLSSFDIASIMYHADMGNLLRGYFYELAILGETQRWLDWLWHNFDEAKKLEVPDGTRMIFDTDEKKDELLKLSLQVDTILTAVHNEMNSHFHKDSIDEGMREYLSNSKVD

SEQ ID NO: 1791 - protein, 375 aa, Enterobacter asburiae
MADNFSSRIERLRTRRRGINEIFAMDSGLESREILLNKSLQQETWESRASGKSATKYALGAMQEVDPVYTRVSIETGKRIENQLSNRLEKKEITASFRLQGSVPLNIHIKGVSDVDILTIDEQLFVFSNEGSKANSYVLSKKQAVDVLQILREEIEDSLRAAFPAAKVHTENSKAVKITGGSLARDVDVVPAVWWNNARYQDTGNEVDRGVAILNKKDNQRIYNTPFLHINYIESRCNTTLGGLRKSIRLLKNIKTDAHEESIEINLSSFDIASIMYHADIGNLLRGHFYELAILSETQRWLDWLWHNFDEAKKLEVPDGTRKIFDTDEKKGELLKLSLQVDTLLTAVHNEMNSIFHKDSIDEGMREYLSNSKVD

SEQ ID NO: 1792 - protein, 375 aa, Klebsiella pneumoniae
MADNFSSRIERLKTRRKGINEIFAMDRGLESREILLAKSLQQEAWESMASGKSATRYALGAMQEVDPVYTRVSIETGKRIENQLSNRLEKKEISASFRLQGSVPLNIHIKGVSDVDILTIDEQLFIFSNEGSKANSYVLSKKKAVDVLQILREEIEDSLRAAFPAAKIDTENSKAVKITGGSLARDVDVVPAVWWNNARYQNTGNEVDRGVAILNKRDNQRIYNTPFLHINYIESRCNTTLGGLRKSIRLLKNIKADAHEENIEINLSSFDIASIMYHADMGNLLKGHFYELAILSETQRWLDWLWHNFDEAKKLEVPDGTRKIFDTDEKKGELLKLSLQVDEILKAVHNEMNAIFHKDSIDEGMRDYLSNSKVD

SEQ ID NO: 1793 - protein, 375 aa, Klebsiella quasipneumoniae
MADNFSSRIERLKTRRKGINEIFAMDRGLESREILLAKSLQQEAWESMASGKSATRYALGAMQEVDPVYTRVSIETGKRIENQLSNRLEKKEISASFRLQGSVPLNIHIKGVSDVDILTIDEQLFIFSNEGSKANSYVLSKKKAVDVLQILREEIEDSLRAAFPAAKIDTENSKAVKITGGSLARDVDVVPAVWWNNARYQDTGNEVDRGVAILNKRDNQRIYNTPFLHINYIESRCNTTLGGLRKSIRLLKNIKADAHEENIEINLSSFDIASIMYHADMGNLLKGHFYELAILSETQRWLDWLWHNFDEAKKLEVPDGTRKIFDTDEKKGELLKLSLQVDEILKAVHNEMNAIFHKDSIDEGMRDYLSNSKVD

SEQ ID NO: 1794 - protein, 374 aa, Pectobacterium carotovorum
MAANYANRIERLKLRRKGINEIYAMDSADESRNILLEKSQQQESWESRASGKSATKYALGAMQEVDPVYTRVSYETGDRIKNQLSRRLEGKGITASFRLQGSVPLNIHIKGVSDVDLLAIDEEIFMSDKNGIKYSSYIPSSKNCVHVIRSLRNEIEDSLASAFPAATIHTDNAKSVKITGGSLARDVDVVPAIWWNNAKYQSSDREVDRGVTILNKKTAELIYNTPFLHVELITSRCDLTFGGLRKSIRMLKNIKADAEAESIQIGLSSFDITSIMYHANLNNLQQGRYYELAILVETQRWLDWLWHNYEAAQKLDVPDETRKIFDNAEKKNELAKLSLQVDKLVLAVANEFNRISNNDIVDDNIRNYVSKSSA

SEQ ID NO: 1795 - protein, 350 aa, Pantoea sp.
MDSADESRHILLKKSHQQESWESRASGKSATKYALGAMQEVDPVYTRVSNETGDRIKNQLSKRLEGKGIIASFRLQGSVPLNIHIKGVSDVDLLAIDEEIFMADTNGIKNSSYIPSSKNSLHVIQSLRNEIEDSLASAFPAATIHTDNAKSVKITGGSLARDVDVVPAIWWNNINYQSSDREVDRGVTILNKRTPELIYNTPFLHIELITKRCDFTFGGLRKSIRMLKNIKADAEAESIEIGLSSFDIASIMYHANLNNLQQGLYYELAILVETQRWLNWLWHNYEAAQELDVPDKTRKIFDNAEKKDELAKLSLQVDRLLLAVANEFNRIFNNDIVDDNLRNYVSKSSA

SEQ ID NO: 1796 - protein, 375 aa, Serratia proteamaculans
MSSNYSSKVERLKSRRKGSNSIPTMDSMLESTRRLYLKSLQAEAWESRASNKSATRYAIGAMQEVDQDYTRISIETSERIENQLSKRLTTKNFNTVFRLQGSVPLNIHIKGVSDVDLLAIEQQVLRYDQTGTRAGSYEPASRDTRDVVRELRQEVETALADAFPAAHVECDNAKSVKITGGSLSRDVDVVPSVWWDTETYQRSGQEHDRGVAILNIKTNEHIYNTPFLHIKLIKELCDESLGGLRKSIRLLKNIRADAEEDGRSIELSSFDIAAMMYHCDINNLKQGFYYELAILSETQRWLDFLWHNFDYAKTLHVPDKTRLIFDKDSKKDELLSLSILVDELTREIAKEMDSSMNESVGMDQVRIYLSRSTVS

SEQ ID NO: 1797 - protein, 374 aa, Yersinia kristensenii
MATTFDNRINRLKSRRKGYTAIAGMDSMLESKQVLLNKSQQQEVWENRATGKNATRYALGAMQEVDPTYTRISIETAERIENQLKNRLSAQGIDAEFRLQGSVPLNIHIKGVSDVDLLAIDSQMFVYDNSGLKASTYTPTTSSSIAVLKNLRHEAEIALTSAFPAATVRKDNAKSIKVTGGSLSRDVDVVPSIWWNTEYYQQTNLESDRGVAILDKTIPEKILNTPFLHIKLITERCNITYGGLRKSIRMLKNIKADSEEEGTKINLSSFDIAAAMYHANDTNLQLGSYYELAILAETQRWLDYLYNNFEYAKTLDVPDGTRKIFNDEKKNGLLFLSLQVDDLLREVGQEISPYFTSETNIQQVRDIIKTIKVE

SEQ ID NO: 1798 - protein, 382 aa, Pectobacterium carotovorum
MANYSDRIQRLKNRRKGSSEQLRVVKDSALTKSQAGLENYTLLEGVIAGVEGWESRATADSATRYAIGAMQSVDTRYTEICIETAKRIENQLSNKLTNLGYTLEFELQGSVPLDIHIKGFSDVDILVIDQEMLRYARDGIRASSYTPTTKDSVSILRCLRIDSKRELELAFPKTFVDDSGSKSLRITGGSLQREVDVVPAIWWDTVQYQQTMEDSDRGVAILDIVKNDHIYNSPFVHIKRIREKCDASNGGLRKSIRLLKNIKADSEAEGQIIDISSYDIASIMYHADAKNLSHNEYYELAVLGETQRWLNSLLNNKDHASQLEVPNGTRKIFENTSQFIELKKLAVLVDTLVDQILEERNLTDTLQRNLTISQLLSMNSVY

SEQ ID NO: 1799 - protein, 313 aa, Pectobacterium carotovorum
MQSVDTRYTEICIETAKRIENQLSNKLTNLGYTLEFELQGSVPLDIHIKGFSDVDILVIDQEMLRYARDGIRASSYTPTTKDSVSILRCLRIDSKRELELAFPKTFVDDSGSKSLRITGGSLQREVDVVPAIWWDTVQYQQTMEDSDRGVAILDIVKNDHIYNSPFVHIKRIREKCDASNGGLRKSIRLLKNIKADSEAEGQIIDISSYDIASIMYHADAKNLSHNEYYELAVLGETQRWLNSLLNNKDHASQLEVPNGTRKIFENTSQFIELKKLAVLVDTLVDQILEERNLTDTLQRNLTISQLLSMNSVY

SEQ ID NO: 1800 - protein, 383 aa, Enterobacter ludwigii
MSSSTFSDRIQRMKKRRKGSPEQVKVAMESYSGVAMDGLESYEILANVLSSQEEWERRGRGDNATRYVIGAMQSVETQYTEVSLNTAKRIENQLEKRLSEYNLDFRLQGSVALDIHIKGFSDVDLLVIDKQMLMYDRDGVRQSLYTPTSKKEDDVILTLRNTARDELRKAFPEAYVDDENNKSLRITGGSLQREVDVVPAIWWDNIDYQLSQEESDRGVMILQRDERKRIYNSPFVHIKRIESKCDRSNGGLRKSIRLLKTIKSDFQDEEGTEIGLNSYDLTSIMYHADENNLRHNAYYELAVLVETHRWLNYLCSHPIEAKKLDVPNGTRKIFEDDNSLNELMKLTNVVNNLVNEVMNEHIGNFGRQLALNESELLKGIQVL

SEQ ID NO: 1801 - protein, 383 aa, Serratia marcescens
MSSSTFSDRIQRMKKRRKGSPEQVKVAMESYSGIAMDGLESYDILESVLSSQEEWESRGRGDNATRYVIGAMQPVEPQYTEVSLNTAKRIENQLEKRLSEYQLDFRLQGSVALDIHIKGFSDVDLLVIDKQMLMYDRDGVRQNLYTPTSKKEDDVILTLRNTARDELRKAFPEAHVDDENNKSLRITGGSLQREVDVVPAIWWDNSDYQLSQEESDRGIMILHRDKRKRIYNSPFVHIKRIASKCDRSNGGLRKSIRLLKTVKSDFQDEEGTEIALNSYDITSIMYHADENNLRHNAYYELAVLVETHRWLNYLCSHHDEAKKLDVPNGTRKIFEDDVSLNELMKLTSVVNNLVNEVINEHIGNFGRQLALNESALLKGIQVF

SEQ ID NO: 1802 - protein, 383 aa, Pectobacterium carotovorum
MSSSTFSDRIQRMKKRRKGSTERVKIAMESYHGIAMDGLESYDILESVFSTPEEWEYRGRGDNATRYVIGAMQPVEPQYTEVSLKTAKRIENQLEKRLSEHQLDFRLQGSVALDIHIKGFSDVDLLVIDKQMLMYDRDGVRQNLYTPTSKKADDVILILRNTARDELRKAFPEADVDDENNKSLRITGGSLQREVDVVPAIWWDNSDYQLSQEESDRGVMILHRDKRERIYNSPFVHIKRIESKCNRSNGGLRKSIRLLKTVKSDLQDEEGTEIGLNSYDITSIMYHADENNLRHNAYYELAVLVETHRWLNYLCSHPDEAKELDVPNGTRKIFEDDASLNELNKLTGVINSLVNDVMNEHTGNFGRQLAVNESALLKGIQVP

SEQ ID NO: 1803 - protein, 382 aa, Escherichia coli
MSSSTFSDRIQRMKKRRKGSPEQVKVAMESYRGMAMDGLESYDVLKSVLSSQEEWERRGKGDNATRYVIGAMQPVESQYTDVSVKTAKRIENQLEKRLSEHQLDFRLQGSVALDIHIKGFSDVDLLVIDKQMLMYDRGGVRQHLYTPTTKNEDDVILILRNMARDELKKAFPEADVDDENNKSLRITGGSLQREVDVVPAIWWDSSDYQVTQEESDRGVMILHREKRERIYNSPFVHIKRIESKCNRSNGGLRKSIRLLKTVKADCKDEGTEIGLNSYDITSIMYHADENNLRHSAYYELAVLVETHRWLNYLCAHPDEAKKMDVPNGTRKIFEDDASLNELFKLTDVINNLVAEVMNELSGDFGRRLTVNESELLKSHRVL

SEQ ID NO: 1804 - protein, 379 aa, Escherichia coli
MSNSSYSSRIERMKSRRKGTYDQLRVATESMSNQRYDGLEKYALLEDALELNESWESRGRDDSAIRYVIGAMQPVDPRYTEISFETAYRIENQLTKKLDLNLDFRVQGSVPLDIHIKGFSDVDLLIIDTQMLMYDSGGVGSYSAAEKDGRDVIIELRRAARDALKMTFPAAQVDDNNAKSLRITGGSLQREVDVVPGIWWDTKEYQLTKKEEHRGVTIIDKNKRERIYNEPFLHMQRIKDKCDQCNGGLRKSIRMLKTLKADSGDEGSSIDLSSYDIASLMYHADANNLRHSTYYELAVLVETHRWLNHLAQDHDAAMQLDVPNGTRKIFEKPNSYGEFLKLTGILNNLVTEVLREVTGNSTEYYSNARGDLLRKQVVF

SEQ ID NO: 1805 - protein, 378 aa, Unknown
  Description of Unknown: Enterobacteriaceae sequence
MSNSFSARIERMKSRRKGTFDQLNVARESISNQRIDGLENYALLEGFLDLNESWETRGKQDSATRYVIGAMQPVDNRYTEISFETAKRIENQLVKKLDLNLEFRVQGSVPLDIHIKSFSDVDLLIIDTQMLIYDSDGIGRYTPTNKNDGDIILELRDATRDALKATFPAADVDDNNAKSLRITGGSLQREVDVVPSIWWDTKEYQHTKDVDQRGVTIIDKNTRQRIYNLPFLHIKRIKDKCDQCNGGLRKSIRFLKTLKADSEAEGTKIELSSYDIASLMYHADGNNLRHSQYYELAVLVETHRWLNYLAQNPNAAMLLYVPNGTRKIIDKNETFAELLKLTGMVNSIVTEVLREITGQPTEYYTPAKGILLIKQAVY

SEQ ID NO: 1806 - protein, 370 aa, Acinetobacter haemolyticus
MSSEVILSYQVHHYRLEKRRKGTDLTYNAFDSVTAGVTSFNEFDELKRTIEKWQIVSDKPSIRYAVGAMQEVSKRYTEISIETAKRIEKQLEPRLLNNHNIVTEYRLQGSVPLNIHIKGVSDVDLLVLNKSHYRTEGYLGTLRHDDIKILRELRNACTYELRQAYPAVTIDTTGAKSITLTGGSLPRDVDVVPSHWVETYEYQQQKHLYLRGVNILDNKTPTTLMNLPFKHIFYIDYKCKYYADGGLKKSIRLCKTIKADLVEEGKVIYLSSFDLASIMYHSNLENLKKGRTNALAIVLETKRFFDYLYHNPNYRNSLYTPDMTRKIFDSYQKETSLTTMSIALDKLVTEIRKDLGYLYDETIGSYPLVI

SEQ ID NO: 1807 - protein, 365 aa, Acinetobacter haemolyticus
MLSYQVHHYRLEKRRKGTDLTYNAFDSVTAGVTSFNEFDELKRTIEKWQIVSDKPSIRYAVGAMQEVSKRYTEISIETAKRIEKQLEPRLLNNHNIVTEYRLQGSVPLNIHIKGVSDVDLLVLNKSHYRTEGYLGTLRHDDIKILRELRNACTYELRQAYPAVTIDTTGAKSITLTGGSLPRDVDVVPSHWVETYEYQQQKHLYLRGVNILDNKTPTTLMNLPFKHIFYIDYKCKYYADGGLKKSIRLCKTIKADLVEEGKVIYLSSFDLASIMYHSNLENLKKGRTNALAIVLETKRFFDYLYHNPNYRNSLYTPDMTRKIFDSYQKETSLTTMSIALDKLVTEIRKDLGYLYDETIGSYPLVI

SEQ ID NO: 1808 - protein, 302 aa, Acinetobacter sp.
MSEIDFYKRLNRLEKRRKGTDLTYNAFDSVTAGVTSFNEFDELKRTIEKWQIVSDKPSIRYAVGAMQEVSKRYTEISIETAKRIEKQLEPRLLNNHNIVTEYRLQGSVPLNIHIKGVSDVDLLVLNKSHYRTEGYLGTLRHDDIKILRELRNACTYELRQAYPAVTIDTTGAKSITLTGGSLPRDVDVVPSHWVETYEYQQQKHLYLRGVNILDNKTPTTLMNLPFKHIFYIDYKCKYYADGGLKKSIRLCKTIKADLVEEGKVIYLSSFDLASIMYHSNLENLKKGRTNALAIVLETKRFF

SEQ ID NO: 1809 - protein, 367 aa, Unknown
  Description of Unknown: Acinetobacter sequence
MSEIDFYKRLNRLEKRRKGTDLTYNAFDSVTAGVTSFNEFDELKRTIEKWQIVSDKPSIRYAVGAMQEVSKRYTEISIETAKRIEKQLEPRLLNNHNIVTEYRLQGSVPLNIHIKGVSDVDLLVLNKSHYRTEGYLGTLRHDDIKILRELRNACTYELRQAYPAVTIDTTGAKSITLTGGSLPRDVDVVPSHWVETYEYQQQKHLYLRGVNILDNKTPTTLMNLPFKHIFYIDYKCKYYADGGLKKSIRLCKTIKADLVEEGKVIYLSSFDLASIMYHSNLENLKKGRTNALAIVLETKRFFDYLYHNPNYRNSLYTPDMTRKIFDSYQKETSLTTMSIALDKLVTEIRKDLGYLYDETIGSYPLVI

SEQ ID NO: 1810 - protein, 367 aa, Acinetobacter baumannii
MSEIDFYKRLNRLEKRRKGTDLTYNAFDSVTAGVTSFNEFDELKRTIEKWQIVSDKPSIRYAVGAMQEVSKRYTEISIETAKRIEKQLEPRLLNNHNIVTEYRLQGSVPLNIHIKGVSDVDLLVLNKSHYRTEGYLGTLRHDDIKILRELRNACTYELRQAYPAVTIDTTGAKSITLTGGSLPRDVDVVPSHWVETYEYQQQKHLYLRGVNILDNKTPTTLMNLPFKHIFYIDYKCKYYADGGLKKSIRLCKTIKADLVEEGKVIYLSSFDLASIMYHSNLENLKKGRTNALAIVLETKRFFDYLYHNPNYRNSLCTPDMTRKIFDSYQKETSLTTMSIALDKLVTEIRKDLGYLYDETIGSYPLVI

SEQ ID NO: 1811 - protein, 367 aa, Acinetobacter nosocomialis
MSEIDFYKRLNRLEKRRKGTDLTYNAFDSVTAGVTSFNEFDELKRTIEKWQIVSDKPSIRYAVGAMQEVSKRYTEISIETAKRIEKQLEPRLLNNHNIVTEYRLQGSVPLNIHIKGVSDVDLLVLNKSHYRTEGYLVTLRHDDIKILRELRNACTYELRQAYPAVTIDTTGAKSITLTGGSLPRDVDVVPSHWVETYEYQQQKHLYLRGVNILDNKTPTTLMNLPFKHIFYIDYKCKYYADGGLKKSIRLCKTIKADLVEEGKVIYLSSFDLASIMYHSNLENLKKGRTNALAIVLETKRFFDYLYHNPNYRNSLYTPDMTRKIFDSYQKETSLTTMSIALDKLVTEIRKDLGYLYDETIGSYPLVI

SEQ ID NO: 1812 - protein, 364 aa, Acinetobacter pittii
MSEIDFYKRLNRLEKRRKGTDLTYNAFDSVTAGVTSFNEFDELKRTIEKWQIVSDKPSIRYAVGAMQEVSKRYTEISIETAKRIEKQLEPRLLNNHNIVTEYRLQGSVPLNIHIKGVSDVDLLVLNKSHYRTEGYLGTLRHDDIKILRELRNACTYELRQAYPAVTIDTTGAKSITLTGGSLPRDVDVVPSHWVETYEYQQQKHLYLRGVNILDNKTPTTLMNLPFKHIFYIDYKCKYYADGGLKKSIRLCKTIKADLVEEGKVIYLSSFDLASIMYHSNLENLKKGRTNALAIVLETKRFFDYLYHNPNYRNSLYTPDMTRKIFDSYQKETSLTTMSIALDKLVTEIRKDLGYLYDETIGSIH

SEQ ID NO: 1813 - protein, 336 aa, Acinetobacter baumannii
MSEIDFYNRLNRLEKRRKGTDLTYNAFDSVTAGVTSFNEFDELKRTIEKWQIVSDKPSIRYAVGAMQEVSKRYTEISIETAKRIEKQLEPRLLNNHNIVTEYRLQGSVPLNIHIKGVSDVDLLVLNKSHYRTEGYLGTLRHDDIKILRELRNACTYELRQAYPAVTIDTTGAKSITLTGGSLPRDVDVVPSHWVETYEYQQQKHLYLRGVNILDNKTPTTLMNLPFKHIFYIDYKCKYYAEGGLKKSIRLCKTIKADLVEEGKVIYLSSFDLASIMYHSNLENLKKGRTNALAIVLETKRFFDYLYHNPNYRNSLYTPDMTRKIFDSYQKEVDQEI

SEQ ID NO: 1814 - protein, 290 aa, Acinetobacter sp.
IETAKRIEKQLEPRLLNNHNIVTEYRLQGSVPLNIHIKGVSDVDLLVLNKSHYRTEGYLGTLRHDDIKILRELRNACTYELRQAYPAVTIDTTGAKSITLTGGSLPRDVDVVPSHWVETYEYQQQKHLYLRGVNILDNKTPTTLMNLPFKHIFYIDYKCKYYADGGLKKSIRLCKTIKADLVEEGKVIYLSSFDLASIMYHSNLENLKKGRTNALAIVLETKRFFDYLYHNPNYRNSLYTPDMTRKIFDSYQKETSLTTMSIALDKLVTEIRKDLGYLYDETIGSYPLVI

SEQ ID NO: 1815 - protein, 283 aa, Acinetobacter sp.
MKQLEPRLLNNHNIVTEYRLQGSVPLNIHIKGVSDVDLLVLNKSHYRTEGYLGTLRHDDIKILRELRNACTYELRQAYPAVTIDTTGAKSITLTGGSLPRDVDVVPSHWVETYEYQQQKHLYLRGVNILDNKTPTTLMNLPFKHIFYIDYKCKYYAEGGLKKSIRLCKTIKADLVEEGKVIYLSSFDLASIMYHSNLENLKKGRTNALAIVLETKRFFDYLYHNPNYRNSLYTPDMTRKIFDSYQKETSLTTMSIALDKLVTEIRKDLGYLYDETIGSYPLVI

SEQ ID NO: 1816 - protein, 367 aa, Unknown
  Description of Unknown: Acinetobacter sequence
MSDIDFYKRLNRLEKRRKGTDLSYNMFDSINEGVTSYSEFDSLKNTVERWQTVSDKPSVRYAVGAMQEVSKRYTEISIETAQRIEKKLQPRLLNNHGITTEYKLQGSVPLNIHIKGVSDVDLLVINRLHYRSEGCLELFRAKDTKALKELRTACISELRQAYPAVAVDTTGAKSITLTGGSLPRDVDVVPSHWVETKEYEKEKHLYLRGINILDNKTPTTLMNLPFKHIYYIDIRCKYLTDGGLKKAIRLCKTIKADLVEEGKEIHLSSFDLASIMYHSNLDNLKKGKTYALAIVLETQRFFDYLYHNPNYRNGLYTPDWTRKIFDNPKKETSLTTMSVALDKLVTALREDLGYHYPNTLNLHPLTI

SEQ ID NO: 1817 - protein, 367 aa, Unknown
  Description of Unknown: Acinetobacter sequence
MSDIDFYKRLNRLEKRRKGTDLSYNMFDSINEGVTSYSEFDSLKNTVEKWQTVSDKPSVRYAVGAMQEVSKRYTEISIETAQRIEKKLQPRLLNNHGITTEYKLQGSVPLNIHIKGVSDVDLLVINRSHYRSEGCLELFRAEDTKALKELRSACISELRQAYPAVAVDTTGAKSITLTGGSLPRDVDVVPSHWVETKEYEKERHSYLRGINILDNKTPTTLMNLPFKHIYYIDIRCKYLTDGGLKKAIRLCKTIKADLVEEGKEIHLSSFDLASIMYHSNLDNLKKGKTNALAIVLEAQRFFDYLYHNPNYRNGLYTPDWTRKIFDNPKKETSLTTMSVALDKLVTALREDLGYHYPSTLNLHPLTI

SEQ ID NO: 1818 - protein, 367 aa, Acinetobacter baumannii
MSDIDFYKRLNRLEKRRKGTDLTYNVFDSMSPGVTSSNEFDTLKYSIEKWQTISDKPSVRYAVGAMQEVGKRYTEISIETAKRIENQLHSRLLNNHGIKTEYRLQGSVPLNIHIKGVSDVDLLVINKEHYRSEKYLNTLRSEDIRVLKELRRASVYELNKAYPAVSIDSTGAKSITLTGGSLPRDVDVVPSHWVETNEYEIQKQLYLRGVNILDNKTPTTLMNLPFKHINYIDSRCKYLTGGGLKKAIRLCKTIKADLVEEGHPIYLSSFDLASIMYHANVDNLKRGESFALAIVLETQRFFDYLYHYPHYRNVLYTPDNTRKIFDNSKKEASLLTMSVALDKLVTELRKDLGYIYDSTISHHPLVI

SEQ ID NO: 1819 - protein, 367 aa, Acinetobacter baumannii
MSDIDFYKRLNNLEKRRKGTDLTYKLFDSISSGITSSSEFDTLKSSIEKWQTISDKPSVRYAVGAMQEVGKRYTEISIETAKRIQNQLEPKLLSNHGIKSECRLQGSVPLNVHIKGVSDVDMLVINTDHYRSEKYLNTLRAEDVRILKQLRAACIYELNKAYPAVNIDTTGAKSITLTGGSLPRDVDVVPSHWIETNEYETHKQFHLRGVNILDNKTPTTLMNLPFKHIYRIDSRCKYLTGGGLKKAIRLCKTIKADLIEEGHSIYLNSFDLASIMYYANVENLKRGESFALAIVLETQRFFDYLHHHPHYRNSLYTPDYTRKIFDTSNKAASLTKMSIALDKLVTALRKDLGYMYDNTIGHHPLTI

SEQ ID NO: 1820 - protein, 366 aa, Acinetobacter indicus
MAKINFDDRLKRLEKRRKAKDLSYNLFDSIGTGVTSYSEFTSLQNKRELWENISTKPSIRYSIGAMQAVDQRYTEIGIETAKRIENQLKTRLTNHGLATEYKLQGSVPLDIHIKGVSDVDLLVIHKNHYRSEDCTTLLRNEDIKILQQLRNSSFHELKQAYPAVKIDNTGGKCISLTGGSLPRDVDVVPSHWVETNEYKNKGSEYLRGINVLDKKIPTTFLNLPFSHIYWIKLICQYLTEGSLRKSIRLCKTIKADLIDEGSKITLSSYDLASVMYHANRDNLKNSKNHSLGIVLETQRFLDYLYHNPNYAKSLDTPDGTRKIFDSADKLTSLTTLSIALDNLVSDLCQDLGFSSKESLKFFPLSI

SEQ ID NO: 1821 - protein, 366 aa, Acinetobacter lwoffii
MAKINFDDRLKRLEKRRKAKDLSYNLFDSIGTGVTSYSEFTSLQNKRELWENISTKPSIRYSIGAMQAVDQRYTEIGIETAKRIENQLKTRLTNHGLATEYKLQGSVPLDIHIKGVSDVDLLVIHKNHYRSEDCTTLLRNEDIKILQQLRNSSFHELKQAYPAVKIDNTGGKCISLTGGSLPRDVDVVPSHWVETNEYKNKGSEYLRGINVLDKKIPTTFLNLPFSHIYWIKLICQYLTEGSLRKSIRLCKTIKADLIDEGSKITLSSYDLASVMYHANRDNLKNSKNHSLGIVLETQRFLDYLYHNPNYAKSLDTPDGTRKIFDSADKLTSLTTLSIALDNLVSDLCQDLGFSSKESLNFFPLSI

SEQ ID NO: 1822 - protein, 370 aa, Acinetobacter baumannii
MATDYNSRIDRLKTRRRGLDKTIPSMESYAYDSVLQESFREIEQLKFKSESWETRSTTPIVNYVLGAMAEVDAKYTEISVKTAERIENQLYDRLKDKGIYTRYRLQGSVPLNIHIKGISDVDLLVIDNSIFTYDRYGPKVSTYTAASSTTKDVLKTLRAESIRSLSDAFPKVNVDTSGAKSIKLTGGSLARDVDVVPSTWNNTYNYQVTDNEEDRGINIYDSVKEEINFNLPFKHISLIKSKCMRNRGSLRKSIRLCKTLKADLIEEGRKIHLSSYDLAALMYHVKDNDLFDASKNDLLVLYMTQQHFDELYRNKETTLSLDTPDSTRKIIDKDEKFTSLLYLSCALDDLVSSVCESLGVSKENLRYLSV

SEQ ID NO: 1823 - protein, 345 aa, Acinetobacter baumannii
MESYAYDSVLQESFREIEQLKFKSESWETRSTTPIVNYVLGAMAEVDAKYTEISVKTAERIENQLYDRLKDKGIYTRYRLQGSVPLNIHIKGISDVDLLVIDNSIFTYDRYGPKVSTYTAASSTTKDVLKTLRAESIRSLSDAFPKVNVDTSGAKSIKLTGGSLARDVDVVPSTWNNTYNYQVTDNEEDRGINIYDSVKEEINFNLPFKHISLIKSKCMRNRGSLRKSIRLCKTLKADLIEEGRKIHLSSYDLAALMYHVKDNDLFDASKNDLLVLYMTQQHFDELYRNKETTLSLDTPDSTRKIIDKDEKFTSLLYLSCALDDLVSSVCESLGVSKENLRYLSV

SEQ ID NO: 1824 - protein, 334 aa, Acinetobacter baumannii
ESFREIEQLKFKSESWETRSTTPIVNYVLGAMAEVDAKYTEISVKTAERIENQLYDRLKDKGIYTRYRLQGSVPLNIHIKGISDVDLLVIDNSIFTYDRYGPKVSTYTAASSTTKDVLKTLRAESIRSLSDAFPKVNVDTSGAKSIKLTGGSLARDVDVVPSTWNNTYNYQVTDNEEDRGINIYDSVKEEINFNLPFKHISLIKSKCMRNRGSLRKSIRLCKTLKADLIEEGRKIHLSSYDLAALMYHVKDNDLFDASKNDLLVLYMTQQHFDELYRNKETTLSLDTPDSTRKIIDKDEKFTSLLYLSCALDDLVSSVCESLGVSKENLRYLSV

SEQ ID NO: 1825 - protein, 313 aa, Paucibacter sp.
MQAVSDTYTKVSKETAFRVANQLKDRLAKRGIVAEFELQGSVPLDVHIKGVSDVDLLTLASELFSYDVKGFKALHGKYCNPAKRTALEVLIELRGHVETDLADAFSAAKVDKTGAKAVKISGGSLARDVDVVPAVWFDTAQYQLTGLASDRGTKILDKKASKTIENQPFRHIELIGARCDKIGGGLRKAIRLCKNIKADSDRNITLPSFDIASTMYHADMKALRLGSFYELSILAETQRHLDYLACNHGVAKTLYVPDGSRLIFDTNEKLRSLNDLSRDMDELLDAVYAEHTPAYLAQYLMSDKRQAISKLAA

SEQ ID NO: 1826 - protein, 373 aa, Paucibacter sp.
MARDINQRLQQLRTRRDGTGGTVNEGFTLDSLFAKSALPVELWESRGKADQPHTRYALGSMQAVSDTYTKVSKETAFRVANQLKDRLAKRGIVAEFELQGSVPLDVHIKGVSDVDLLTLASELFSYDVKGFKALHGKYCNPAKRTALEVLIELRGHVETDLADAFSAAKVDKTGAKAVKISGGSLARDVDVVPAVWFDTAQYQLTGLASDRGTKILDKKASKTIENQPFRHIELIGARCDKIGGGLRKAIRLCKNIKADSDRNITLPSFDIASTMYHADMKALRLGSFYELSILAETQRHLDYLACNHGVAKTLYVPDGSRLIFDTNEKLRSLNDLSRDMDELLDAVYAEHTPAYLAQYLMSDKRQAISKLAA

SEQ ID NO: 1827 - protein, 374 aa, Unknown
  Description of Unknown: Massilia sequence
MATDINKRLSQLRARRDGTDRMAIDESVRNEVLAKSLYPSVEPWEKRGKNDQPHTRYAIGAMQPVNSTYTRISRETADRVANQLSSRLAKAGITAEFRLQGSVPLDVHIRRVSDVDLLVIDLSHLVYQTTGVRARNGTYKPATSTSALVLSRLRQQVEADLPDAFPAATVDVEGAKAVKISGGSLPRSVDVVPAHWFDTVDYQATGQEVDRGVYIYNKNTGETIDNLPFLHIARVAARCDSIRGGLRKAIRLCKSVKADSDRDITLPSYDIAATMYHSDMAALWWGQHNDLAVLAETQRFLDLLARNDDLAKSLVVPDGSRKIFNSAEKLSGLLRLSIELDELLNKVYEENVPSLNAAALPFANKRAVVGTLSI

SEQ ID NO: 1828 - protein, 377 aa, Microvirgula aerodenitrificans
MASDIDSRLLQLRARRKGDPSVGTFSEAALAYNRQFAADALQVEDWETRGTSSQRWTRYAIGAMQAVGKKYTEVSEQTGERVASQLRDRLIKAGINAEFKLQGSVPLDVHIKRVSDVDVLAITKDFFTYDPTGAQALQGAYKYPTQRTSGGVLSSLRLQIESDLDDAFPAAKVDKTGAKAVKVSGGSLPRSVDVVPAHWYDTKEYQASGRQADRTVTIYNKQTGETIDNLPFLHIERVGSRCDNIGGGLRKAIRLCKNVKADSDRDIQLSSYDIAAIMYHANMNALLLGRYSDLAVLAETQRHLDALYQDPGAAGRLWVPDGSRIIFDAPEKHDWLRGLSIEMDQLLKNVFQENFPSIDSSIPSQGVQRECIKALTV

SEQ ID NO: 1829 - protein, 314 aa, Burkholderia ubonensis
MQAVGKKYTEVSKQTGERVAGQLRDRLAKAGIGAEFKLQGSVPLDVHIKRVSDVDVLAITTDFRIYDNTGLQALRGGYKNPSQRTSSGVLSSLRQQVESDLDDAFPVAKVDKTGAKAVKVSGGSLQRAVDVVPAHWYDTKEYQASGRQADRAVTIYNKKTGETIDNLPFLHIERVGSRCGSINGGLRKAIRLCKSVKADSDRDIQLSSYDIAAIMYHADMSALRLGQYSDLAVLSETQRHLDALYRDSIAASRLRVPDGSRVIFDTSEKRAWLLQLSVEMDELLKNVYQENFPSLLSSGFSSGVQRDMVKGLKV

SEQ ID NO: 1830 - protein, 314 aa, Burkholderia ubonensis
MQAVGKKYTEVSKQTGERVAGQLRDRLAKAGIGAEFKLQGSVPLDVHIKRVSDVDVLAITTDFRIYDNTGLQALRGGYKNPSQRTSSGVLSSLRQQVESDLDDAFPVAKVDKTGAKAVKVSGGSLQRAVDVVPAHWYDTKEYQASGQQADRAVTIYNKKTGETIDNLPFLHIERVGSRCDSINGGLRKAIRLCKSVKADSDRDIQLSSYDIAAIMYHADMSALRLGQYSDLAVLSETQRHLDALYRDSIAASRLRVPDGSRVIFDTSEKRAWLLQLSVEMDELLKNVYQENFPSLLSSGFSSGVQRDMVKGLKV

SEQ ID NO: 1831 - protein, 377 aa, Burkholderia sp.
MTTDINKRLSQLRQRRTGSSFATESFSRADSVHAGITLDAAGPEPWETRGTSSQHWTKYALGAMTAVGKKYTDVSIANADRVADQLRDRLHAAGVSTEFKLQGSVPLDVHIRRVSDVDLLTILKNYSTFARSGIKARQGIYRSNTTETSEERLAGLRAQVELDLRAAFPAADVDISGGKAVKVSGASLQRSVDVVPAHWIDTEAYQSSGREEDRGVKIYDKKTGETISNRPFLHIARVGGRCDSIKGGLRKAIRLCKSMKADSDREIKLSSFDIASLMYHADMSALRLGQFTDLAVLAETQRHLDAACKDRDWAGKLLVPDGGRRIFDSQEKWRWLLNLSLEIDDLLSNVYREVVPGQRDPNRLLSEKRNVVKATSI

SEQ ID NO: 1832 - protein, 377 aa, Burkholderia cenocepacia
MTTDINKRLSQLRQRRTGSSFAMESFSRADSVHAGITLDAAGPEPWETRGTSSQHWTKYALGAMTAVGKKYTDVSIANADRVADQLRDRLHAAGVSTEFKLQGSVPLDVHIRRVSDVDLLTILKNYSTFARSGIKARQGIYRSNTTETSEERLAGLRAQVELDLRAAFPAADVDISGGKAVKVSGASLQRSVDVVPAHWIDTEAYQSSGREEDRGVKIYDKKTGETISNRPFLHIARVGGRCDSIKGGLRKAIRLCKSMKADSDREIKLSSFDIASLMYHADMSALRLGQFTDLAVLAETQRHLDAACKDRDWAGKLLVPDGGRRIFDSQEKWRWLLNLSLEIDDLLSNVYREVVPGQRDPNRLLSEKRNVVKATSI

SEQ ID NO: 1833 - protein, 358 aa, Limnohabitans sp.
MVASIDKRLQQLRVRRDGSVQTLLTAPKPETWESRGRSNQPSTRYALGAMQAVSADYTRVSIETANRITNQLSKAGLNVEFRLQGSVPLDVHIKGISDVDLLALEKRFLTYHTAGTKAKRGYYKYPAPRTSVEALLALRGQIEPALRAAFPSANVDMKGSKAVKISGGSLARSVDVVPSHWLDTISYQDSDDEIDRGVYVLDLKKMATVENHPFLHIALIKYRCDQVSGGLRKAIRLCKNVKADSDSTISLPSFDISAVMYHANLEALKVGRLFELSILSETQRHLDNLACNHDLARTLLVPDGSRKIFDTTEKLQGLNELSKDMDELLKSVYAENTTNQLATGSLNDMRNLVCYLTA

SEQ ID NO: 1834 - protein, 371 aa, Stenotrophomonas maltophilia
MARTVDQRIAALKARRSGEDRVNLMAQDSAALAKYIEKIWKQETWETKATSKPNTRYVLGAMQEVDADYTRISIETALRVAKQLGNRIERFTLEFHLQGSVPLNVHIRGVSDVDLLTLISSQFLSYDPSGPRGTSGAYYPTTLTSLQQLKDLRAQEEPALESAFPAATVDKHGSKAIKISGGSLPRSIDVVPSHWYDSADYQRSGAFHDRGVIILDKKNNVTMTNYPFKHIKEVSDRDLVAMGSLKKAIRLIKNIKADADQDIMLTSFDLAAIMFHADMAALRTGHSYELAILAETQRHLDDLYHRPDYAKLLLVPDGTRVIFDSPTKWSSLLTLSCEVDRLLEAVANENSIGLPANNHSERRQLIRSVHL

SEQ ID NO: 1835 - protein, 371 aa, Stenotrophomonas maltophilia
MARTVDQRIAALKARRSGEDRVNLMAQDSAALAKYIEKIWKQEAWETKATSKPNTRYVLGAMQEVDADYTRISIETALRVAKQLGNRIERFTLEFHLQGSVPLNVHIRGVSDVDLLTLISSQFLSYDPSGPRGTSGAYYPTTLTSLQQLKDLRAQEESELESAFPAATVDKRGSKAIKISGGSLPRSIDVVPSHWYDSADYQRSGAFHDRGVIILDKKNNATMTNYPFKHIKEVSDRDLVAMGSLKKAIRLIKNIKADADQDIMLTSFDLAAIMFHADMAALRTGHSYELAVLAETQRHLDDLYHRPDYAKLLLVPDGTRVIFDSPAKWSSLLTLSCEVDRLLEAVANENSIGLPANNHSERRQLIRSVHL

SEQ ID NO: 1836 - protein, 347 aa, Stenotrophomonas maltophilia
MAQDSAALAKYIEKIWKQEAWETKATSKPNTRYVLGAMQEVDADYTRISIETALRVAKQLGNRIERFTLEFHLQGSVPLNVHIRGVSDVDLLTLISSQFLSYDPSGPRGTSGAYYPTTLTSLQQLKDLRAQEESELESAFPAATVDKRGSKAIKISGGSLPRSIDVVPSHWYDSADYQRSGAFHDRGVIILDKKNNATMTNYPFKHIKEVSDRDLVAMGSLKKAIRLIKNIKADADQDIMLTSFDLAAIMFHADMAALRTGHSYELAVLAETQRHLDDLYHRPDYAKLLLVPDGTRVIFDSPAKWSSLLTLSCEVDRLLEAVANENSIGLPANNHSERRQLIRSVHL

SEQ ID NO: 1837 - protein, 347 aa, Stenotrophomonas maltophilia
MAQDSAALAKYIEKIWKQETWETKATSKPNTRYVLGAMQEVDADYTRISIETALRVAKQLGNRIERFTLEFHLQGSVPLNVHIRGVSDVDLLTLISSQFLSYDPSGPRGTSGAYYPTTLTSLQQLKDLRAQEEPALESAFPAATVDKHGSKAIKISGGSLPRSIDVVPSHWYDSADYQRSGAFHDRGVIILDKKNNVTMTNYPFKHIKEVSDRDLVAMGSLKKAIRLIKNIKADADQDIMLTSFDLAAIMFHADMAALRTGHSYELAILAETQRHLDDLYHRPDYAKLLLVPDGTRVIFDSPTKWSSLLTLSCEVDRLLEAVANENSIGLPANNHSERRQLIRSVHL

SEQ ID NO: 1838 - protein, 371 aa, Stenotrophomonas maltophilia
MARTVDERISALRARRRGEDRASLMAQDSVAVAKYVEKIGQKEAWETKATSKPNTRYVLGAMQEVDADYTRISTETALRVAKQVENRIAGFGLEFHLQGSVPLNVHIRGVSDVDLLTLISAQFLSYDPGGLRATSGAYYPTALTSLQQLKDLRAEEEPALEDAFPAATVDKQGSKAIKISGGSLARSVDVVPSHWYDSADYQRSGALHDRGVIILDKKNNVTMTNYPFKHIREVSDRDLVAMGSLKKAIRLIKNIKADADQDIALPSFDLAAIMFHADMDALRNGHWYELAILAETQRHLDDLYHRPDYSKLLLVPDGTRVIFDSPAKWSALLTLSCEVDRLLEAVANENSIGLPANNHGDRRQLIKSVSL

SEQ ID NO: 1839 - protein, 347 aa, Unknown
  Description of Unknown: Stenotrophomonas sequence
MAQDSVAVAKYVEKIGQKEAWETKATSKPNTRYVLGAMQEVDADYTRISTETALRVAKQVENRIAGFGLEFHLQGSVPLNVHIRGVSDVDLLTLISAQFLSYDPGGLRATSGAYYPTALTSLQQLKDLRAEEEPALEDAFPAATVDKQGSKAIKISGGSLARSVDVVPSHWYDSADYQRSGALHDRGVIILDKKNNVTMTNYPFKHIREVSDRDLVAMGSLKKAIRLIKNIKADADQDIALPSFDLAAIMFHADMDALRNGHWYELAILAETQRHLDDLYHRPDYSKLLLVPDGTRVIFDSPAKWSALLTLSCEVDRLLEAVANENSIGLPANNHGDRRQLIKSVSL

SEQ ID NO: 1840 - protein, 371 aa, Stenotrophomonas maltophilia
MARTVDERISALKARRRGEDRVGLMAQDSAAMAKYVEKIWQQEAWETRATTKPNTRYVLGAMQEVDADYTRISTETALRVAKQLGNRIEQFKLEFHLQGSVPLNVHIRGVSDVDLLTLISSQFLSYDPGGLRAASGSYYPTALTSLQQLRDLRAQEEPALERAFPAATVDKQGSKAIKISGGSLPRSVDVVPSHWYDSADYQRTGALHDRGVIILDKKNNVTMTNYPFKHIKEVSDRDLVAMGSLKKAIRLIKNIKADADRDIALPSFDLAAIMFHADIAALRTGHSYELAILAETQRHLDDLYHRPDYAKLLLVPDGTRVIFDSPAKWSALLTLSCEVDRLLEAVANENSIGLPANNHGDRRQLVKSIRL

SEQ ID NO: 1841 - protein, 371 aa, Stenotrophomonas maltophilia
MARTVDERISALRARRRGEDRASLMAEDSAAAAKYFEKIGQQEAWETKAANKPNTRYALGAMQEVDADYTRISTETALRVAKQLESRIAGFKLEFHLQGSVPLNVHIRGVSDVDLLTLISPQFLSYDPGGLRATSGAYYPTALTSLQQLKDLRAEEEPALKNAFPAATVETRGSKAIKISGGSLARSVDVVPSHWYDSADYQRSGALHDRGVIILDKRNNATMTNYPFKHIREVSDRDLVAMGSLKKAIRLIKNLKADADREIALPSFDLAAIMFHADMNALRNGHWYELAILAETQRHLDHLYHHPDYAKLLLVPDGTRAIFDSPAKWSSLLTLSCEVDRLLEAVANENSIGLPPNDHSERRKLVKSVSL

SEQ ID NO: 1842 - protein, 371 aa, Stenotrophomonas maltophilia
MARTVNDRLSALKSRRRGDDRLDLLAQDSAALADYFGKIAKQESWETKAADKPNTRYALGAMQEVDADYTRISTETAMRVANQLEKRIAGFNLEFHLQGSVPLNVHIRGVSDVDLLTLITAQFLSYDPCGLRASSGAYYPTTLTSLQQLKDLRAEEEPALKNAFRAATVDTQGSKAIKISGGSLARSVDVVPSHWYDSADYQRSGALHDRGVIILDRKANATMTNYPFKHIKEVSDRDLVAMGSLKKAIRLIKNIKADADRDIALPSFDLAGIMFHADMTALRNGYWYELAILAETQRHLDYLYHHPDYAKLLLVPDGTRLIFDSPAKFSALLTLSCEVDRLLEAVANENSIGLPANNDSDRRQLIQSLSF

SEQ ID NO: 1843 - protein, 371 aa, Xanthomonas fuscans
MAKTINERITALKSRRSGEDRFDLLVEDKAALANYIGKMLREEAWEKKASNKPNTRYALGAMQEVDADYTRISTETAMRVANQLEKRVKAFNLEFHLQGSVPLNVHIRGVSDVDLLTLINERFYNYDPNGIRALAGAYQPTQLTSLQELKDLRNEEELALRNAFQAAKVDTTGSKAIKISGGSLARSVDVVPSHWYETAAYQQSGAMHDRGVIILDKKTNSTMTNFPFKHIKQVSDRDNLTLGSLKKSIRLVKNVKADSDRTIALPSFDLAAIMFHANPTALRTGYTFELAILAETQRHLDYLYHHPDEAKLLDVPDGTRRIFDSQAKLDALFSLSVELDELLEAVANEHQDHQPAKTHYERRQLIEAVQL

SEQ ID NO: 1844 - protein, 373 aa, Pseudogulbenkiania sp.
MAADINKRLGQLRARRDGTDRMAMDSAVLAELMAKALHPSVEPWEKRGSAYQPHTRYAIGAMQPVSDSYTRVSVQTAERVINQLHDRLAQAGIDAEFRLQGSVPLDVHIRRVSDVDLLVIETSFLTYMTSGAMAQRGDYFPTTKTSGGVLSQLRVQVEADLDDAFPAANVDKTGAKAVKISGGSLQRSVDVVPSHWLDSVEYQSSRSEVDRGIKIYNKYTGQTIENFPFLHIALIKERCDAVGGGLRKAIRLCKSVKADADLDIQLPSFDIAATMYHANLNNLRMGQNFDLAVLAETQRFLDVLACNHEYAKTLRVPDGSRAIFDTNEKLQGLVNMSIEMDELLSNVYRENALGGGNAPSLVEMRSTVQALAI

SEQ ID NO: 1845 - protein, 376 aa, Achromobacter ruhlandii
MATDINKRLAQLRARRDGSDRLTMDSAVQNEILSKALGTGTQTIQESWEKRASIDSKHTLYALGAMQPVSATYTRVSVETAERIGNQLRSRLGKAGIDAEFRLQGSVPLDVHIRRVSDVDLLTIDTGFLVYSTSGVQSQAGYYLNTSKNSLSVLQTLRKQIEIELPLAFPQAIVDTTGAKAVKIHGGSLPRMVDVVPAHWYDTNDYQANRTESDRGIQILDKKAGISLTNFPFLHIRRIIDKCNNVGGGLRKAIRLCKNVKADAESEGNAISLPSFDIASMMYHADVGNLAFGQYFELMILAEAQRHLDVLARNNEYAETLMVPDGSRRIIDTPAKWRGLLSLSLEMDDLLRRVAAEHGVSGSLEDCRNAIRFLNQ

SEQ ID NO: 1846 - protein, 380 aa, Burkholderiales bacterium
MADIGKRLIQLRARRVGDDRPQRTALSAAQTLDVMAKSLYQSDEKWERNRQARPYTAYALGAMQEVGETYTRVSVEEAERVGKQLVPRLARRGIPAEYRLQGSVPLNVHIRRVSDVDLLLLDTSHRTYDRQGVMAASGAYLYQPARSSVSVLGSLRAGVVSSLREAFPAATVDSSGAKAVTVSGGSLQRVVDVVSSHWHDTIQYQSSRMERDRGVTILDSKKVTTIDNLPFLHIHRVGERCDGIFGGLRKSIRLCKQVKADMEMEGKTVSFPSFDIAATMYHADMGQLRMGLVYELAILAETQRFLDYLHHNKDYARTLVTPDGLRRIFDDPKKLDGLTQLSVEMDDLLKQVAREHGYGVSTYLSTEDLRTKLKLTNVEA

SEQ ID NO: 1847 - protein, 379 aa, Rhizobium leguminosarum
MARDIGKRLNQLHTRRSGVDRLGRLAQDAATEILQKSSREESWQKRARDQPYTRYCLGAMQEVDQDYTRISVETAERVGKQLLEGLQASNIPVEFRLQGSVPLNVHIRGVSDVDLLTLETSFLRYDSTGRMAQSGLYYPSNKSSLEVLSALRSESEKILKAKYPAATVDTSGGKAIAISGGSLPRPVDVVPSHWYDTADFQASELQRDRGVFILDKKVPTELSNFPFRHIHEINQQDLAAGAGLKKAIRLCKNVKNDAIEDGKKIVFPSFDIASTMYHCDLNGLRVGTFYELAVLAETQRFLDELYHNSEKAKSLLVPDGSRRIFDSDEKYEGLRTLSVEMDDLAKEVAKEQSILLKYGGTDPSLGDSRRVLNGTYVAS

SEQ ID NO: 1848 - protein, 377 aa, Methylobacterium sp.
MAQDINARLNRLKIRRRGMDRLGRLNETARAEILNDSVTDERWQKRANNQPNTRYVLGSMQEVGTEYTRISVETAERVGKQLKNGLMSAGYSVEFRLQGSVPLNVHIRGVSDVDLLNLEAGYHTYDRGGLRDLIGSYTSPDARNSVSVLWPLRKKSEEILISKFPAATVDTSGGKAIAISGGSLARPVDVVPSHWHDTFNYQRSGDERDRGIVLLDKKIPETIQNLSFLHIDRVNKQDTACNGGLKKAIRLCKNVKNDAVEEGKTIKFPSFDIAATMYHADRLALQAGHIYELAILAETQRFLDELYHDPVKAKSLYVPDGSKKIFDSNEKYDGLRTLSCEMDKLLKEVAKEQGTQLTGQDVLISHGRERLRKAYIL

SEQ ID NO: 1849 - protein, 379 aa, Rhizobium phaseoli
MATNINKRLDQLRTRRTGIDRAHRVAKDAAAEVLAKSRIDEAWQKRAKDQPYTRYCLGAMQAVDPDYTRISIETAERVGRQLLSNLHALGIPIELGIQGSVPLDVHIRGVSDVDLLVLETDFYTYNTRGVMSLGGQYRSPTQRTSLLVLGNLRTQSERILKDKFPAATVDTSGGKAIAMSGGSLARPVDVVPSHWHDTVEYQVSKLERDRGVTILDRKVPKTIDNLPFLHIYRINERDKSVFGGLKKAIRLCKNVKNDAIEEGRKINFPSFDIAATMYHADSAGFQAGIVNELAVLAETQRFLDELYHDEAKAKSLMVPDGSRHIFDNDDKYQGLRTLSYEMDELAKEVAKEQSPLLRISPQATILDTRKALRETYVPR

SEQ ID NO: 1850 - protein, 383 aa, Brevundimonas sp.
MPININDRLTRLNNRRKGMDRLGRLTEAAQLDVVRKSVHSEAWQRRASTGQPNTRYALGAMQEVDPDYTRISKETAERVAGQLKSGLTARGFTVDWRLQGSVPLNVHIRGVSDVDLLKLDTNFKTYTSWGAMSQAGRYTGTATAATSVGSLLNLRRESETILKAKYPAATVDCSGNKAIKIFGGSLARPVDVVPSHWFDNYDYQTSGQEHDRSVTILDKSVPTTIDNLPFLHIKKISDRCDHALGGVRKAIRLCKNVKNDAEEERGVKIALSSFDIGATIFHADLAALRVGASYELAILAEVQRHLDHLTMNESHAKTLRVPDGSRAIFDTPEKLSALRTLSVEMDELAKAVATEQGKVVMKSLGVSTYDARRILNEAYIPYL

SEQ ID NO: 1851 - protein, 321 aa, Bradyrhizobium sp.
MQEVGADYTRISVETAERVGVQLKADLASAGISADFRLQGSVPLNVHIRGVSDVDLLTLDTNFMTYSTTGVLSQQGQYSGAPTPRTSMSVLSALRSEAEKILKIKYPKATVDTSGGKAISISGGSLARPVDVVPSHWHDNHAYQVSRQEHDRTVTILNKKVPETIDNLPFLHIKRVGERCDSVFGGLRKAIRLCKNVRADAIDEGTAINFPSFDIASTMYHADMDALKMGIFYELRILGEVQRFLHLLYHDEAFAKTLRVPDNSRIIFDTNEKYAGMKRLSIEIDDLVKEVAKEQVPWLHTPEGQVLKTSRDAIWSVQVPS

SEQ ID NO: 1852 - protein, 380 aa, Mesorhizobium sp.
MAIDIEKRLRQLNTRRRGVDRLGRLSTAAQSDVLQKSISEESWQRRALTQPYTRYALGAMQEVGPDYTRVSIETAERVGKQLSEKLTAAGFAVVFRLQGSVPLNVHIRGVSDVDLLNLDADFYTYRLTGLKARLGHYTSPTPDTSIGRLTRLRKEAEKVLINAYPAADVDISGGKAIAISGGSLARPVDVVPSHWHDTDEYQSSGNERDRGVTILNKKVPETVDNLPFLHIGRVHDRDQNDAQGGLKKSIRLAKNVKNDAIEDGKYINLPSFDIAAIMYHANQAVLRTSVYYELAVLAETQRFLDYLWHNKDFARTLHVPDGSRRIFDKEEKFGGLLTLSSEMDDLARQVAREQSQKLRYQETIPLDESRNAISNVLVPG

SEQ ID NO: 1853 - protein, 380 aa, Mesorhizobium sp.
MPTDINKRLAQLKTRRRGTDRLGRLSEAAQSAIVAKSFGDEKWQTRAASQPFTRYALGAMEEVGPEYTRISIETAERVGKQLDEKLSAAGWTVEFRLQGSVPLNVHIRGVSDVDLLNLELGFFSYYVAGLKARSGHYTSPSQDKSVDRLLRLRKEAEKILIAAYPAADVDVSGGKAIAISGGSLARPVDVVPSHWVDTIDYQSSNIERDRGVTILNKKVPETIDNLPFLHIGRVHDRDQNEAHGGLKKAIRLCKNVKNDAIEDGKTVNLPSFDIAAIMYHADQAALRTGVFYELAVLAETQRFLDRLWQDKTFARTLSVPDGSRRIFDSESKFGGLLTLSLEMNELARQVAREQNLTLRYQESIPLEDSRKAISGVFVPG

SEQ ID NO: 1854 - protein, 380 aa, Mesorhizobium ciceri
MPTDINKRLAQLKTRRRGTDRLGRLSEAAQSAIVAKSFGDEKWQTRAASQPFTRYALGAMEEVGPEYTRISIETAERVGKQLDEKLSAAGWTVEFRLQGSVPLNVHIRGVSDVDLLNLELGFFSYYVAGLKARSGHYTSPSQDKSVDRLLRLRKEAEKILIAAYPAADVDVSGGKAIAISGGSLARPVDVVPSHWVDTIDYQSSNIERDRGVTILNKKVPETIDNLPFLHIGRVHDRDQNEAHGGLKKAIRLCKNVKNDAIEDGKTVNLPSFDIAAIMYHADQAALRTGVFYELAVLAETQRFLDRLWQDKTFARTLSVPDGSRRIFDSESKFGGLLTLSLEVNELARQVAREQNLTLRYQESIPLEDSRKAISGVFVPG

SEQ ID NO: 1855 - protein, 380 aa, Mesorhizobium sp.
MARDIEKRLRQLNTRRRGTDRLGRLSEAAKLDVLTKSFTDEAWQKRALSQPYTRYALGGMAEVGPEYTQKSIETAERVGKQLKDKLEANGRSVEFRLQGSVPLNVHIRGVSDVDLLNLEAYFLSYYVAGPRAIAGLYGSPGSESSVDRLLRLRKESERILIDAYPAADVDTTGGKAICISGGSLARPVDVVPSHWVDTIAYQSTQQLRDRGVTILNKKVPETIDNMPFLHIDRVHQRDLLEAGGGLKKAIRLAKNVKNDAIEDGKDVPLPSFDIAGIMYHANQSMLQTGRVYELAILSETQRFLEVLRNNRAFARTLDVPDGTRKIFDSDRKFVGLDVLSTEIDDLAREVAREQTAMIRQYDALPLEESRKAIEKAFVPG

SEQ ID NO: 1856 - protein, 380 aa, Sphingomonas wittichii
MARDISKRISRLQNRRTGMDRYIALDEAARVEVLAKSMTQERWQKRASTDKSYTRYALGAMQEVGADQTRISLDTAERIGRQLEQGFAANGRSVEFRLQGSVPLNVHIRRYSDVDLLTLDQGFLTYSNLGILAQQGRYVYPTEERSVERLLKLRRDAEEILKAAYPAAVVDTSGSKAINVSGGSLARPVDVVPSHWYDTVDWQLSQQEADRAVTILDKNVPRTLDNWPFRHIQKVTERCHMTLGGTRKAIRLAKSVKCDAEVDGVTIHLPSFDIAGLMYHADQTLLVAGARYELAILAETQRWLDQLSRNRAQADALRTPDNTRAIIDSPAKFNGLVNLSKEIDDLLVEVAKEQAPWIGLNPSFDSCRNVLLNLVIAEAA

SEQ ID NO: 1857 - protein, 378 aa, Variovorax sp.
MTSDISQRIQRLAARRRGTDRMVALDAADQIEILSKSLNEEGGWTKRAASQPFTRYTLGAMQEVGPDYTRVSLETAQRVRAQLDTRLHAAGFQVEFHVQGSVPANVHIRGVSDVDLLVLDRSFLTYDRGGLVSAQGGYKNPTTLSTETVLTRLRNNAETSLEAAFPRASIDKTGAKAIAISKGSLARPVDVVPSHWHDTIDYQQSRQMEDRGVTLWDRKARLAIENRPFRHIAKLGAQDRMTGGGLKKAIRLCKNVKADAIEDGKRIGFSSFDIAGAMYHASISALGAGIVYELAILAETQRHLDHLATDSAYARSLWTPDGTRRIFDNEDKLAGVRSLSIEMDALAQAVAREQSQVLVGRATPTWQEINEVLARSNV

SEQ ID NO: 1858 - protein, 379 aa, Alcaligenes faecalis
MARDIDKRLKSLHERRMGTDRIADLALDSATLVIAKSLTQESYAKRAIAQKHTKYALGAMQAVDPDYTRISLEEADRVKDQLKRGLDRKSISTEFRLQGSVACDIHIRGVSDVDLLVLDGRYIHYEPNGQKALLGGYTSPVPYNTLQALIQLRSESESILDAAFPAAKVEKVGAKAIKISGGSLRRPVDVIPSNWFDTAAYQRSSAEADRGVHILNKHVPERILNMPFRHIQQINDRDQRSIGGLKKAIRLCKNVKADAESEGTKIELSSYDIASALWHADIVALTVGMANELAILAEVTRFLDDLARRPNYACTLRVPDDSRYVFDSEAKIEGLRLLSLEMDDLSERVAREQSKDPGLWQTPSTGPVLEELRKSYVPG

SEQ ID NO: 1859 - protein, 377 aa, Ralstonia mannitolilytica
MARDIQQRLKSLEARRRGTDRRGMTFDAADQVLAKSLAQESYQVRGANKEFTKYALGSMQAVDPEYTRIGIEEATRVGKQLESGLAKLGIDVEFRLQGSVPCDIHIRGASDVDLLVLEGRYIRYEVDGPKAKRGEYRNPVSYNTLDALHGLRTHCEQILTDAYYAATVDTTGAKAINLSGGSLRRDVDVVPSNWFDTADYQATGLEVDRGVQILDKHSLVRVSNMPFRHIHRITMRDRECLGGLKKAIRLCKNVKADAAEEGTKIGLSSFDIASMLWHADQRALTVGVANELAILAEATRFLDYLARNHAEAKKLFVPDGSRIVFDTEEKLEALTLLSLELDDLSLKVTREQLSLLGQGVIPAQQINEALRKAYIPG

SEQ ID NO: 1860 - protein, 377 aa, Burkholderia territorii
MARDIYKRLKSLDARRRGTDRTGTIFDSAEQVVAKSAALESYQQRGAEKEFTKYALGSMQAVDPDYTRIGVQEATRIGQQLKTGLAKDGIGVEFRLQGSVPCDIHIRGASDVDLLVLEERYFHYDRTGPKAQRGEYGGPVPYDTLDALRSLRTRSEKILTDTYYAATVDTTGAKAIHLSGGSLRRDVDVVPSNWFDTVDYQKTGIEADRGVDILDKSVPARVRNMPFRHIQRITNRDRECGGGLKKAIRLCKNIKADAIDEGTAIRLSSFDIASMLWHADIRALTVGVAYELAILAEATRFLDFLSRNHAEAKKLYVPDGSRIVFDTAEKLEALNMLSLELDDLSLKVSREQAPFLGQGQVPLQQVNEALRRAYIPA

SEQ ID NO: 1861 - protein, 377 aa, Burkholderia territorii
MARDIYKRLKSLDARRRGTDRTGTIFDSAEQVVAKSAALESYQQRGAEKEFTKYALGSMQAVDPDYTRIGVQEATRIGQQLKTGLAKDGIGVEFRLQGSVPCDIHIRGASDVDLLVLEERYFHYDRTGPKAQRGEYGGPVPYDTLDALRSLRTRSEKILTDTYYAATVDTTGAKAIHLSGGSLRRDVDVVPSNWFDTVDYQKTGIEADRGVDILDKSVPARVRNMPFRHIQRITNRDRECGGGLKKAIRLCKNIKADAIDEGTAIRLSSFDIASMLWHADIRALTVGVAYELAILAEATRFLDYLSRNHAEAKKLYVPDGSRIVFDTAEKLEALNMLSLELDDLSLKVSREQAPFLGQGQVPLQQVNEALRRAYIPA

SEQ ID NO: 1862 - protein, 377 aa, Burkholderia territorii
MARDIYKRLKSLDARRRGTDRTGTIFDSAEQVVAKSAALESYQQRGAEKEFTKYALGSMQAVDPDYTRIGVQEATRIGQQLKTGLAKDGIGVEFRLQGSVPCDIHIRGASDVDLLVLEERYFHYDRTGPKAQRGEYGGPVPYDTLDALRSLRTRSEKILTDTYYAATVDTTGAKAIHLSGGSLRRDVDVVPSNWFDTVDYQKTGIEADRGVDILDKSVPARVRNMPFRHIQRISNRDRECGGGLKKAIRLCKNIKADAIDEGTAIRLSSFDIASMLWHADIRALTVGVAYELAILAEATRFLDYLSRNHAEAKKLYVPDGSRIVFDTAEKLEALNMLSLELDDLSLKVSREQAPFLGQGQVPLQQVNEALRRAYIPA

SEQ ID NO: 1863 - protein, 377 aa, Burkholderia ubonensis
MARDIQKRLKSLDARRRGTDRGGMTFDSAEQVLAKSAALESYQERGAEKEFTKYALGSMQAVDPDYTRVGVEEATRVGKQLKAGLEKLGIGVEFRLQGSVPCDIHIRGASDVDLLVLDERYIHYDSTGPKAQRGEYRNPVPYNTLDALRSLRTHSEKILTDAYYAANVDTTGAKAIHLSGGSLRRDIDVVPSNWFDTVDYQKTDLEADRGVDILDKNAPTRVRNMPFRHIQRITNRDRECGGGLKKAIRLCKNIKADAIDEGTAIRLSSFDIASMLWHADVRALTVGVAYELAILGEATRFLDYLARNHAEAKKLYVPDGSRIVFDTNEKLEALTLLSLELDDLSLKVSREQAPLLGQGQIPLQQINETLRKAYIPG

SEQ ID NO: 1864 - protein, 377 aa, Burkholderia cenocepacia
MTRDIQKRLKSLDARRRGIDRGGMIFDSAEQVLAKNAALESYQERGAEKEFTKYALGSMQAVGPDYTRVGIEEATRVGKQLEAGLEKLGIGVEFRLQGSVPCDIHIRGASDVDLLVLDERYIHYDRTGLKAQRGEYRNPVPYDTLDALRSLRKHSEKILTDAYYAANVDTTGAKAIHLSGGSLRRDVDIVPSNWFDTVDYQRTGLEADRGVDILDKQAPARVSNMPFRHIQRITERDKECGGGLKKAIRLCKNVKADAMDEGTVIRLSSFDIASMLWHADARALTVGVAYELAILGEATRFLDYLTRNHAEAKKLYVPDGSRIVFDTDEKLEALTLLSLELDDLSLKVSREQAPLLGQEKIPFQQINETLRKAYIPG

SEQ ID NO: 1865 - protein, 373 aa, Bosea vaviloviae
MPRSINDRLTNLRTRRKGLDRIDRLNDSAKLEISRHASLDEKWQRRALSQPYTRYSLGAMQAVDSTYTKKSIDEAERVSKQLHDGLAVVVETELQGSVPLDVHIRGVSDVDLLVLDGSFVTFQTSGAMARASLYGSAGGRTSLSALFFLRSEAEALLKRRYWGATVDCSGGKAISLSGGSFERPVDVVPAHWHDTEAYQASRQKHDRDVTILNKKVPETIANRPFKHIKLISDRDVAYLGGLKKAVRLVKNVKNDAENQNAANLPSFDIAALLYHADGAALRAGYINELSILAEAQRFFDWCYGNKDKARALRTPDGLRFILDSDAKMSALLSISVELDDLANQVAIEQGLMAKLGWSDVHRTLSNAYIPDAA

SEQ ID NO: 1866 - protein, 305 aa, Gluconobacter albidus
MPRDINARLEKLRIRRKGVDAVNSGWVTEGFAQDILQKSIIQEAWQRRAAAQPYTRYALGAMQAVDPAYTQKSIDEAERVAKQMRDGLSVSIETRLQGSVPLDIHIKGVSDVDLLVLLTGFHTYFTHGALALAGHYTNPTSETSLSALISLRRECEELLKRRYWGATVDCNGGKSIALSGGSFERPVDVVPSHWSDTIAYQSSLAENDRGVKILNKTVPETIDNLPFTHIKRVHDRDAAFYGSLKKAIRLVKSVKNDADYEETAAMLPSFDIASLMYHADETAMKAGFVNELEGSKNPLVLRSSV

SEQ ID NO: 1867 - protein, 377 aa, Gluconobacter oxydans
MPRDINARLEKLRIRRKGVDAVNSGWVTEGFAQDILQKSIIQEAWQRRAAAQPYTRYALGAMQAVDPAYTQKSIDEAERVAKQMRDGLSVSIETRLQGSVPLDIHIKGVSDVDLLVLLTGFHTYFTHGALALAGHYTNPTSETSLSALISLRRECEELLKRRYWGATVDCNGGKSIALSGGSFERPVDVVPSHWSDTIAYQSSLAENDRGVKILNKTVPETIDNLPFTHIKRVHDRDAAFYGSLKKAIRLVKSVKNDADYEETAAMLPSFDIASLMYHADETAMKAGFVNELYILKEAQRFFDWCWGNKSEASKLMTPDGSRAILNNEDKWTGLLTISTELDDLARQVAREQGLYTSSPTWNDVYSTLGNARVPTAN

SEQ ID NO: 1868 - protein, 376 aa, Unknown
  Description of Unknown: Erythrobacter sequence
MPRDINTRLENLRIRRKGVDAARSGRVTASVADEVLRKSVIQESWQRRATEQPYTRYALGAMQAVDPAYTQKSHDEADRVAKQLRSGLSIPIEMRLQGSVPLDVHIRGVSDVDLLVIRTDFLRYDTFGALATSGWYSPSSKTSLSVLRDLRIDCEELLKRRYWGADVDCDGGKCIALSGGSFERPVDVVPSHWHDTVDYQASRLEHERGVYILDKKIPDTFSNLPFKHIKRVNERDQSYFGGLKKAIRLVKNVKNDASDESTAAKLPSFDIAALMYHADETSLKAGYVNELHILSEAQRFLDWCYRNKDDAGRLTTPDGLRRILDTEAKRSGLLAISSELDDLAQQVAREQGSLGPSPSWSNVYSTLGSARVPDAA

SEQ ID NO: 1869 - protein, 376 aa, Unknown
  Description of Unknown: Erythrobacter sequence
MPRDINTRLENLRIRRKGVDAARSGRVTASVADEVLRKSVIQESWQRRATEQPYTRYALGAMQAVDPAYTQKSHDEADRVAKQLRSGLSIPIEMRLQGSVPLDVHIRGVSDVDLLVIRTDFLCYDTFGALATSGWYSPSSKTSLSVLRELRIECEELLKRRYWGADVDCDGGKCIALSGGSFERPVDVVPSHWHDTVDYQASRLEQERGVYILDKKIPDTFSNLPFKHIKRVHERDLSYFGGLKKAIRLVKNVKNDASDESTAAKLPSFDIAALMYHADETSLKAGYVNELHILSEAQRFLDWCYRNKDDAGRLTTPDGLRRILDTEAKRSGLLAISSELDDLAQQVAREQGSLGPSPSWSNVYSTLGSARVPDAA

SEQ ID NO: 1870 - protein, 374 aa, Sphingomonas dokdonensis
MARNINDRLTQLNSRRKGTDRLDRVATASINEVLTKSLMTESWEKRATSQPYTRYALGAMQAVSDRYTQISIETAERVGKQLVTNLPMSVSFRLQGSVPLDVHIRGVSDVDLLTLDGRFLTYNPYGSRASTYGSSTLTSLGVLLELRREAERVLKAAYPAAKVDCSGGKCIALSGGSLARPVDVVPSHWEDNAAYQSSLQEHDRGVTILNKTVPETLGNLPFLHIKRVHDRDTSVLGGLKKAIRLTKNVKNDAENETSAAKLPSFDIAGLLYHADQNALRSGYTYELAILRETQRFLDWCYHNKDAAKQLRTPDGSRCILDTDAKFAGLSTISVEMDNLAKEVAREQLAGVSFGEPSWLQIDEALRKAYIPAAA

SEQ ID NO: 1871 - protein, 377 aa, Sphingopyxis sp.
MARNINDRLTNLNKRRKGTDRLDRVSKEFAASIVNDSMILEKWEKRATAQPFTRYALGAMQPVEKRYTDISIETAIRVGKQLQQGLSMDVDLRLQGSVPLDVHIRGVSDVDLLTLAGSFLTYTQGGALARAGWYRPSDRRPVDVLLELRREAEKVLTAAYPAVTVDCTGGKAIAMSGGSLPRPVDVVPSHWHDNIDYQAAQQEHERGVTILNKHVPTTIENLPFLHIQRINEADGSTLGGLKKAIRLAKNVKNDAEDEQAAMKLPSFDIAALLYHADRAMLRAGYQFELSILAETQRFFDWCWNNKDSARQLRTPDGTRPILNTDDKIDGLRVISAELDNLAGEVAREQSNVIRGLQAPTQQIIAEALRNAYIPDAA

SEQ ID NO: 1872 - protein, 374 aa, Sphingomonas sp.
MTRQIDSRLRTLAQRRKGGDRLNRVSKEQAVLLAQDGLSIESWQRRVGTQPHTRYTLGAMEAVERRYTEISIETALRVGSQLQQKLSIPVTLRLQGSVPLNVHIRGVSDVDLLTLDTRFLRYDPNGLRASTYGHSPLTSTAVLMALRLEEERLLRTTFPAAAVDTSGGKAITIEGGSLARPVDVVPSHWWDTANYQATQAEHDRGVYILDKKVPETISNLPFLHIKRVGDADDAVFGGLRKAIRLTKNVKNDAENEAAARKLPSFDIAALLYHADRNALALGRGHELAILGETQRFLDWCWNNKDAAKRLMTPDGMRTVLNTDAKMEGLRAISVEMDALAREVAREQAPSLRNLDPSWSQVDAALRQARIPLAA

SEQ ID NO: 1873 - protein, 372 aa, Xanthomonas vesicatoria
MTTIDQRLQKLRARRSGADRAIAVAMDQQIEILREQLLGEAYERRAMGKPFTRYALGAMQEVDPDYTRISIETATRVENQLQRRLSAEGLNTTYRLQGSVPLNVHIRGVSDVDLLTIGLGSLFYAPAGVHAQRGGYSPPARDTTSFLRDLRRTSETSLRTAFPAVHVDTTNAKAIKLTGGSLPRPVDVVPAVWWDTEQYQFTGLEHDRGVSIYHKFDHATIDNLPFLHIKRVADRDAAALGSLRKAIRLCKNVKADAEDEGTTIALSSYVLYHADLTAWRSGAQWELGILAEAQRHLDWCYRNPPQAQALMTPDGSRCILETAEKSTALMMLSSEMDKLLRQVAREQSVQLYLQESPSLDSSRRAIEQLIIH

SEQ ID NO: 1874 - protein, 376 aa, Xanthomonas vesicatoria
MTTIDQRLQKLRARRSGADRAIAVAMDQQIEILREQLLGEAYERRAMGKPFTRYALGAMQEVDPDYTRISIETATRVENQLQRRLSAEGLNTTYRLQGSVPLNVHIRGVSDVDLLTIGLGSLFYAPAGVHAQRGGYSPPARDTTSFLRDLRRTSETSLRTAFPAVHVDTTNAKAIKLTGGSLPRPVDVVPAVWWDTEQYQFTGLEHDRGVSIYHKFDHATIDNLPFLHIKRVADRDAAALGSLRKAIRLCKNVKADAEDEGTTIALSSYEIAGLLYHADLTAWRSGAQWELGILAEAQRHLDWCYRNPPQAQALMTPDGSRCILETAEKSTALMMLSSEMDKLLRQVAREQSVQLYLQESPSLDSSRRAIEQLIIH

SEQ ID NO: 1875 - protein, 376 aa, Stenotrophomonas maltophilia
MTAIDHRLQKLRARRSGADRSAAVAADQQVEILRKQLLGEAYERRAGGKPSTRYALGAMQEVDPDYTRISVETASRVENQLRQRLAAEGLGTTYRLQGSVPLNVHIRGVSDVDLLTIGLGSLYYAPGGVRAQRGAYSPPVRDTLLLLRDLRRTSESALRAAFPAVDVDATNAKAVKLSGGSLARPVDVVPAVWWDTLQYQLSGLEYDRGVSIYHKFDHVTIDNLPFLHIKRVSDRDIVAFGGLRKAIRLCKNVKADAEEEGTMIGLSSFEIAGLLYHADLAALRAGAQWELAILTEAQRHLDWCYHNPTEAQALMTPDGSRRILDTPEKAAALWRLSMEMDKLLRQVAREQDSTLYMQESPSLENSRRAVEHVIVQ

SEQ ID NO: 1876 - protein, 377 aa, Unknown
  Description of Unknown: Stenotrophomonas sequence
MMTAIDHRLQKLRARRSGADRSAAVAADQQVEILRKQLLGEAYERRAGGKPSTRYALGAMQEVDPDYTRISVETASRVENQLRQRLAAEGLGTTYRLQGSVPLNVHIRGVSDVDLLTIGLGSLYYAPGGVRAQRGAYSPPVRDTLLLLRDLRRTSESALRAAFPAVDVDATNAKAVKLSGGSLARPVDVVPAVWWDTLQYQLSGLEYDRGVSIYHKFDHVTIDNLPFLHIKRVSDRDIVAFGGLRKAIRLCKNVKADAEEEGTMIGLSSFEIAGLLYHADLAALRAGAQWELAILTEAQRHLDWCYHNPTEAQALMTPDGSRRILDTPEKAAALWRLSMEMDKLLRQVAREQDSTLYMQESPSLENSRRAVEHVIVQ

SEQ ID NO: 1877 - protein, 381 aa, Rhizobium leguminosarum
MARDINKRLTQLSSRRKGLDRIDKINETQAFDELVRKGTIAERWEKRAASKPNTRYALGAMQAVDPDYTRISVETAGRVANQLEQGLIRKGTNVQFRLQGSVPLDVHIRGVSDVDLLTLTTDFFTYATYGARARAGGYVNPSSKSALTVLAELRAQCEVILAEAFPKAELDKTGGKAIAISGGSLARPVDVVPSHWFDTVDFQASGDEASRAVTILDKKVPTTLDNWPFLHIRNVDLVDSAVYGALKKAIRLCKNVKADAKADGTDVTLPSFDITSAMYHADRQALTGGRLFELAILAETQRHLDHLARNIDYAKTLKVPDGSRAIFNTDDKIRGLIALSIEVDDLLREVAKEQNGYLATLAEPALDVSRGVLKNLDASGL

SEQ ID NO: 1878 - protein, 375 aa, Rhizobium giardinii
MARDVNRRLEQLAKRRKGTDRLGNLSYSEQTEVINKSILDESWQKRALDKPNTRYALGAMQAVDPDYTRISLETAERVGNQLLSRLEAQGLFVEFRIQGSVALDVHIRGVSDVDLLTLDRYFYTFNRFGPKSGSYSGTGTTETSQERLMKIRLKSEVALNDAFPAATVDKSGGKAIAIFGGSLARPVDVVPSHWYDTAEYQTSGREADRAVTILDKDVPITIDNWPFLHIHKIHERDSAIGGGMKKAIRLAKNVKNDAETEGTSIALPSFDIASIMYHADLQALSRGSIYELAVLAEAQRHLDFLSNNQSYAMTLEVPDGSRKIIDKAEKFNALEKLSTEFDDLVREVAREQGKNLGLLPSLQEQRNILQDSYIL

SEQ ID NO: 1879 - protein, 375 aa, Pseudomonas syringae
MNTPINERINRLRSRRSGLDRSSVIAMDAKDFIVNRSLTKEAWEHRVKDKPNTTFALGAMQEVDPTYTRISIETAERVSNQLSKRTSGNLEFELQGSVPLNVHIRGVSDVDLLAIEADFHTYDARGYMSTSGQYRSPTSRTSVGVLTARRGEIGRALRDAFPAATIDTSGSKAIKLQGGSLARPVDVVPSHWHDTITYQASGQKHDRAVTILDSHKSTTIENWPFLHIKKVRERCETTGGGLRKSIRLCKNIKAELEAEGKPVTISSFDIASIMYHANMHSLSAGAYYELAILAETQRYLDYLWNNKEEARRLVVPDGSRFIFNTEDKFNGLLHLSVAMDSLLREVAKEQNYLLSLSDKPLLDASRIAVTNAIIF

SEQ ID NO: 1880 - protein, 375 aa, Pseudomonas lundensis
MNTPINERINRLRSRRSGLDRSSVIAMDAKDFIVNRSLTKEAWEHRVKDKPNTTFALGAMQEVDPTYTRISIETAERVSNQLSKRTSGNLEFELQGSVPLNVHIRGVSDVDLLAIEADFHTYDARGYMSTSGQYRSPTSRTSVGVLTARRGEIGRALRDAFPAATIDTSGSKAIKLQGGSLARPVDVVPSHWHDTITYQASGQKHDRAVTILDSHKSTTIENWPFLHIKKIRERCETTGGGLRKSIRLCKNIKAELEAEGKPVTISSFDIASIMYHANMHSLSAGAYYELAILAETQRYLDYLWNNKEEARRLVVPDGSRFIFNTEDKFNGLLHLSVAMDSLLREVAKEQNYLLSLSDKPLLDASRIAVTNAIIF

SEQ ID NO: 1881 - protein, 349 aa, Pseudomonas syringae
MDAKDFIVNRSLTKEAWEHRVKDKPNTTFALGAMQEVDPTYTRISIETAERVSNQLSKRTSGSLEFELQGSVPLNVHIRGVSDVDLLAIEADFHTYDARGYMSTSGQYRSPTSRTSVGVLTARRGEISKALRDAFPAATIDTSGSKAIKLQGGSLARPVDVVPSHWHDTITYQASGQKHDRAVTILDSHKSTTIENWPFLHIKKVRERCETTGGGLRKSIRLCKNIKAELEAEGKPVTISSFDIASIMYHANMHSLSAGAYYELAILAETQRYLDYLWNNKEEARRLVVPDGSRFIFNTEDKFNGLLHLSVAMDSLLREVAKEQNYLLSLSDKPLLDASRVAVTNAIIF

SEQ ID NO: 1882 - protein, 375 aa, Pseudomonas syringae
MSTSINDRINRLRSRRSGLDRSSVIAMDAKDFIVNRSLTKEAWEHRVKDKPNTTFALGAMQEVDPTYTRISIETAERVSNQLSKRTSGSLEFELQGSVPLNVHIRGVSDVDLLAIEADFHTYDARGYMSTSGQYRSPTSRTSVGVLTARRGEISKALRDAFPAATIDTSGSKAIKLQGGSLARPVDVVPSHWHDTITYQASGQKHDRAVTILDSHKSTTIENWPFLHIKKVRERCETTGGGLRKSIRLCKNIKAELEAEGKPVTISSFDIASIMYHANMHSLSAGAYYELAILAETQRYLDYLWNNKEEARRLVVPDGSRFIFNTEDKFNGLLHLSVAMDSLLREVAKEQNYLLSLSDKPLLDASRVAVTNAIIF

SEQ ID NO: 1883 - protein, 375 aa, Pseudomonas cerasi
MSTSINERINRLRSRRSGLDRSSVIAMDAKDFIVNRSLTKEAWEHRVKDKPNTTFALGAMQEVDPTYTRISIETAERVSNQLSKRTSGNLEFELQGSVPLNVHIRGVSDVDLLAIEADFHTYDARGHMSTSGQYRSPTSRTSVGVLTARRGEISKALRDAFPAATIDTSGSKAIKLQGGSLARPVDVVPSHWHDTITYQASGQKYDRAVTILDSHKSTTIENWPFLHIKKVRERCETTGGGLRKSIRLCKNIKAELEAEGKPVTISSFDIASIMYHANMHSLSAGAYFELAILAETQRYLDYLWNNKEEARRIVVPDGSRFIFNTEDKFNGLLHLSVAMDSLLREVAKEQNYLLSLSEKPMLDASRVAVTNAIIF

SEQ ID NO: 1884 - protein, 375 aa, Pseudomonas syringae
MNTSINERISRLRSRRSGLDRSSVIAMDAKDFIVNRSLTKEAWEHRVKDKPNTTFALGAMQEVDPTYTRISIETAERVSNQLSKRTSGNLEFELQGSVPLNVHIRGVSDVDLLAIEADFHTYDARGNMSTSGQYRSPTSRTSVGVLTARRGEISKALRDAFPAATIDTSGSKAIKLQGGSLARPVDVVPSHWHDTITYQASGQKYDRAVTILDSHKSTTIENWPFLHIKKVRERCETTGGGLRKSIRLCKNIRAELEAEGKPVTISSFDIASIMYHANMHSLSAGAYYELAILAETQRYLDYLWNNKEEARRIVVPDGSRFIFNTEDKFNGLLHLSVAMDSLLREVAKEQNHLLSLSEKPMLDASRVAVTNAIIF

SEQ ID NO: 1885 - protein, 375 aa, Unknown
  Description of Unknown: Pseudomonas fluorescens group sequence
MSTSINDRINRLRSRRSGLDRSSVIAMDAKDFIVNRSLTKEAWEHRVKDKPNTTFALGAMQEVDPTYTRISIETAERVSNQLSKRTSGNLEFELQGSVPLNVHIRGVSDVDLLAIEADFHTYDARGYMSTSGQYRSPTSRTSVGVLTARRGEISKALRDAFPAATIDTSGSKAIKLQGGSLARPVDVVPSHWHDTITYQASGQKHDRAVTILDSHKSTTIENWPFLHIKKVRERCETTGGGLRKSIRLCKNIKAELEAEGKPVTISSFDIASIMYHANMHSLSAGAYYELAILAETQRYLDYLWNNKEEARRLIVPDGSRFIFNTEDKFNGLLHLSVAMDSLLREVAKEQSFLLSLSEKPMLDASRVAVTNAVIF

SEQ ID NO: 1886 - protein, 375 aa, Pseudomonas koreensis
MSTSINDRINRLRSRRSGLDRSSVIAMDAKDFIVDRSLTKEAWEHRVKDKPNTTFALGAMQEVDPTYTRISIETAERVSNQLSKRTSGNLEFELQGSVPLNVHIRGVSDVDLLAIEADFHTYDARGYMSTSGQYRSPTSRTSVGVLTARRGEISKALRDAFPAATIDTSGSKAIKLQGGSLARPVDVVPSHWHDTITYQASGQKHDRAVTILDSHKSTTIENWPFLHIKKVRERCETTGGGLRKSIRLCKNIKAELEAEGKPVTISSFDIASIMYHANMHSLSAGAYYELAILAETQRYLDYLWNNKEEARRLIVPDGSRFIFNTEDKFNGLLHLSVAMDSLLREVAKEQSFLLSLSEKPMLDASRVAVTNAVIF

SEQ ID NO: 1887 - protein, 197 aa, Pseudomonas syringae
SLDHYTVIAMDAKDFIVNRSLTKEAWEHRVKDKPNTTFALGAMQEVDPTYTRISIETAERVSNQLSKRTSGNLEFELQGSVPLNVHIRGVSDVDLLAIEADFHTYDARGYMSTSGQYRSPTSRTSVGVLTARRGEMSKALRDAFPAATIDTSGSKAIKLQGGSLARPVDVVPSHWHDTISYQASGQKHDRAVTILVY

SEQ ID NO: 1888 - protein, 316 aa, Pseudomonas avellanae
MQEVDPTYTRISIETAERVSNQLSKRASGNLEFELQGSVPLNVHIRGVSDVDLLAIEADFHTYDARGYMSTSGQYRSPTSRTSVGVLTARRGEISKALRDAFPAATIDTSGSKAIKLQGGSLARPVDVVPSHWHDTISYQASGQKHDRAVTILDSHKNTTIENWPFLHIKKIRERCETTSGGLRKSIRLCKNIKADLEAEGKAVTISSFDIASIMYHANMHSLSVGAYYELAILAETQRYLDYLWNNKEEARRLIVPDGSRFIFNTEDKFNGLMHLSVAMDSLLREVAKEQSFLLSLSEKPMLDASRVAVTNAIIL

SEQ ID NO: 1889 - protein, 333 aa, Pseudomonas avellanae
SGYRPRRGELIGGSLGAMQEVDPTYTRISIETAERVSNQLSKRASGNLEFELQGSVPLNVHIRGVSDVDLLAIEADFHTYDARGYMSTSGQYRSPTSRTSVGVLTARRGEISKALRDAFPAATIDTSGSKAIKLQGGSLARPVDVVPSHWHDTISYQASGQKHDRAVTILDSHKNTTIENWPFLHIKKIRERCETTSGGLRKSIRLCKNIKADLEAEGKAVTISSFDIASIMYHANMHSLSVGAYYELAILAETQRYLDYLWNNKEEARRLIVPDGSRFIFNTEDKFNGLMHLSVAMDSLLREVAKEQSFLLSLSEKPMLDASRVAVTNAIIL

SEQ ID NO: 1890 - protein, 375 aa, Unknown
  Description of Unknown: Pseudomonas syringae group sequence
MNTPINERINRLRSRRSGLDRSSVIAMDAKDFIVNRSLTKEAWEHRVKDKPNTTFALGAMQEVDPTYTRISIETAERVSNQLSKRTSGNLEFELQGSVPLNVHIRGVSDVDLLAIEADFHTYDARGYMSTSGQYRSPTSRTSVGVLTARRGEISKALRDAFPAATIDTSGSKAIKLQGGSLARPVDVVPSHWHDTISYQASGQKHDRAVTILDSHKNTTIENWPFLHIKKIRERCETTSGGLRKSIRLCKNIKADLEAEGKAVTISSFDIASIMYHANMHSLSVGAYYELAILAETQRYLDYLWNNKEEARRLIVPDGSRFIFNTEDKFNGLMHLSVAMDSLLREVAKEQSFLLSLSEKPMLDASRVAVTNAIIL

SEQ ID NO: 1891 - protein, 375 aa, Pseudomonas fragi
MNTPINERINRLRSRRSGLDRSAVIAMDAKDFIVNRSLTKEAWEHRVKDKPNTTFALGAMQEVDPTYTRISIETAERVSNQLSKRTSGNLEFELQGSVPLNVHIRGVSDVDLLAIEADFHTYDARGYMSTSGQYRSPTSRTSVGVLTARRGEISKALRDAFPAATIDTSGSKAIKLQGGSLARPVDVVPSHWHDTISYQASGQKHDRAVTILDSHKNTTIENWPFLHIKKIRERCETTSGGLRKSIRLCKNIKADLEAEGKAVTISSFDIASIMYHANMHSLSVGAYYELAILAETQRYLDYLWNNKEEARRLIVPDGSRFIFNTEDKFNGLMHLSVAMDSLLREVAKEQSFLLSLSEKPLLDASRAAVTNALIF

SEQ ID NO: 1892 - protein, 375 aa, Pseudomonas fluorescens
MNTPINERINRLRSRRSGLDRSSVIAMDAKDFIVNRSLTKEAWEHRVKDKPNTTFALGAMQEVDPTYTRISIETAERVSNQLSKRTSGSLEFELQGSVPLNVHIRGFSDVDLLAIEADFHTYDARGYMSTSGQYRSPTSRTSVGVLTDRRGEISKALRDAFPAATIDTSGSKAIKLQGGSLARPVDVVPSHWHDTISYQASGQKHDRAVTILDSHKNTTIENWPFLHIKKIRERCETTIGGLRKSIRLCKNIKADLEAEGKAVTISSFDIASIMYHANMHSLSVGAYYELAILAETQRYLDYLWNNKEEARRLIVPDGSRFIFNTEDKFNGLMHLSVAMDSLLREVAKEQSFLLSLSEKPMLDASRVAVTNAIIL

SEQ ID NO: 1893 - protein, 375 aa, Pseudomonas sp.
MSTSINERINRLRSRRSGLDRSTVIAMDAKDFIVNRSLTQEAWEHRAKDKPNTTFALGAMQEVDPTYTRISIETAERVSNQLTKRVTGNMEFELQGSVPLNVHIRGVSDVDLLALEANFHTYDSSGSMSRSGQYNSPTSRTSLGVLIARREEMSRVLRDAFPAASIDTSGSKAIKLQGGSLARPVDVVPSHWHDTISYQASRQKHDRAVTILDSHKNITIENWPFLHIKKVRERCDTTGGGLRKSIRLCKNLKAELEAEGQTVAISSFDIASIIYHANLHSLSAGSYYELAILAETQRHLDYLWNNKEEARRLIVPDGSRFIFNTEEKFNGLLHLSVAMDSLLQEVAKEQSYLLSLSEKPLLDASRAAVTNAVIF

SEQ ID NO: 1894 - protein, 375 aa, Pseudomonas aeruginosa
MSNSINDRINRLRSRRSGLDRSSVIALDAKDFIVNRSLNQERWEGRAKDKPYTTFVLGAMQEVDPTYTRISLETADRVSNQLAKRMSGNMEFELQGSVPLNVHIRGVSDVDLLALEADFCTYDRRGAMSTGGQYSSPTTRTSVGVLTARRAEISRVLREAFPAATVDTSGSKAIKLFGGSLARPVDVVPSHWHDTIEYQASRQKHDRAVTILDVHKGVTADNWPFLHIKRVRERCESTGGGLRKSIRLCKNLKAELEAEGQNVTISSFDIASVMYHANMSSLTVGALYELAILAETQRHLDYLVNDKEAARRLMVPDGSRSIFNEESKFAGLLRLSIAMDNLLREVAKEQSYLLRLSETPMLDASRATVIKSAIF

SEQ ID NO: 1895 - protein, 375 aa, Pseudomonas stutzeri
MSNSINDRISRLRSRRSGLDRSSVIALDAKDFIVNRSLNQERWEGRAKDKPYTTFALGAMQEVDPTYTRISLETAERVSNQLARRMSGSMEFELQGSVPLNVHIRGVSDVDLLALEADFHTYDPRGGMSASGQYRSPSTRTSVGVLTARRAEISRVLREAFPVATVDTSGSKAIKLYGGSLARPVDVVPSHWHDTIEYQASRQKHDRAVTILDGHKNTTADNWPFLHIKRVRERCESTGGGLRKSIRLRKNLKAELEAEGQNVPISSFDIASVMYHANMTSLTVGALYELAILAETQRHLDYLWNNKEVARQLLVPDGSRFIFNEEEKFTGLLHLSLAMDNLLREVAKEQNYLLKLSEKPMLDASREAVMKSAIF

SEQ ID NO: 1896 - protein, 375 aa, Pseudomonas sp.
MSNSINDRIDRLRSRRSGMDRTSVIAMDAKDFIVNRSLAQETWERRAKDKPNTTFALGAMQEVDPTYTRISLETAERVSNQLARRLTGNMEFELQGSVPLNVHIRGVSDVDLLALEGDFHTYDSRGAMSRTGQYISPTSRTSVGVLTARRAEIIRSLREAFPAAHVDTSGAKAVKLSGGSLARPVDVVPSHWHDTIDYQASRQKHDRAVTILDAQKNSTLENWPFLHIKKVRERCESTAGGLRKSIRLCKNLKAELEAEGQSVSISSFDIASIMYHANMANLTVGSFYELAILAETQRYLDYLWANKDQARRLIVPDGSRFIFDAEEKFTGLLHLSVAMDKLLQAVAKEQSYFLRQYESPMLDASREAVIKAAIF

SEQ ID NO: 1897 - protein, 374 aa, Pseudomonas putida
MSNGVNDRISRLRSRRSGLDRAAVVTQDAKEFIVNHSRHQEAWESRARDKPHTTFALGAMQEVDPTYTRISLETGKRVRNQLEKRLGGGVGFELQGSVPLNVHIRGVSDVDLLILDESFLIYDTYGVNGNTGYYTPAPGKTSVGVLSALRRETELALRAAFPAATVDAKGAKAVKIYGASLARPVDVVPAHWYDTASYQASQQKHDRAVTILDAQKMSTINNWPFLHIKKITDRCNATLGGLRKSIRLCKNVKAELEAEGRSVNLSSFDLASIMYHADMGCLTAGYVYELAILAETQRYLDYLWMFKDKARQLRVPDGSRAIFDVESKFDGLASVSHAMDELMREVAKEQNYALSLQPKPSLQESRSAVMQAYV

SEQ ID NO: 1898 - protein, 375 aa, Unknown
  Description of Unknown: Pseudomonas syringae group sequence
MSNGVSDRISRLRSRRNGLDRASVVTQDARDLINNRSQQRETWESRVGDKPFTTYALGAMQEVDPTYTRISIETAERVSNQLEKRLSAPLEFKLQGSVPLNVHIRGVSDVDLLVLDTSFLTYARSGVNSVAGHYIAAPGRTSAEVLRVLRNNSQSALGDAFPAATVDASGAKALKIFGGSLARPVDVVPGHWYDTAAYQSSKQQHDRAVTILNAHTMSTIDNWPFLHIQKITDRCNTTYGGLRKAIRLCKNLKAEREAEGRSINLSSFDLGSIMYHADMANFTAGIVYELAILAEAQRYLDHLWIYKEEARRLMVPDGSRAIFDSEEKFDGLLALSAAMDDLLRNVAQEQSAELSVVSQPDLGASRSAVMRSIIA

SEQ ID NO: 1899 - protein, 375 aa, Unknown
  Description of Unknown: Pseudomonas sequence
MSNGVSDRISRLRSRRNGLDRASVVTQDARDLINNRSQQRETWESRVGDKPFTTYALGAMQEVDPTYTRISIETAERVSNQLEKRLSAPLEFKLQGSVPLNVHIRGVSDVDLLVLDTSFLTYARSGVNSVAGHYIAAPGRTSAEVLRVLRNNSQSALGDAFPAATVDASGAKALKIFGGSLARPVDVVPGHWYDTAAYQSSKQQHDRAVTILNAHTMSTIDNWPFLHIQKITDRCNTTYGGLRKAIRLCKNLKAEREAEGRSINLSSFDLGSIMYHAEMANFTAGIVYELAILAEAQRYLDHLWIYKEEARRLMVPDGSRAIFDSEEKFDGLLALSAAMDDLLRNVAQEQSAELSVVSQPDLGASRSAVMRSIIV

SEQ ID NO: 1900 - protein, 376 aa, Pseudomonas syringae
MANGVNDRISRLRSRRSGLDRASAVAMDAKEFIVNRSLNKEAWESRAKDKPYTTFALGAMEEVDPTYTRISLETADRVRNQLEKRLSASMEFELQGSVPLNVHIRGVSDVDLLALDTSFFTYDTGGIASRSGHYSPATAGRTSVGVLSVLRRETEQALSAAFPAATVDVTGAKAVKVFGASLARPVDVVPSHWYNTVAYQSSQQKHDRAVTILDAHKLSTIDNWPFLHIKKIKDRCDSTRGGLRKSIRLCKNMKAELEAEGRSVNLSSFDLGSIMYHANMDKLAAGFIYELAIMAETQRHLDYLWTYKDEARRLRVPDDSRFIFDSESKFDGLLTISSALDDLLRRVGQEQDYGLRFQEKPGLQDSRDAVSRSIIF

SEQ ID NO: 1901 - protein, 344 aa, Leptospira santarosai
MTRYQKLLSRRAPQDERFFKSFSEAFELSIGENTKYILGAMRPVEKRFTDKLLNDGNRIQAQLDSRIDSEYPNIEFRRQGSVTNDTHIRYYSDIDVLVLIDKFYTVEYPVLPNDQYMGSANRDLSILRYRCKEEIELAFPATDVDDSGAFSISVKGGSLSGKVDVVPSCWYLTFEYRENPQEYLKGVTVLNRKTQEQINNFPFKFNHLLNARDSNTYGITKMLIRFLKSIKADEEEEGSKYSISSYDLCSVVYRMPDDLFLRSIVNSPIIMIYNLLSWFNYLILNESRAKALMVVDNSRKIFNEQAKLQDISRLYKLINELCSKATSESGQTFISKSHIAENSY

SEQ ID NO: 1902 - protein, 344 aa, Leptospira santarosai
MTRYQKLLSRRAPQDERFFKSFSEAFELSIGENTKYILGAMRPVEKRFTDKLLNDGNRIQAQLDSRIDSEYPNIEFRRQGSVTNDTHIRYYSDIDVLVLIDKFYTVEYPVLPNDQYMGSVNRELSILRYRCKEEIELGFPATDVDDSGAFSISVKGGSLSGKVDVVPSCWYLTFEYRENPQEYLKGVTVLNRKTQEQINNFPFKFNHLLNARDSNTYGITKMLIRFLKSIKADEEEEGSKYSISSYDLCSVVYRMPDDLFLRSIVNSPIIMIYNLLSWFNYLILNESRAKALMVVDNSRKIFNEQAKLQDISRLYKLINELCSKATSESGQTFISKSHIAENSY

SEQ ID NO: 1903 - protein, 344 aa, Leptospira santarosai
MNRYQKLLSRRLPKEETLYKSFSESFNASRGENTDYILKAMAPVEKRFTDKLIEDGNRIESQISRRLMAEYPDLEFRRQGSVSNNTHIRFSSDVDVLVIIDKFYTVEPPLTVSNPYIGDPKEDLTILRNQCKKEMAIAFPSTEIDDSGAISISIKGGSISRKVDIVPANWYHSVAFEEQGFEYLKGVMVFNRELYQRISNFPFLFNYLIEEKDDSTNGVTRMLIRFLKSVKADEEEDGKKFYLSSYDICSLVYRMPESFLNGLEIDRPISIIGSLVEWLNFLKQLSSVAFTIKVVDESRLIFDKKEKLDDLGPLTVAINDLYEKARAESGNYFVSKAHFAEYAR

SEQ ID NO: 1904 - protein, 344 aa, Leptospira interrogans
MNRYQKLLSRRLPKEETLYKSFSEAFNVSRGENTEYILKAMAPVEKRFTDKLIEDGNRIEAQISRRLITKYPGLEFRRQGSVSNNTHIRFSSDVDVLVIIDKFYTVEPPLTVNNPYIGDPKEDLSVLRNQCKKEVGIAFPSTEIDDSGAISISIKGGSLSRKVDIVPTNWYHSVAFDERGLEYLKGIMVFNRETYERISNFPFLFNYLIEEKDHITNGATRMLIRFLKSVKADEEDDGKKFNLSSYDICSIIYRMPDVLLNRLEINRPISIIGCLIEWLNYLTLSPSAAFAIKVVDKSRFIFDKKEKLDDLGPLSIAINDLYERAKAESGDRFISKAHFAEYIN

SEQ ID NO: 1905 - protein, 295 aa, Bacillus mycoides
MNPVDLKYTNNTIAEGERIKNQLSKLEDNGFNVEFRYQGSVTNNTHIRAHSDIDVLTLHSGFHSLEAPQKPSYPYAGDPVKDLCELREECYSILSSAFPTADIDNSGAKSIGLQGGSLRRKVDVVPSNWYNTNLYAQTGAEYHRGVMVLDYHNKKRLTNTPFYHNKLLDDKDLYTATNYKKMVRLLKTLKADSDVKINLSSYDIAALMYHQDNASYLVGQSPLLLITQSLSFLKNVYENSEYREGLLVPDKSRTIFERATLHDLKLMILELDNVVQDIRNDLSISGNTIYKEIIA

SEQ ID NO: 1906 - protein, 349 aa, Bacillus mycoides
MANFDYSKRLDSLKKRRQEDGGLIQKSQYSTYEILKESYEELKESATIKYVIGAMNPVDLKYTNNTIAEGERIKNQLSKLEDNGFNVEFRYQGSVTNNTHIRAHSDIDVLTLHSGFHSLEAPQKPSYPYAGDPVKDLCELREECYSILSSAFPTADIDNSGAKSIGLQGGSLRRKVDVVPSNWYNTNLYAQTGAEYHRGVMVLDYHNKKRLTNTPFYHNKLLDDKDLYTATNYKKMVRLLKTLKADSDVKINLSSYDIAALMYHQDNASYLVGQSPLLLITQSLSFLKNVYENSEYREGLLVPDKSRTIFERATLHDLKLMILELDNVVQDIRNDLSISGNTIYKEIIA

SEQ ID NO: 1907 - protein, 349 aa, Bacillus cereus
MANFDYSKRLDSLKKRRQEDGGLIQKSQYDTYEMLKESYEELKESATIKYVIGAMNPVDLKYTNNTIKEGERIKNQLSKLEDNGFNVEFRYQGSVTNNTHIRAHSDIDVLTLHAGFHSLESPQKPSYPYAGDPVKDLCELREECYSILSSAFPTADIDNSGAKSIGLQGGSLRRKVDVVPSNWYNTNLYAQTGAEYHRGVMVLDYHNKKRLTNTPFYHNKLLDDKDLYTAANYKKMVRLLKTLKADSDVKINLSSYDIAALMYHQDNASYLVGQSPLLLITQSLSFLKNVYDNSEYREGLLVPDKSRAIFERATLHDLKLMILELDNVAQDIRNDLSVSGNTIYKEIIA

SEQ ID NO: 1908 - protein, 349 aa, Bacillus toyonensis
MANFDYSKRLDSLKKRRQEDGGLIQKSQYGTYEMLKESYEELKDSATIKYVIGAMNPVDLKYTNNTIKEGERIKNQLSKLEDNGFNVEFRYQGSVTNNTHIRAHSDIDVLTLHAGFHSLESPQKPSYPYAGDPVKDLCELREECYSILSSAFPTADIDNSGAKSIGLQGGSLRRKVDVVPSNWYNTNLYAQTGAEYHRGVMVLDYHNKKRLTNTPFYHNKLLDDKDLYTAANYKKMVRLLKTLKADSDVKINLSSYDIAALMYHQDNASYLVGQSPLLLITQSLSFLKNVYDNSEYREGLLVPDKSRAIFERATLHDLKLMILELDNVVQDIRNDLSVSGNTIYKEIIA

SEQ ID NO: 1909 - protein, 348 aa, Bacillus sp.
MGNFDYSKRLDNLKKRRQEDGELIKSEFGEYEVIKESYEELKESSTIKYVIGAMNPVDLKYTHNTIAEGERVKNQLSKLKDSGFDVEFRYQGSVTNNTHIKAHSDIDVLTLHSGFYSLEAPQKPTYPYAGDPVKDLCDLREECYSILSSAFPAADVDNSGAKSIGLQGGSLRRKVDVVPSNWYNTNLYNQTKEEYHRGVKILDYHNKTRLANTPFYHNKLLNDKDLQTATNYKKVVRLLKTLKADGDAKINLSSYDIAALMYHQDNSSYLVGQSPLRIITNSLSFLKNVYDNKSYRTGLLVPDKSRTIFEKATVDDLKLMIFELDKVAQDIINDLSASGSTINKEIVA

SEQ ID NO: 1910 - protein, 361 aa, Bacillus thuringiensis
MANLDYIKKLDTLKKRRQGLEPIKKSIDYVGEQSEMYDEFPNHVFSEAFEQINESPIIKYIIGAMEPVDQIYTMNTFEQGKRVVNQLSKLKDEGYDFSFEYQGSVVSNTHIKAHSDIDILVLHAGFFTLESPLKPKYPYKGDPVKDLCNLREASYNLLKREFPAVNVDNTGAKSISLEGGSLSRKVDVVPANWYDTVLYNETNLSYYRGVMVLDYKKKERIANTPFYHNKLLEDKDNKTLHNYKKIIRLLKTIKADSDKKIGLSSYDIAALMYHMDDNEYCVGDSRLLLLTRTLNFMLQVYSDETYRKGLQVPDESRFIFEEGKATVEDLWLLIGSLAEIIEDLKEELSKTGKTFAEEIAI

SEQ ID NO: 1911 - protein, 361 aa, Bacillus thuringiensis
MSNFDYIKKLDTLKKRRQGLESITKSTDYVSEQTGMYDEFPNHVFFEAFEQINESPIIKYIIGAMEPVDQKYTMNTFDQGKRVINQLSKLKDEGYNFSFEYQGSVVSNTHIKAHSDIDILVLHAGFFTLESPLKPEYPYKGDPVKDLCDLREASYNLLKREFPAVNVDNTGAKSIGLEGGSLTRKVDVVPSNWYDTVLYNKTNLSYHRGVMVLDYKKKERIANTPFYHNKLLEDKDNNTFHNYKKIIRLLKTIKADSDKKIGLSSYDIAALMYHMEDNEYCVGESRLLLLTRAQNFMLQVYKNETYRKGLQVPDESRFIFEEGKATVEDLWLLIGSLAEIIEDLKNELSKTGKTFAEEIAI

SEQ ID NO: 1912 - protein, 354 aa, Clostridium sticklandii
MSKNYSSRLSELRSRKNDIQILQECYGYKGFSLDSYNQFIKMASETNDVQNYFIEAMASVDEIYTKNTYKEAERVKNQLDKIKTASLNFEYEYQGSVSNNTHIKAHSDIDVLVIIDKFVTLQHPLVPANPYKGNPINDLLELRYTSEKHLISAFPQADVDCSGAKAIGLSGGSLRRKVDVVPSNWYDTVEYDRTKQMHYRGIYVLDKYKKERILNTPFYHNYLLDVKDINTAGNFKRVVRLLKTLKADSDNDIKLSSYDIVAIAYHMETSKYVTGDKYIRLLKNVYSYLNDLASMSSELRNSIDVPDKSRKIFNESGKYIGLILLKDEIEELLKSLVSSYGLSDYSIEYKSIAV

SEQ ID NO: 1913 - protein, 337 aa, Halomonas meridiana
MSRLERLNQRRIDENITEAKLYNESYRSIAQSDSVKYVIGAMQPIDPEYTKNTYKQAERVRSQLENRLTDHCEYKYQGSVTNDTHIKAKSDIDLLVIIDKFFTVENPQIPKSPYKGDPLQDLISLRKEAEEALESAFPQADVDKSGSKSVSIEGGSLTRKVDVVPSNWFNTNKYAETGNEIFRGVQILDKSVPKRLANTPFLHNAWIDHKDGNTNSGMRKACRLMKSLKYDSENIDLSSYDIVSIAFNMANASLSYPKGSELLILGSCLDYCRQLQSNSTLRESIDVPDGHRKVFCDGHATLQGLNRLTEELEQLANDVLRENQRSFRKLAEARVEY

SEQ ID NO: 1914 - protein, 341 aa, Leptospira sp.
MIRNKLEKLNQRRTDDFVKLQKSLTENLKDFYQTDAIKYIIGTMQKVEQEYTLNTYKEGERVKNQLKTNLTQSCSYEYQGSVTNDTHIKARSDIDLLTIIDKFETLENPQEPKNPYHGNVLEDLKNLRIEEVNILKKTYTEAIVDDSGSKSISISGGSLRRKIDVVPSNWFNSNLYAITSLKENRGIQIYDKDKNIQILNYPFLHNAKIEKKDKECNEGLRKTIRLLKSLKYDSEEIELSSYDIASIAYNMPNYLLQINRGEELKLVFNSLSYCKEIESNTLKRENLFVPNNTRKIFETGGATIKGLKELIKQLELLITDVENENYKSFNKLSEARIDYYF

SEQ ID NO: 1915 - protein, 342 aa, Balneola vulgaris
MINDYSKRLEQLRRRRTDERIEKSILSESFRKSELGESIKYALESMKEIDPDYTKNTYVASEKVSENIRKGLEKVPIDIEFRNQGSVETNTHIKLHSDIDLLVILKTFETLERPQEPSSPYQGDPLQDLKQLRSETYRVLDSVYDTVDNSNAKAIKVFPTNPKRMVDVVSANWFNSNEYATNGRNELYRGINIYNKDEHSRSRDFPFLHIERVNNKEPMTNGGFKKLVRLLKTLKVDADVKIKLNSFEITCALYDIRNEKLNLPEVNQLLLLPVASEQLNKLIINDAYRHSLKSPNGKESAFPSDTKVIELKKLKREVDDLMTDIKSDLETKYLSINESINY

SEQ ID NO: 1916 - protein, 335 aa, Ekhidna lutea
MEHDYSLFVENLKGRRYDEALREQVLSEAFHQCGYSDCLRYTLESMVEIDPSYAYKVYANSRRIHENIAKVLKKKGYDADYRYQGALKTYSNIRLYGDVEIIVIKKNVSEKPHTDMQILAKDLLDVLSKDPTLKSVDYSDKTRIRVIAQKPTCEIDVLPSMWINSAEYVKTRNEIYKGIAEFDFAKKKVKKYLPFLNIARINARDQHTNGNLKAMSRLLKSLRADAVDRIHLRDSEINAILYNIPEADLTVPANKVLSLLPTVAKMLDKLESDAAYFNQMLSPSEKDRVFGGRPDKQKELQKLNAQLKKLISDLKADLDSQGKTLNSEIEYLPTP

SEQ ID NO: 1917 - protein, 343 aa, Flavobacterium daejeonense
MKKNYTQRLEKLKKRRLDDQLQKAVLSESFSDIRISESVKYALESMSPIDPSYTNNTYVASENIRNNLTKGLNNKGLTVEYRHQGSVETDTHIKLHSDIDILVFTEKYHSMEPPLTPISPYQGDPLADLKELRQECYNALNAIYNQVDNSKAKSIQVFPTNPKRKVDVVPANWVNTQDYQSTSNEKYRGVHIYDKDNHSRQKDFPFLHIANVKAKNSLVNGGLAKLVRLLKTLKVDADYEINLSSFEITSIVFAMENHSLNKPKYQELLLLNEGSRQLDKVITDKLYRESLMSPNGKERVFETSEIKIVELKKLKLELDELIEDITEELGKQFKRIDENIIYG

SEQ ID NO: 1918 - protein, 340 aa, Fluviicola sp.
MALNYEQRLQNLRNRRFDNEINESRLTKSFNLSEIPKNIKYLMESMTKIDKEYNDKTIDAAKKVQSHLEGKLNLHFQRDYWMQGSVMTSTNIIIHSDIDLLTIIGRYHFPGPGVPNQYPYNESDPNSDIKELRRQSEKIMEMIYDEVDKSGKKGITIFNKSLKRKVDLVFCFWYYSKEYHETKNDYYKGLYLFDFTKDQKELDYPFAHMREVNFKGDATNDGSRMGIRLLKTLKADSIEKIGLTSFQITTIVHSIDNSVIYHYPGKDITIAKALSNQLDKLINNPYYRSSVESPNGTESPLTEDIVPDMKLIKADLDQLIEDVQKEIYLTYFEKGNLIYS

SEQ ID NO: 1919 - protein, 340 aa, Chryseobacterium soldanellicola
MPLNYERRLSNLQSRRYDNELNESVISKSFSNDKIPKNIKYLYESMSKIDSKYNERTYDAANRVQKHLEGNFNLHFDRAYRTQGSVVTGTNIKVHSDFDLLVIINKYHFNGPNVPINNPYTDTDHTDDIKDLRKQSENIMSNIYDEVDKTGRKNISIFNKSLNRKVDIVFCFWYHTQDYIETQNEYYRGIYLYDFIENEKISDFPFAHISQVNAKGETTNDGSRKAIRLLKTLKADSLEEIKLSSFDLTTIVHSIEDNLLYYHSGKEVQIAKVISNQLLNLINNSELRKSIKSPNGTENPLTDDCVSEMRNLKKDLDELIEDVSKELYNSYFEKGELIYS

SEQ ID NO: 1920 - protein, 341 aa, Pedobacter sp.
MANLNYGRRLSNLQNRRFDKDFNESTLTKSFSTSDLPENIKYLVESMLPIGKKYNERTLQAAQNVQNHLERDFNLHFRRAYKNQGSVMAGTNIKVHSDIDLLTVINRYHYPQGQPVNPYTDSDPNSDIKDLRRQAIQILKRQYDIVDDKGEKSISIINQNLGRKVDIVPSFWYHSDKYTETGNEHYKGIYLFNFVKETKHLDYPFATANNINHKGTATNDGSRRGIRLLKTLKADCDDQLETLKSFQLTSIVHDIDSNKLYYNAGTELEIAKVVSSQINRIINEPAYRLSVSSPNGTEKPLTKEGIVKDLIRLKIDLDLLIEDSSSEINKSYSVQRGILTY

SEQ ID NO: 1921 - protein, 341 aa, Pedobacter luteus
MPTLDYTRRLSSLQNRRFDKELNESTLTKSFSASNLPEDIKYLIESMQPIGDKYNAKTITAANNVQKHLERDFNLHFNRAYRTQGSVMTGTNIEVHSDFDLLTVIDRYFYPQSQPVNPYTASDPNVDICEMRKQATEIMKAEYKIVDDTGDKCISIENQNLNRKVDIVFCYWYHSEKFNETNNDHYKGVYLYDFKKQIKHRDFPFATINNVNHKGDNTHDGFRRGVRLLKTLRADCEVELKMLKSFQLTSIAYSMENSSLMYSTGSELQIAKNLSAEMKLLIDDPIKRKAVLSPNGIERPLAKDEVVADMIRLKQDLDVLIEDASKDIANSYFVQRSILAY

SEQ ID NO: 1922 - protein, 295 aa, Pedobacter luteus
MQPIGDKYNAKTITAANNVQKHLERDFNLHFNRAYRTQGSVMTGTNIEVHSDFDLLTVIDRYFYPQSQPVNPYTASDPNVDICEMRKQATEIMKAEYKIVDDTGDKCISIENQNLNRKVDIVFCYWYHSEKFNETNNDHYKGVYLYDFKKQIKHRDFPFATINNVNHKGDNTHDGFRRGVRLLKTLRADCEVELKMLKSFQLTSIAYSMENSSLMYSTGSELQIAKNLSAEMKLLIDDPIKRKAVLSPNGIERPLAKDEVVADMIRLKQDLDVLIEDASKDIANSYFVQRSILAY

SEQ ID NO: 1923 - protein, 273 aa, Algoriphagus ornithinivorans
MQDNLNLHFNRAYKTQGSVITNTNIKVHSDFDLLTIIDRYHYNQPGVENSSDYTESNPDDDILELRTQSTKIMKNIYDEVDTSGKKGISIFNKSLNRKVDIVFCFWYHSKKYIETKDEHYKGIYLYEFPVKRKILDYPFAHINNVNYKGDTTNDGARKGIRLLKNLKADADSKIDLTSFHLTTIVHSIEDNHLNYNLGNELLIAKSISDKMNILINDPARRKEVKSPNGTENPLEDDKVVPEIKKIKEDLDTLIIDTAKELNSPTVKRILLNY

SEQ ID NO: 1924 - protein, 335 aa, Siphonobacter aquaeclarae
MAILNYTNRLENLRNRKFDPNLNELYTSKYFNRLGLPDNVKYLLEITQPIDKLSNDKYLLAAERVQNHLERRLNLHFERDYRHQGSITTNTNIRVHSDIDLLTIISRYHFVPNGEPILSPYTATNANEDIKLLRKQATQILKSIYQDVDDSGKKSISIFNKDLHRKVDIVFCFWYHSSTATDNEKGIMLFDFENETRIKDFPFAHISAVNTKGNSTSDGSKKGIRMLKNLKADADIELNSFQLTSIVHDISNNNLPHSVGTELYLAQNISYHLEKIISDSQYRKDIQSPNGREYPLKNDDCVEQLKKLRSELDTLIMDSQRELSKVEVRNLIHSI

SEQ ID NO: 1925 - protein, 352 aa, Dyadobacter fermentans
MNSNYKSLTEQMQRRLNPENLAFKEPFREELRSLQYQDALLFIRFAMKGVEPEYTSKSIEAGNRAKKHLEAELMSVDYRFQGSVMTNTHIRGYSDIDLLCLSSKFYNWDSYNVDRYLNEDSFRQQLTELQIRKLNAEKNKSSYQGDSNNDLRTIRLTSERIMTSKYTECDTSKPKSIKIRNKDLHRDVDIVTAAWYNDLRTILRDDKENRGVKVYDKDANATGSADFPFISIARINQRSSDTNGRLKKMIRFLKNVKSFSDLEINLSSFDINALCFDIDTSDYWSATYIELVTVLHRQLTRIVNDSAHADSIVSVDEREYIFRGKPQKVDGIRRLLGEVSQVLRDMPKPLYS

SEQ ID NO: 1926 - protein, 341 aa, Dyadobacter fermentans
MQRRLNPENLAFKEPFREELRSLQYQDALLFIRFAMKGVEPEYTSKSIEAGNRAKKHLEAELMSVDYRFQGSVMTNTHIRGYSDIDLLCLSSKFYNWDSYNVDRYLNEDSFRQQLTELQIRKLNAEKNKSSYQGDSNNDLRTIRLTSERIMTSKYTECDTSKPKSIKIRNKDLHRDVDIVTAAWYNDLRTILRDDKENRGVKVYDKDANATGSADFPFISIARINQRSSDTNGRLKKMIRFLKNVKSFSDLEINLSSFDINALCFDIDTSDYWSATYIELVTVLHRQLTRIVNDSAHADSIVSVDEREYIFRGKPQKVDGIRRLLGEVSQVLRDMPKPLYS

SEQ ID NO: 1927 - protein, 352 aa, Dyadobacter sp.
MNSNYKSLTEQMQRRLNPENLAFKEPFREELRSLQYQDALLFIRFAMKGVEPEYTSKSIEAGNRAKQHLEAELTSVDYRFQGSVMTNTHIRGYSDIDLLCLSSKFYNWDSYNVDRYLNEASFRQQLTELQIRRLDAEKNKSSYQGDSNNDLRTIRLTSERIMTSKYTECDTSKPKSIKIRNKDLHRDVDIVTAAWYNDLRTILRDDRENRGVKVYDKDANATGSADFPFISIARINQRSSDTNGRLKKMIRFLKNVKSFSDLEIKLSSFDINALCFDIDTSDYWSATYIELVAVLHRQLTRIVNDSAHADSIISVDEREYIFRGKPQKVDGIRRLLGEVSQVLRDMPKPLYS

SEQ ID NO: 1928 - protein, 305 aa, Riemerella anatipestifer
MNGVEQSYTERSKEAGERVKNHLKETLNDVVYRYQGSVMTNTHIKGNSDIDLLVITDKFYTFDRAGIEKTLSDFNQTYYLNQIQIQRLKNELSGGGYSTALEDLRTNRLKSEKKLKDVYDICDITHAKAIKITNQSLKRDVDIVIANWYDNVNSVINGKNSDYRGIQVYNKDTNSKGKQDYPFLSIKRINERSSDTNGRLKKMIRFLKNVKADSGKEINLSSFDFNAICYDIDVKIYKNLSKYFLVPVIYNQLLRLVTNETLANNLKSVDEHEYIFRDKPEKYKSLGLLLEEVTVIYLDLKPQLL

SEQ ID NO: 1929 - protein, 351 aa, Riemerella anatipestifer
MPKNYSLLVESLQKRSNPDNIILEKSLSNELSTIRYNDILRYITLAMNGVEQSYTERSKEAGERVKNHLKETLNDVVYRYQGSVMTNTHIKGNSDIDLLVITDKFYTFDRAGIEKTLSDFNQTYYLNQIQIQRLKNELSGGGYSTALEDLRTNRLKSEKKLKDVYDICDITHAKAIKITNQSLKRDVDIVIANWYDNVNSVINGKNSDYRGIQVYNKDTNSKGKQDYPFLSIKRINERSSDTNGRLKKMIRFLKNVKADSGKEINLSSFDFNAICYDIDVKIYKNLSKYFLVPVIYNQLLRLVTNETLANNLKSVDEHEYIFRDKPEKYKSLGLLLEEVTVIYLDLKPQLL

SEQ ID NO: 1930 - protein, 383 aa, Riemerella anatipestifer
MLRSPAFGNTRPLAEILLKTSKVNINLFTKLSMPKNYSLLVESLQKRSNPDNIILEKSLSNELLTIRYNDILRYITLAMNGVEQSYTERSKEEGERVKNHLKETLNDVVYRYQGSVMTNTHIKGNSDIDLLVITDKFYTFDRAGIEKTLSDFNQTYYLNQTQIQRLKNELSGGGYSTALEDLRTNRLKSEKKLKDVYDICDITHAKAIKITNQSLKRDVDIVIANWYDNVNSVINGKNSDYRGIQVYNKDTNSKGKQDYPFLSIKRINERSSDTNGRLKKMIRFLKNVKADSGKEINLSSFDFNAICYDIDMKIYKNLSKYFLVPVIYNQLLRLVTNETLANNLKSVDEHEYIFRDKPEKYKSLGLLLEEVTVIYLDLNPQLL

SEQ ID NO: 1931 - protein, 351 aa, Riemerella anatipestifer
MPKNYSLLVESLQKRSNPDNIILEKSLSNELSTIRYNDILRYITLAMNGVEQSYTERSKEEGERVKNHLKETLNDVVYRYQGSVMTNTHIKGNSDIDLLVITDKFYTFDRAGIEKTLSDFNQTYYLNQTQIQRLKNELSGGGYSTALEDLRTNRLKSEKKLKDVYDICDITHAKAIKITNQSLKRDVDIVIANWYDNVNSVINGKNSDYRGIQVYNKDTNSKGKQDYPFLSIKRINERSSDTNGRLKKMIRFLKNVKADSGKEINLSSFDFNAICYDIDMKIYKNLSKYFLVPVIYNQLLRLVTNETLANNLKSVDEHEYIFRDKPEKYKSLGLLLEEVTVIYLDLNPQLL

SEQ ID NO: 1932 - protein, 351 aa, Riemerella anatipestifer
MPKNYSLLVESLQKRSNPDNIILEKSLSNELLTIRYNDILRYITLAMNGVEQSYTERSKEEGERVKNHLKETLNDVVYRYQGSVMTNTHIKGNSDIDLLVITDKFYTFDRAGIEKTLSDFNQTYYLNQTQIQRLKNELSGGGYSTALEDLRTNRLKSEKKLKDVYDICDITHAKAIKITNQSLKRDVDIVIANWYDNVNSVINGKNSDYRGIQVYNKDTNSKGKQDYPFLSIKRINERSSDTNGRLKKMIRFLKNVKADSGKEINLSSFDFNAICYDIDMKIYKNLSKYFLVPVIYNQLLRLVTNETLANNLKSVDEHEYIFRDKPEKYKSLGLLLEEVTVIYLDLNPQLL

SEQ ID NO: 1933 - protein, 351 aa, Riemerella anatipestifer
MPKNYSLLVESLQKRSNPDNIILEKSLSNELSTIRYNDILRYITLTMNGVEQSYTERSKEAGERVKNHLKETLNDVVYRYQGSVMTNTHIKGNSDIDLLVITDKFYTFDRAGIEKTLSDFNQTYYLNQTQIQRLKNELSGGGYSTALEDLRTNRLKSEKKLKDVYDICDITHAKAIKITNQSLKRDVDIVIANWYDNVNSVINGKNSDYRGIQVYNKDTNSKGKQDYPFLSIKRINERSSDTNGRLKKMIRFLKNVKADSGKEINLSSFDFNAICYDIDMKIYKNLSKYFLVPVIYNQLLRLVTNETLANNLKSVDEHEYIFRDKPEKYKSLGLLLEEVTVIYLDLNPQLL

SEQ ID NO: 1934 - protein, 305 aa, Riemerella anatipestifer
MNGVEQSYTERSKEEGERVKNHLKETLNDVVYRYQGSVMTNTHIKGNSDIDLLVITDKFYTFDRAGIEKTLSDFNQTYYLNQTQIQRLKNELSGGGYSTALEDLRTNRLKSEKKLKDVYDICDITHAKAIKITNQSLKRDVDIVIANWYDNVNSVINGKNSDYRGIQVYNKDTNSKGKQDYPFLSIKRINERSSDTNGRLKKMIRFLKNVKADSGKEINLSSFDFNAICYDIDMKIYKNLSKYFLVPVIYNQLLRLVTNETLANNLKSVDEHEYIFRDKPEKYKSLGLLLEEVTVIYLDLNPQLL

SEQ ID NO: 1935 - protein, 351 aa, Tenacibaculum agarivorans
MMKDYKKLIKNIQTRTNPENISLKKEFIAGLSAISYSDVLKYIRYAMKGVEPEYTQKSKLAGERVQNHLKNNLTNVVYKYQGSVMTNTHIKGTSDIDLLVIANTFYTFDRASINNILTNENLKASLNSFQIEKLKNELNGGGYSNDIKDLRNNRIGSENTLLPIYDICDISHPKAIKITNKSLNRDVDIVIANWYDNVTAILKNKEPDFRGIQVYDKKLNIKGKVDYPFLSIQRINTKSRETNGRLKKMIRFLKNVKVDSDLEINLSSFDINAICFDINTNKYFDKSFYELVPVIYNQLKRLTNNPQLAHDLKSVDGNEFIFRDDSKKFQSLQSLITEIDLILLDLKKTIL

SEQ ID NO: 1936 - protein, 353 aa, Tenacibaculum ovolyticum
MTKNYKQLSEKIKNRLNPENISIKKAFSEELGTISYSHILVFIRTAMKGVEPEYTKKSKDAGERVKTHLNTVLTDKTYKYQGSVMTNTHIKGASDIDLLVISEKFYSYDLKRINNILSDPNQKSQYYNSSIQKLEKEKSGSNYLGNSIEDLHKLRIDSENVLIPIYDICDISKPKNIKIKNKNLNREVDVVIANWYDDVSSIINDKGEFRGVQVYNKLTKTKGKSDYPFLSIKRINEKNSLTNGRLKKMIRFLKNVKYFSQIDIKLSSFDINAICYEIDISKYKDKSFYQLVPVIYSQLYSLSTNNQHSDDLISVDGREYIFRHDKEKHTEMLSLLKEINDIASDLNKTPIYG

SEQ ID NO: 1937 - protein, 248 aa, Aggregatibacter actinomycetemcomitans
MSNYNFRIKNISNRLNPDNLELATNLSDEEYPSIFYTDVTRYVKLAMKGVDPLYTRKSKEAGEKVKSHLLNELDNVEYEYQGSVMTDTHIKGNSDIDLLVISTKFYTFDREGITKLINDPVEIRNLNQLQINSLKKELSGTGYHGALEDLRHNRIQSESTLKGIYDICDCTHPKAIKIKNKTLNRDVDIVIANWYDNSSSVLNDKKKQYRGIQVYDKDNNSKCSPDYPFLSIYRINEKNSNTNGRLKK

SEQ ID NO: 1938 - protein, 352 aa, Aggregatibacter actinomycetemcomitans
MSNYNFRIKNISNRLNPDNLELATNLSDEEYPSIFYTDVTRYVKLAMKGVDPLYTRKSKEAGEKVKSHLLNELDNVEYEYQGSVMTDTHIKGNSDIDLLVISTKFYTFDREGITKLINDPVEIRNLNQLQINSLKKELSGTGYHGALEDLRHNRIQSESTLKGIYDICDCTHPKAIKIKNKTLNRDVDIVIANWYDNSSSVLNDKKKQYRGIQVYDKDNNSKCSPDYPFLSIYRINEKNSNTNGRLKKMIRFLKNIKIDSELDIQLSSFDINAICYQIDKSLYISKNKYELIEVIFNQLNSLAHNINYLENLKSVDEREYIFRGKESKINSLILLLKEVYSILEDLKKEDIL

SEQ ID NO: 1939 - protein, 353 aa, Aggregatibacter actinomycetemcomitans
MSNYNFRIKNISNRLNPDNLELATNLSDEEYPSIFYTDVTRYVKLAMKGVDPLYTRKSKEAGEKVKSHLLNELDNVEYEYQGSVMTDTHIKGNSDIDLLVISTKFYTFDREGITKLINDPVEIRNLNQLQINSLKKELSGTGYHGALEDLRHNRIQSESTLKGIYDICDCTHPKAIKIKNKTLNRDVDIVIANWYDNSSSVLNDKKKQYRGIQVYDKDNNSKCSPDYPFLSIYRINEKNSNTNGRLKKMIRFLKNIKIDSELDIQLSSFDINAICYQIDKSLYISKNKYELIEVIFNQLNSLAHNINYLENLKSVDEREYIFRGKESKINSLILLLLKEVYSILEDLKKEDIL

SEQ ID NO: 1940 - protein, 327 aa, Sphingobacteriia bacterium
MAKNYRQLTESIRGRLNPENFALKKAFSDELSTISYSDVLTYIRLAMKGVEPEYTQKSRDAGERVKEHLGKELKDVSFKYQGSVMTDTHIKGYSDIDLLTICEKFYQPDTRNFKEIIETPERRAKYYQTSIDKLQREINLTSYTGNALNDLRELRLDSERILSGVYQTRDLTKPKAIKIKNLSLNREVDIVIANWYDDVSSVINDKGDYRGIQVYNKDTHSRESADFPFLSIKRINERSSETNGRLKKMIRFLKNSKANSDHEIDLSSFDINAICYDIKVSEYQNLSFYELVPVLYNQMKSICTNQAHADDLVSVDGKEYIYRNRLY

SEQ ID NO: 1941 - protein, 352 aa, Bacteroidetes bacterium
MAKNYRQLTESIRGRLNPENFAIKKAFSDELSTISYSDVLTYIRLAMKGVEPEYTQKSRDAGERVKEHLGKELKDVSFKYQGSVMTDTHIKGYSDIDLLTICEKFYQPDTRNFKEIIETPERRAKYYQTSIDKLQREINLTSYTGNALNDLRELRLDSERILSGVYQTRDLTKPKAIKIKNLSLNREVDIVIANWYDDVSSVINDKGDYRGIQVYNKETHSRESADFPFLSIKRINERSSETNGRLKKMIRFLKNSKANSDHEIDLSSFDINAICYDIKVSEYQNLSFYELVPVLYNQMKSICTNQTHADDLVSVDGKEYIYRNRPAKLSNLKLLLAEVEAIFIDFKTTVRV

SEQ ID NO: 1942 - protein, 307 aa, Niabella drilacis
MKGVEPEYTQKSKDAGERVKEHLSKELSQVSFKYQGSVMTNTHIKAYSDIDLLTISEKFYQADNYEIRQILENSDRRAKYYSLSINKMEKELNASSYQGNSLDDLRYNRTKSEEVLSEVYSICDTSKPKSIKIENLSLKREVDIVIANWYDDVKSVINDKGEYRGIQIYNKEKHQRENADFPFLSIMRINERGNETTGRVKKMIRFIKNIKALSDHEIKLSSFDINAVCYDIGIEKYKSLSFYQLVPVIYNQLKSICENKTHSDNIVSVDGREYIFRYNSEKLKNLKLVLNELQSIYLDLYTNILSK

SEQ ID NO: 1943 - protein, 353 aa, Niabella drilacis
MPKNYRQLTESVRNRINPEHRALTKAFSDELSTISYSDVLVFIRTAMKGVEPEYTQKSKDAGERVKEHLSKELSQVSFKYQGSVMTNTHIKAYSDIDLLTISEKFYQADNYEIRQILENSDRRAKYYSLSINKMEKELNASSYQGNSLDDLRYNRTKSEEVLSEVYSICDTSKPKSIKIENLSLKREVDIVIANWYDDVKSVINDKGEYRGIQIYNKEKHQRENADFPFLSIMRINERGNETTGRVKKMIRFIKNIKALSDHEIKLSSFDINAVCYDIGIEKYKSLSFYQLVPVIYNQLKSICENKTHSDNIVSVDGREYIFRYNSEKLKNLKLVLNELQSIYLDLYTNILSK

SEQ ID NO: 1944 - protein, 358 aa, Hymenobacter sp.
MPQNYQVLAENIKSRINPDHIALQRSFSAELATISYSDVLVYVRLAMKGVDEDYTRRTKDAGERVKDHLRASLTNVIFRYQGSVMTNTHIRAHSDIDLLTITNKFYTYDAYSAKKMLNEQANSLTYSQRQKLTNEVNVTGYSGSLLDDLRSLRLDCENILSSKYSVCDIEHAKAIKITNLSLGRDVDIVIANHYDDVVSIINDKGDYRGIQVYNKETHSRGDVDYPFMSIEKINARGIETVGRIKKMIRFLKNVKAKSNSDIRLSSFDFNAICYDINVDKYKYLSFYELVPVLYQQIKSLCDNQWHSDSLMSVDGREAIFKGHPDKLRHLRLILNEVTSIYSDMIDARIFGKTLVQMI

SEQ ID NO: 1945 - protein, 355 aa, Mucilaginibacter pineti
MAQNNYRDLINNVRNRLDPENLIIEKSIREELASISYSDVLEYVRYAMNGVEPAYTQRSKDAGENVKTHLTNGGITNASYRYQGSIMTNTHVKGYSDIDLLVISDKFYSVDVHNVKGILNESSRQIHYSSNQIFRLQVENAVSSYNGNSLDDLRKLRLDSEYILKNKYIIHDLTKPKSIKITNSGLRRDVDIVIANWYDDITSVINGKGDNRGIQIYNKDYHIQGKADYPFISIERINNKSTITSGRLKKMIRFLKNLKGKSTLAIELSSFDFNAICYDIDQAKYQNLIFHQLVPVLYTQLKTLATNQTAADNLVSVDGREYIFRNQPHKMESLKNLVIEIESIVADLKSNRVLL

SEQ ID NO: 1946 - protein, 308 aa, Mucilaginibacter pineti
MNGVEPAYTQRSKDAGENVKTHLTNGGITNASYRYQGSIMTNTHVKGYSDIDLLVISDKFYSVDVHNVKGILNESSRQIHYSSNQIFRLQVENAVSSYNGNSLDDLRKLRLDSEYILKNKYIIHDLTKPKSIKITNSGLRRDVDIVIANWYDDITSVINGKGDNRGIQIYNKDYHIQGKADYPFISIERINNKSTITSGRLKKMIRFLKNLKGKSTLAIELSSFDFNAICYDIDQAKYQNLIFHQLVPVLYTQLKTLATNQTAADNLVSVDGREYIFRNQPHKMESLKNLVIEIESIVADLKSNRVLL

SEQ ID NO: 1947 - protein, 351 aa, Chitinophaga sp.
MPQNYKELTRQLRSRLDPESLIFEKSINEELSSINYSDVVEYVRYAMNAVEPAYTQRSKDAGERVKTHLTSGGITDAIFRYQGSVMTDTHIRGYSDIDLLVISDKFYSWDSAGVSRALNESYNYQTAQVQKLQYETNIGGYSGNALDDLYQLRINSETILSQKYSVCDTSKPKSIRINNKDLKRDVDVVIANWYDDVVSIINNKGDNRGIQVYNKHEHVKGKVDYPFVSIERVNTKSAETSGRLKKMIRFLKNIKAKSGLVIDLSSFDCNAICYDIQVAKYQYSTFYQLVPVLYQQLKRLVDDVNAANSLKSVDGREYIFLGKPDKIQSLKNLMTEIDAILFDLRNSHIQL

SEQ ID NO: 1948 - protein, 305 aa, Chitinophaga sp.
MNAVEPAYTQRSKDAGERVKTHLTSGGITDAIFRYQGSVMTDTHIRGYSDIDLLVISDKFYSWDSAGVSRALNESYNYQTAQVQKLQYETNIGGYSGNALDDLYQLRINSETILSQKYSVCDTSKPKSIRINNKDLKRDVDVVIANWYDDVVSIINNKGDNRGIQVYNKHEHVKGKVDYPFVSIERVNTKSAETSGRLKKMIRFLKNIKAKSGLVIDLSSFDCNAICYDIQVAKYQYSTFYQLVPVLYQQLKRLVDDVNAANSLKSVDGREYIFLGKPDKIQSLKNLMTEIDAILFDLRNSHIQL

SEQ ID NO: 1949 - protein, 373 aa, Chryseobacterium frigidisoli
MRVSGKATEKPHKNNLKLEILEMAKSYRQLIESVKGRINPEHFALKKTFSDELSTISYSEVLTYIRLSMKGVEPEYTQKSKDAGERVKEHLLKGLSDVSFKYQGSVMTDTHIKGYSDIDLLTICEKFYQPDSYNIKKLLENSEQRVKFFSSIPKLEKEVTGTTYQGKSLEDLRNLRIDSENILKGIYSICETTKPKSIKIKNLSLNREVDVVIANWYDDITSVINDKGDYRGIQVYNKDTNSREEADYPFLSIKRINERSSLTNGRLKKMIRFLKNNKANSDHNIDLSSFDINAICYDINVNEYQTLSFYELVPIIYNQLKKITTDEFKADNLVSVDGREYIFKNNSAKKENLKNLLAEVEGIFIDLKSILRI

SEQ ID NO: 1950 - protein, 351 aa, Chryseobacterium frigidisoli
MAKSYRQLIESVKGRINPEHFALKKTFSDELSTISYSEVLTYIRLSMKGVEPEYTQKSKDAGERVKEHLLKGLSDVSFKYQGSVMTDTHIKGYSDIDLLTICEKFYQPDSYNIKKLLENSEQRVKFFSSIPKLEKEVTGTTYQGKSLEDLRNLRIDSENILKGIYSICETTKPKSIKIKNLSLNREVDVVIANWYDDITSVINDKGDYRGIQVYNKDTNSREEADYPFLSIKRINERSSLTNGRLKKMIRFLKNNKANSDHNIDLSSFDINAICYDINVNEYQTLSFYELVPIIYNQLKKITTDEFKADNLVSVDGREYIFKNNSAKKENLKNLLAEVEGIFIDLKSILRI

SEQ ID NO: 1951 - protein, 351 aa, Flavobacterium psychrophilum
MAKNYKLLTESIKGRTNPDHFILTKTFSDELSTISYSDVLTYIRFSMKGVEPEYTQKSKDAGERVKEHLSKELNDITFKYQGSVMTDTHIKGFSDIDLLTISEKFYQADKTKIKTLLENSEQRVKFSSSVPKLEKEINASSYQGNALQDLSSLRLDSEKILMGVYTNCETNKPKSIKIKNLSLNREVDVVIANWYDDISSVINDKGDYRGVQVYNKDTNSRGNADYPFLSIRRINERSSITNGRLKRMIRFMKNSKANSEQDIDLSSFDINAICYDINIDDYKTLSFYELVPIIYNQMKKIATDETKADNLVSVDGREYIFRNNNSKKENLKKLLAEVEGVFIDLKNILRI

SEQ ID NO: 1952 - protein, 351 aa, Maribacter sp.
MQKDYQQLISSVRGRINPDNFALKKAFSEELSTISYSQVLIYIRLAMKGVEPEYTQKSKDAGERVKEHLSIELENVEFRYQGSVMTNTHIRGYSDIDLLTISDKFYSYDVNNIQQLLASSERRSKYYRSSIEKLEKEVNTSPYLGNSIQDLRDLRINSENVLNRIYSVCDTSKPKAIKIKNLNLNREVDIVIANWYDDISSIINNKGDYRGIQIFNKTTDSKENPDYPFLSIKRINERSSETNGRLKKMIRFLKNSKANSNQDIDLNSFEINAICYDINPSKYESLSFYELVPVIYNQMKEIATDDSKANNLVSVDGREYIFRHKQSKKDNLRILLAEIEAIFVDLKRTLV

SEQ ID NO: 1953 - protein, 352 aa, Leeuwenhoekiella nanhaiensis
MQQDYQQLISSVRGRINPENFALKKSFSDELATISYSKVLIYVRLAMKSVEPEYTQKSKNAGERVKEHLNRELENVSFRYQGSVMTNTHIRGYSDIDLLTISDKFYSYDASRIKELLASSERRAKYYNSSIEKLEREVNTSPYLGNSIQDLRDLRNNSENILRGIYSVCDTSKPKAIKIKNLSLNREVDIVIANWYDDISSIINNKGDYRGIQIYNKASNSKENPDYPFLSIKRINERSSETNGRLKKMIRFLKNSKANSNQDISLTSFDINAICYDISPNIYKSLTFYELVPIIYNQMKDIVTNDDKANNLVSVDGRDYIFRYHQTKRDDLSKLLSEIEAIFIDLKKSINV

SEQ ID NO: 1954 - protein, 352 aa, Pedobacter panaciterrae
MIQNNYRALSESVRLRQNPENLAFTKSFSDELSSVSYADVLTYVKLAMNAVDPDYTQRSKEAGEMVKNHLTSNGLKDVTFKYQGSVMTDTHIKGVSDIDLLAISDKFYSRALSEVNAILNDNDRKQRYQPSQVSSLVLEQSLPVYEGSSNQDLKKLRLDSETILSGKYQDCKTEKPKSIKIYNSNLKREVDIVIANWYDDIRSITNNRGENRGIQIYNKDKHNVGDADYPFLSIQRINERSAETSGRLKKMIRFMKSIKAKSTLGIDLNSFEFNAICYNIPKTKYEQLAYYELVFVIFQQIKNLSQNEDLANNLLSVDGSEYIFRDKPEKMQSLINLVIEVEAVYLDIEKTL

SEQ ID NO: 1955 - protein, 351 aa, Capnocytophaga granulosa
MEKKNYSALFENLQNRSNPEKLQEITTKFFSDNPDVKYNDVLKYITLAMNGVSPEYTNKSREAGEKVKLHLQDILLDVEYQYQGSVMTNTHIKGYSDIDLLVISDKFYTLDERNIIENLEVNKFSLSQEKIQKLQQELLGKKYHSATNDLKNNRLLSEQKLSSVYEICDITHPKAIKITNKSMGRDVDIVIANWYDDAQSVINNRQIEYRGIQIYNKRSNTIENRDFPFLSIQRINKRSSETKGRLKKMIRFLKNLKADSDEKIELSSFDINAICYNIEKNKYLHSNKYQLVPILYEQLNELVSNSNKINSLKSVDGHEYIFSRNNIDKKESLKMLLQEVKIIYSNLQSYL

SEQ ID NO: 1956 - protein, 360 aa, Moheibacter sediminis
MRNYDELVREVKSRTNPESISERRLFGENYEHEFKVQAPTLVLEYIKRAMDGVGEDYTRRSKEAGEAVKNHLKACLSNVDYEYQGSVMTNTHIRGNSDIDLLVISNLFHFNDWSGVDSVLNNSLEKLLLESYQLTNLRYARESSTSYQGNFLADLKRNRTESENKLTNEYDECNISKPKAIRLKNKNLHREVDVVIACWYRTVQAIKENEKKFRSIQIYDKSENSIGRVESPFVSIDRINSKDNSVNGRLKKMIRFLKNLKVDSGTKINLNSFDINAICYKIDINNYSGKKYYELVPVLVDEFYRLISNESYRNSVKSVDGSEYIFYGKPDKVKALRELEEELGKVFGDFQLIPNFNYSL

SEQ ID NO: 1957 - protein, 311 aa, Moheibacter sediminis
MDGVGEDYTRRSKEAGEAVKNHLKACLSNVDYEYQGSVMTNTHIRGNSDIDLLVISNLFHFNDWSGVDSVLNNSLEKLLLESYQLTNLRYARESSTSYQGNFLADLKRNRTESENKLTNEYDECNISKPKAIRLKNKNLHREVDVVIACWYRTVQAIKENEKKFRSIQIYDKSENSIGRVESPFVSIDRINSKDNSVNGRLKKMIRFLKNLKVDSGTKINLNSFDINAICYKIDINNYSGKKYYELVPVLVDEFYRLISNESYRNSVKSVDGSEYIFYGKPDKVKALRELEEELGKVFGDFQLIPNFNYSL

SEQ ID NO: 1958 - protein, 360 aa, Myroides sp.
MAKNYSFLVDRVKSRSNPENLSYTKLFGEDFNRDYLNVSGNKILEYIKLSMQGVGKEYTDKSFQAGDAVKTHLSSVLSSVNYEYQGSVMTNTHIKGNSDIDLLVISNRSYFFDYDIKSKYEETIRYFNLNESQKQRVNEHLNATSYSGNTLQDLRNNRINSETKLESVYTIFNNEKPKCIQITNQNVHRDVDIVFASWHKTFEGLKEANNKKNKIKIYDYHQHELGRVESPFISIDLINTKDAYVNGRLKKMIRFIKTIKADSEVDINLSSFDINAICFNIPIDKYQDKIYSELVKVIYDEFCKIITDENYRNSIKSVDGSEFIFYGKEDKLLRISQIVSEIDYLRKELEKNTLITRIYS

SEQ ID NO: 1959 - protein, 345 aa, Bacteroides finegoldii
MADYTSLINRIESRYNPDSLREVRQNSIYSLSGIDKDIAKYVKLAMNEVDPIYTNKTLEAGENAKSHLQRELQQSVNFRYQGSVMTRTHIRGVSDIDLLTITSKFQDTDYSKAKAFVESHPYSYDTETMRIKNWVNNFTRYFGDANNDLRQLRLEDERILQSHYVICDIAKPKSIRITNQNLHRDVDVVVASWHDSLEYISGNGDVYRGIYIYDKQKNERLGPDYPFLSIDRINTRSSYTEGRLKKMIRFLKNVKADASVNIDLTSFDINAICYDINIEEYRNSYYLDLVRVLWLKLYHLCQNESEANGLKSVDGTEYIFRNNPSKFDNLKRLHNEVWNIYKELQ

SEQ ID NO: 1960 - protein, 300 aa, Bacteroides sp.
MNEVDPIYTNKTLEAGENAKSHLQRELQQSVNFRYQGSVMTRTHIRGVSDIDLLTITSKFQDTDYSKAKAFVESHPYSYDTETMRIKNWVNNFTRYFGDANNDLRQLRLEDERILQSHYVICDIAKPKSIRITNQNLHRDVDVVVASWHDSLEYISGNGDVYRGIYIYDKQKNERLGPDYPFLSIDRINTRSSYTEGRLKKMIRFLKNVKADASVNIDLTSFDINAICYDINIEEYRNSYYLDLVRVLWLKLYHLCQNESEANGLKSVDGTEYIFRNNPSKFDNLKRLHNEVWNIYKELQ

SEQ ID NO: 1961 - protein, 300 aa, Butyricimonas sp.
MNEVDPIYTNKTLEAGENAKSHLQRELQQSVDFRYQGSVMTRTHIRGVSDIDLLTITCKFQDTDYSKAKAFVENHPYSYDAETMRIKNWVNSFNRYTGDANYDLRQLRLEDERILQSHYVICDITKPKSIRITNQNLHRDVDVVVASWHDSFGYISGNGDVYRGIYIYDKQKNDRLGPDYPFLSIDRINTRSSYTEGRLKKMIRFLKNVKADASVNIDLTSFDINAICYDINIEEYRNSYYLDLVRVLWLKLYHLCQNESEANGLKSVDGTEYIFRNNPSKLENLKRLHNEVWNIYKEIQ

SEQ ID NO: 1962 - protein, 363 aa, Prevotella corporis
MDEYFICILFQYKYIYIIMNYQQKIRTLSSRYNPEASVLIEQRQFSDVYSSDDDVVKYVKSAMAAVDADYTNKTKEAGTCVKQHLKGTLQHVSYEYQGSVMTDTHIKGASDIDLLVLSEKFYGTEIDKVRVELQNQAKYSQYQINRLQNYNNAFSLYQGDSTQDLAQLRSDIEEIMTATYSLCDIDNSKAVKITNQHLHRDVDIVTSSWFQSLDYVLEGMPQERRGINIYNKEKGYAEGPDYPFLSISRINSRSAKTQGRLKRMIRFLKNVRTDSDYDIPLNSFEINAICYSIPIQDYYNLNFKDLVYIVWYNMYHLWKDNKENQLRSVVGDEYVFLGKPNKVQALKVLEDEVYQIYNDLKNI

SEQ ID NO: 1963 - protein, 345 aa, Prevotella corporis
MNYQQKIRTLSSRYNPEASVLIEQRQFSDVYSSDDDVVKYVKSAMAAVDADYTNKTKEAGTCVKQHLKGTLQHVSYEYQGSVMTDTHIKGASDIDLLVLSEKFYGTEIDKVRVELQNQAKYSQYQINRLQNYNNAFSLYQGDSTQDLAQLRSDIEEIMTATYSLCDIDNSKAVKITNQHLHRDVDIVTSSWFQSLDYVLEGMPQERRGINIYNKEKGYAEGPDYPFLSISRINSRSAKTQGRLKRMIRFLKNVRTDSDYDIPLNSFEINAICYSIPIQDYYNLNFKDLVYIVWYNMYHLWKDNKENQLRSVVGDEYVFLGKPNKVQALKVLEDEVYQIYNDLKNI

SEQ ID NO: 1964 - protein, 347 aa, Prevotella intermedia
MNYQQKLTALSARYNPDSINLFERERRQFSDAYSSGGDVVKYVKHAMAAVEPEYTSKTKEAGEAVKQKLKETLQNVSYEYQGSVMTDTHIKGASDIDLLVLSEKFYRTEIDKVRTELQQPWKYDLNQINRLQSFNSSFSLYQGNGNQDLTQLRNDIEKIMKNTYKECDVNNAKAVKITNLHLHRDVDIVTSSWFQSLDYVLEGMPKEMCGINIYNKDKGYAEGPDYPFLSISRINSRSSDTNGRLKRMIRFLKNVRTDSDNDIPLNSFEINAICYSIPIQDYYNVDFKSLINILWRNMYSLWHDGKENLLKSVVGDEYVFLGKRDKIKALKDLEDEVYKINQDLGNI

SEQ ID NO: 1965 - protein, 284 aa, Prevotella intermedia
MNYQQKLTALSARYNPDSINLFERERRQFSDAYSSGGDVVKYVKHAMAAVEPEYTSKTKEAGEAVKQKLKETLQNVSYEYQGSVMTDTHIKGASDIDLLVLSEKFYRTEIDKVRTELQQPWKYDLNQINRLQSFNSSFSLYQGNGNQDLTQLRNDIEKIMKNTYKECDVNNAKAVKITNLNLHRDVDIVTSSWFQSLDYVLEGMPKEMCGINIYNKDKGYAEGPDYPFLSISRINSRSSDTNGRLKRMIRFLKNVRTDSDNDIPLNSFEINAICYSIPIQDYYN

SEQ ID NO: 1966 - protein, 348 aa, Porphyromonas sp.
MDYKSKLITLSNRYNPERVSLFEARHFSNSGLLSTDRDVVQYVKKAMCAVDEDYTQKTKQAGEAAKGHLERVLRDVSFEYQGSVMTDTHIKGASDIDLLVLCNKFYDTEITKVRKEIQSPSLNYTPQEVYRLSRYNQCFSEYQGNSYADLANLRADIERTMKYIYDECDTSHAKAVKIRNKHLHRDVDIVTASWFQSLNYVLHDMPKEELGIKIYNKDKGYAEGPDYPFMSISKINSRSADTNGRLKRMIRFLKNVRTDSEQEIPLTSFDINAICYSIPVRDYIYLDYKGLVHILWSTMFYLWHGHQEGQLKSVVGDEYVFQGKPEKVEALKMLEDEVYKIKTDLEKV

SEQ ID NO: 1967 - protein, 348 aa, Porphyromonas gulae
MDYKSKLITLSNRYNPERVSLFEARHFSNSGLLSTDRDVVQYVKKAMCAVDEDYTQKTKQAGEAAKGHLERVLRDVSFEYQGSVMTDTHIKGASDIDLLVLCNKFYDTEITKVRKEIQSPSLNYTPQEVYRLSRYNQCFSEYQGNSYADLANLRADIERTMKYIYDECDTSHAKAVKIRNKHLHRDVDIVTASWFQSLNYVLHDMPKEELGIKIYNKDKGYAEGPDYPFMSISKINSRSADTNGRLKRMIRFLKNVRTDSEQEIPLTSFDINAICYSIPVRDYIYLDYKGLVHILWSTMFYLWHDHQEGQLKSVVGDEYVFQGKPEKVEALKMLEDEVYKIKTDLEKV

SEQ ID NO: 1968 - protein, 347 aa, Porphyromonas gingivalis
MDYKSKLVTLSNRYNPERVPLFETRHFSNSGLQSTDRDVVQYVKKAMCAVDEDYTRKTKEAGEAAKGHLERVLRDVSFEYQGSVMTDTHIKGVSDIDLLVLCEKFYGSDIHRVREELQRQYLYTTEELSRLRSYDQSFYSYQGNSSEDLGNLRAGIERTMKYIYDECDTSHAKAVKIRNKHLNRDVDIVTSSWFQSLSYVLHDMPKEELGIKIYNKDKGYAEGPDYPFLSISRINSRSAETNGRLKKMIRFLKNVRTDSDLNIPLTSFDINAICYSIPVLDYINLDYRGLVRVLQSTIYYLCTDYKAGELTSVVGDEYVFRGKPEKVEALKALGLEVYQIETELDKR

SEQ ID NO: 1969 - protein, 345 aa, Unknown
  Description of Unknown: Bacteroidales sequence
MDYSQKLRKINNRYNPDSSMLVEQRMFSGESLYDKDVARYVMRAMKAVDEEYTKRSKAAGEVVKQHLKELLTNVSYEYQGSVMTDTHIRGASDIDLLVLCDKFVGTDIFKVREELAKTWKYNSYQLGRLCQFDNSFSQYEGNSFRDMAFLRTQIEKIMSRTYTICDISKPKAVKITNQNLHRDVDIVTSSWFQSLDYVLDGMPENKRGIKIYNKSTGFSEGPDYPFLSISRINQRSSDTNGRLKRMIRFLKNVRTDSEKDIPLTSFEINAICYSIPVQDYAQKEYKELVYILWYSMFHLWNDGKQDELKSVVGDEYIFKDKPEKLAALKVLEDEVYKINKDLGNI

SEQ ID NO: 1970 - protein, 345 aa, Bacteroides caccae
MDYSQKLRKINNRYNPDSSMLVEQRMFSGESLYDKDVAKYVMRAMKAVDEEYTKRSKAAGEVVKQHLKELLTNVSYEYQGSVMTDTHIRGASDIDLLVLCDKFVGTDIFKVREELAKTWKYNSYQLGRLCQFDNSFSQYEGNSFRDMAFLRTQIEKIMSRTYTICDISKPKAVKITNQNLHRDVDIVTSSWFQSLDYVLDGMPENKRGIKIYNKSTGFSEGPDYPFLSISRINQRSSDTNGRLKRMIRFLKNVRTDSEKDIPLTSFEINAICYSIPVQDYAQKEYKELVYILWYTMFHLWNDGKQDELKSVVGDEYIFKDKPEKLAALKVLEDEVYKINKDLGNI

SEQ ID NO: 1971 - protein, 345 aa, Prevotella salivae
MDYSQKLRQINNRYNPDSSVLVEQRMFSGESAYDKDVARYVMRAMKAVDDEYTKRTKAAGEVVKQHLRESLTNVSYEYQGSVMTDTHIRGASDIDLLVLCEKFVGTDIFKVRQELAKTWKYNDCQIGRLCQFDNSFSQYEGNSSQDMASLRTQIEKIMSRTYTICDTSKPKAVKITNQNLHRDVDIVTSSWFQSLDYVLDGMPENERGIKIYNKSTGLSEGPDYPFLSISRINQRSADTNGRLKRMIRFLKNVRTDSEKDIPLTSFEINAICYSIPVQDYVQKEYKDLVYILWHTMFHLWNDGKQDDLKSVVGNEYVFKDKPEKLAALKVLEDEVYKINKDLGNI

SEQ ID NO: 1972 - protein, 346 aa, Prevotella paludivivens
MSNINYTNHITRINSRYNPDNNRIVENRTFSATSDDPIEAAKYVHMAMREVDETYTRITRDAGDAVKKILSAKLSDVDFEYQGSVMTDTHIKGYSDIDLLTICNRFNHTEISKVREAINNSWHYNISQLDNLKNYNNSFYPYQGNARADLRKLRLDNESLLNSTYTICDTTKPKAIKITNQHLHRDVDIVTSTWYDSLEYVLSGNDQKHRGIKIYQKDTDSETEPDYPFLGISMINERSSFTNGRLKRMIRFLKNVRSDADAEIKLTSFDINAICYNISPKEYLLMDYKQLVFLLWNKMYHLCNNEEIDDLKSVVGTEYVFRNKPEKVSALRLLENEVWEIYNEIK

SEQ ID NO: 1973 - protein, 349 aa, Bacteroidales bacterium
MADYRQLAQSVQNRLNPDRELLIERKMFSDLSDASTDILKYIKLAMRGVEPEYTQKSKEAGERVKDHLAPLSNVIFKYQGSVMTNTHIKGSSDIDLLTICDKFYSWDRAGIESVLNSYIEKANYSTNAINKLEKEVQNFSPYLGTPTDDLRQIRLDSENILQQKYIQCDISNGKAIKIRNLSLKRDVDIVTASWYDNVNSVINDKDADFRGIQVYDKNRNERCPVDYPFLSIKRINERGNETNDRLKKMIRFLKNIKADSNQNIDLSSFDINAICYDIDISKYIDKSYYELVYTIYLQLDSICKNKTHSDRIVSVDGKEFIFRNNENKLLNLRKLMTELTTIFVDLYNH

SEQ ID NO: 1974 - protein, 353 aa, Tenacibaculum maritimum
MAKDYESLIRKVKNRTNPDITNESVLLEKSFRDELGRTTVKANEYVKRVMRGVEPRYTERTFEAGKKVREHLKKNNPNLDFEFQGSVMTNTHIKGHSDIDLVQITNRFYFHEGRQNFQKAKESFEYSYTEKERLSVIAEGTSFEGDDKMTLREIRIDAENVLNREYKYVDTTKGKSIEVKPTNPSRKVDVVTASWYKNVKAVAKADKEERGIKIYDKNDHKILPEDFPFRKIKLVNQKDSGVNGRLKKMIRFLKNVKVDSDYKIDLTSFDITSISYNIPTYKYYDKSYLELVHVIYEEMYKIYSDKVYRDSIKSVDDTEYIFRNNPEKVEHLRTLLTEVNLIKNDIIVASFIY

SEQ ID NO: 1975 - protein, 353 aa, Tenacibaculum agarivorans
MAKDYESLIRKVKNRTNPDIVNESVLLEKSFRDELGRTTVKANEYVKRAMRGVEPRYTERTFEAGKKVREHLKKNNSSLDFEFQGSVMTNTHIKGHSDIDLVQITNRFYFHEGRQNFQKAKESFEYSYTEKERLSVIAEGTSFEGDDKMTLREVRIDAENVLNREYKYVDTTKGKSIEVKPTNPSRKVDVVTASWYKNVKAVAKADKEERGIKIYDKNDHKILPEDFPFRKIKLVNQKDSGVNGRLKKMIRFLKNVKVDSDYKIDLTSFDITSISYNIPTYKYSDKSYLELVHVIYEEMYKIYFDKVYRDSIKSVDDTEYIFRNNPEKVEHLGTLLTEVNLIKNDIIGASFIY

SEQ ID NO: 1976 - protein, 361 aa, Chryseobacterium hispalense
MRKNYTSLIEKVKNRSNPDFINESVLFNKAFSDELGQLRSSGKQVLEYVRRSMNGVEARYTERTIEAGDKLKGHLKRNNSSVDYRYQGSVMSNTHIKGHSDIDLIQITNSFYSHEITQNFSMKYISEPNMSFNQKQKLLNVINATPYSGNSNSDLRLLRLNAEVVLLSTYKNVDTDKPKSIEVNPTDPNRIVDVVTAAWYRSVDSEFNEDETLRGIQIYDKKKNERLATDFPFLKISLINERSKETNGRLKKMIRFTKTLKADSEQDLKGLSSFDICSVCYNIPVHQYFNLAYYELVYVLYMEFKKISENEVYANSIKSIDGTEYIFYNKPDKIRLLRLLYKEILYVYQDLLPNTTALRFL

SEQ ID NO: 1977 - protein, 361 aa, Flavobacterium columnare
MQKNYADLVQRAKNRSNPDSIRETELFSKSFNEDFRGLGIPYSEVFEYVKRAMQGVESEYTERTIEAGNKIKEHLKRNNSSLDYKFQGSVMCNTHIKGHSDIDLVQITNSFYSHEPIVKFNEKFTSSSYLTLSQKQNLLSVINGTPYKDDARDNLRKIRLEAETVLTSNYKYVDITKSKSIEVNPTNPNRLVDVVTASWYKNVDSVLDNDTDKNGIQIYDKEKNLRLPVDFPFLKIRLLNEKDKSVNGRLKKMIRFLKTIKADSEYNLKEISSFDISSICYNIPTWKYSDKPYYELVLVLYSELKKIIEDENYRNSIRSIDNTEFIFKDKNEKVRLLRLIFNELLPIYQDLSPQTSFTKFL

SEQ ID NO: 1978 - protein, 357 aa, Cellulophaga sp.
MAKNYEELVNRVKSRYNPEAIDETTLLNESLRTELKALSGSKVMEYVKRSMQGVEPAYTQNTIVAGDKVKTHLKNNNPKLDYEYQGSVMSNTHIKGYSDIDLVQLCNKFYGHDLRTEFTEEYRKSNLTETQRWALLEVIEGSIYTGDADQDLRTMRLEAENVLDAMYNDVDISKDKSIEVNLTNPKRKVDVVTASWYRSVNSSKSGDKTDKGICIYDKNKDVRLPVDYPFLKIKMLNDKDKIVNGRLKKMIRFLKTIKADSDIKIKINSFDISSICYNIDSISYYNKPYYELVYVLQVELGKIIADDFYRNNIKSIDGTEYIFRDKPEKYGQLLMLLNELNTIKKDLVDNNAITRFL

SEQ ID NO: 1979 - protein, 357 aa, Psychroserpens sp.
MARNYDELVRRVKARYNPAEIDETTLLNESLRVELKALSGSKVMEYIKRSMQGVEPAYTQNTIVAGDKVKTHLKNNNPNLDYEYQGSVMSNTHIKGYSDIDIIQICNLFYGHDSRTRFTEEYRKDNLTEAQRWALLEVINGSIYVGDANQDLRKMRLEAEKVLSSIYNVVDLSKNKSIEVILTNPKRKVDVVTASWYKSVNAAKSGDKTEKGISVYDKSKNERLPVDFPFLKIKMLNEKDKTVNGRLKKMIRFLKTIKADSDIKIDISSFDISSVCYNINFLSYYDKPYYELVYVLQVELDHLVEDEFYRNNIKSIDGTEYIFRDKSEKHGQLSLLLNEINSIRKDLVDNNAITRFL

SEQ ID NO: 1980 - protein, 358 aa, Arenibacter algicola
MKKNYELLIQRVKQRSNPNAIDESVLLEKSFSAELKGLYDKKVLVYIKRAMQGVEPVYTSNTLVAGDKVKTQLKNLYPKLDYKYQGSVPSNTHIRGYSDIDLVQIGGGFYAHDDRSNFITEYQKPNLSQDQKIRLCEVINGAPYLGNSNEDLKKIRLNAEEVLTKAYKEVNILKAKSIEVNLTNPKRMVDVVTASWYKSVEAVLSANDYENGIQIYNKEKNHRLNADFPFLKIHLINKKDSDVNGRLKKMIRFLKTLKADSDIEIDFSSFDISSVCYNIEKIKYYDKSYDALVHVLHEELDRIAIDSVYRDTIQSIDKSEHIFRDKPEKIAQLKLLLDELKIIREDLFKDSLVKRFLS

SEQ ID NO: 1981 - protein, 365 aa, Flavobacterium daejeonense
MSKNYDQLIQKINQRSNPDSFTMKALFAEENVTSLLFENKKLKTAQVYIYVQKAMKGVASEYTSNSKIAANQVEAHLKRSHGSQVHFERQGSVMTNTHIIKDNDIDLVQITNKSKGVDHSGLKKALANPNTLNPIEYKNLKKHSDDFSQYEGNQLTDLRNIRKQSEEVLISTYKEVDVEKVNSIYVQVSSPKRDVDVVTATYYKGIDYMKTNRDYRRGIQIYNKELHKLSNVDFPFWSIKRINERSLLTNGRLKNMIRFIKNVKFDCDNIDNKGAIRSFHINAICYNINIAKYQYAHFLELVTVINDELIRILINKSYRDNIKSVDGTEIIFEKDCDKKLQEIRFLQAEINQIVIDLTLLNKQLI

SEQ ID NO: 1982 - protein, 365 aa, Flavobacteriaceae bacterium
MTKRYDQLIQKINQRSNPDSYTMKALFAEENVTSLLFENKKLKTAEVYMYVQKAMKGVAQEYTNNSKTAANQVEAHLKRSHGSGVHFERQGSVMTNTHIIKDNDIDLVQVTNKSKGVDHSGLKKALDNPQILNPIEFKNLKKHSDDFKQYEGSQLTDLKNIRKQSEEILASTYKEVDIKKVNSIYVQVSSPKRDVDVVTATYYKGVDYMKTNRDYRRGIQIYNKELHRLSNVDFPFWSIKRINERSILTNGRLKNMIRFIKNVKFDCDNIDNKGAIRSFHINAICFNINIAKYQYAHFLDLVSVINDELLQILIDKSYRDNIKSVDGTEIIFEKDSDKKLQEISFLHSEINQIVIDLNLLNKKLI

SEQ ID NO: 1983 - protein, 311 aa, Elizabethkingia anophelis
MSAVDDKFTRDIIQAGNNVKAHLSRSLEDVIYEFQGSVMTNTHIKANSDIDLLVISNKFYRIPPRTELQSLLNGYTLNTVQKNIVQEILNTSPFIGNSDHVLLDNRLKTEKILQDNYDDCDISKPKCVRIFNQNLKKPVEAVIACYEDDIFSIKNFRDKKYRGIKIYEKNIGTGKTDHPFFTIDSINEKSSKTNGRLKKMIRFLKNFMYDSDYEYSELKSFGINIICYNIDISKYNSLHYVGLLFVIQEQLQKIIDDSGYMASLTSIDGSEKLFYDINNNLIIKKYAEVFQLNKELKELLDDIYFNFKNAI

SEQ ID NO: 1984 - protein, 360 aa, Elizabethkingia anophelis
MKENFINKLQNLKNRYNPEGYESLNESLKDLDSTKLSSINTPDEYVRNAMSAVDDKFTRDIIQAGNNVKAHLSRSLEDVIYEFQGSVMTNTHIKANSDIDLLVISNKFYRIPPRTELQSLLNGYTLNTVQKNIVQEILNTSPFIGNSDHVLLDNRLKTEKILQDNYDDCDISKPKCVRIFNQNLKKPVEAVIACYEDDIFSIKNFRDKKYRGIKIYEKNIGTGKTDHPFFTIDSINEKSSKTNGRLKKMIRFLKNFMYDSDYEYSELKSFGINIICYNIDISKYNSLHYVGLLFVIQEQLQKIIDDSGYMASLTSIDGSEKLFYDINNNLIIKKYAEVFQLNKELKELLDDIYFNFKNAI

SEQ ID NO: 1985 - protein, 359 aa, Chryseobacterium soli
MPENFSKKLENLKNRYNPESSYLYESLKDMDSTKLSYINTPDVYVRSAMSAVDDKFTSDIIQAGNNVKTHLSRSLEDVIYEFQGSVMTNTHIKANSDIDLLVISDKFYKVPPRTDLESLMDGFILTPSQKNVVQGLINTPSFIGNSNEVLLDNRLKTEKTLQANYDDCDITKTKCVRIFNKNLKKPVEAVIACYEDDVFSIKNFREKKYRGIKIYEKNIGTGKTDHPFYTIDCINEKSANTNGRLKKMIRFLKNFMYDSDYEYNELKSFGINIICYNIETYKYSSIHYIGLLFVIQEQLQKVCDDIGYMASLTSIDGSEKLFYDNSGNFLIKKYSEVIQLNKELNELLNEIYSNFKNAI

SEQ ID NO: 1986 - protein, 359 aa, Chryseobacterium camelliae
MREDFSKKLESLKNRYNPEGSYLYESLKDMDSTKLSYINTPDMYVRSAMSAVDNKFTSDIIQAGNNVKTHLSRSLEDVVYEFQGSVMTNTHIKANSDIDLLVISDKFYRVPPRTELESLMSSFSLSPSQKNIVQDLINTPSFSGNSNDVLLDNRLKTEKTLQANYDDCDISKSKCVRIFNKNLKKPVEAVIACYEDDVFSIKNYREKKYRGIKIYEKNIGTGKTDHPFFTIDCINEKSTKTNGRLKKMIRFLKNFMFDSDYEYNELKSFGVNIICYNIETYKYNSLHYVGLLFVIQEQLQKVCDDIGYMASLTSIDGSEKLFYNNSGNFLIKKYSEVIQLNKELKELLNEIYYNFKNAI

SEQ ID NO: 1987 - protein, 359 aa, Chryseobacterium halperniae
MNNNYSERLINLKNRYNPDGIFLSKAFSDLDISKLSYNSSSDDYVRFAMAAVDDKFTDDIKKAGNNVKMHLQRTLSNVDYEYQGSVMTDTHIKANSDIDLLVISNRFYNIPSNFELQSLINDYSLNTSQRTLVQDIINSPRFTEDSDAVLLQNRKVSEETLQRQYISCDTKKSKCVTIYNSDLRKYVDTVIACYDDDVFSLKNLREKKYRGIKIYEKNVGTGKTDHPFFTIDSINTKSALAHGRLKKMIRFLKNFMFDSSYNYQELKSFGVNIICYNIEVSRYNTLHYVELLLIMQQQLKKIITDSIYMSSLTSIDGSEKLFYDSNGNFYDKKFNEVKQLENELSVLINDIYYNFKKAI

SEQ ID NO: 1988 - protein, 327 aa, Treponema pedis
MNFSKRLKRLEERQNPNYKSYSLESSFSAIHESVENEFVKAKEYVKRAMKELPRQSTEISYEEGDRVKNHLMKELPNYGFNPDFRYQGSVPCNTHIKYHSDIDLLVIIDKFESIENPDRITNPYLGNPKEDLTNLRAACIKILKENYTVADIEKNSKSIKISGGTLRRHIDIVPANWYNSENWYIYKQDYYRGIRIFDNKTKERDKNFPFLNIHLINKKDIQTSGWYRQIVRLAKTLKEDSEHSINISSYDIQALLYNMKNSNSFSNIKDILLCTTDYLSNLIQDPNKYFSLIVPDETRRIADKVDIKEIKKLYDEFYELSIKLRII

SEQ ID NO: 1989 - protein, 352 aa, Bdellovibrionales bacterium
MSSYLYPKSRYQKLIDRRTPRELGGNIRLDERIRNSSLSSETVKYVLGSMTPVDPEYTANTFKQGERVRGQLENNLPSTHAAEFAYQGSVTTDTHIKLYSDIDLLTVAKAFHCLKQPLQPTFPWAGDPVQHLMELRGHGTRVLKEKFPQAKVDTTGSKAVAISEGSLTRSVDVVFCNWLDTEHYRMYGSDWRGIQILDTSGPTRVTNYPFLHKRRLDDVDRAVYGSLKKIIRFVKSVKADADVEIKVSSYHIAGLACSMAPADLMIDFGDELKLVTNFYGYAQYLLANEPAREKLMTPNGHEPLFKGIELSALQRLVTEIAPIAEEIKAFQFYGYGLARASISSVFRDLASR

SEQ ID NO: 1990 - protein, 375 aa, Subdoligranulum sp.
MENLFYQRKGNMLFDYDKILNDLTERKFNTSDYKRILNEDKLIRDNYSVQDSKDFGNSKQYLDLRESSAVKYVIGAMLPVAKNYTQQIISNRNSIENTLRQMNDGIYRDANLDFDYQGSVTNNTHIRRNSDVDLLVMCNYFLTLQAGLPCPDPYRGNPKDDLLTLRNNCVEQLGKVSPKLNIDDSGAKSVKVSGGHLVVSVDVVPANWCETKESYKTKSKVDKGIMVLDKKKMQRITNYPFKFNELLKEKDSKTAGVFKQAIRLLKNVKVDAENSTGSRIRFSSYGIASLLYDLSDNCYHIGYSPLMLVDVVYKQICRYVNENALQELTDPVGVSLNHSGNTVEGLRELQSAMYSLKKTLENEVGGLSRQIKIAV

SEQ ID NO: 1991 - protein, 375 aa, Subdoligranulum sp.; identical to SEQ ID NO: 1990

SEQ ID NO: 1992 - protein, 340 aa, Clostridium botulinum
MKLQKYFEKFDSEIGLNPTREQRIDSAYETWNNNFKDHEKLQEIFNDFYQQGSYATKTAIKPQNSSEFDIDAVLLLNLDHDKKPKETLQLIKDVIKSYSSYKGKCKIKERCVRIDYAGDFHMDIVAAKLSGDEHILIPCKSDDEWQETNPKGFKNWFNEKHADASYKLSRIVRIVKYWRDLKVGKDTAPKSILLSTLLANNIVTSNSISETLVLTLESLVENIDSILDDNGQPYVENPSLAGENLARDWDKDKYDIFKTKLEKFAVNARAALDETDKDESIKQWRNIFDTKFPNELPEVEEAKAITAGKVFVNAVGTLNTTEGKVIPQHRFYGDIEYEKK

SEQ ID NO: 1993 - protein, 340 aa, Clostridium saccharobutylicum
MKLEQHFKKLDSEISLNPTRQQRIESAYSNWKGIFEIHEDTKEIFVEFYEQGSYSTNTAIKPQNSSEFDIDAVLLLKLDEEMKPKETLQLIKNVIESYDNYKGKAKVKDRCVRIDYAGDFHMDVVPAKPTEAEHICIPCKSDDEWQETNPKGFRDWFNEKHSDANYKLSITVRIVKYWRDLKVGKDTAPKSILLSTLLANQIVPCNSTAETLVLTLENLVQNLDLILNDEDEPYVENPSLENENLARDWDKSKYDIFKKKLEKFAVDARAALDEKDKDESIRLWRLIFDSKFPKELPEEETAKAIIDGKILVNSAGTLNSIEGISIPKHRFYGDILNEKK

SEQ ID NO: 1994 - protein, 307 aa, Clostridium saccharobutylicum
MFEIHEDTKEIFVEFYEQGSYSTNTAIKPQNSSEFDIDAVLLLKLDEEMKPKETLQLIKNVIESYDNYKGKAKVKDRCVRIDYAGDFHMDVVPAKPTEAEHICIPCKSDDEWQETNPKGFRDWFNEKHSDANYKLSITVRIVKYWRDLKVGKDTAPKSILLSTLLANQIVPCNSTAETLVLTLENLVQNLDLILNDEDEPYVENPSLENENLARDWDKSKYDIFKKKLEKFAVDARAALDEKDKDESIRLWRLIFDSKFPKELPEEETAKAIIDGKILVNSAGTLNSIEGISIPKHRFYGDILNEKK

SEQ ID NO: 1995 - protein, 306 aa, Bacillus cereus
MGKNFKEDEEIEDLFLDFYSQGSYSTNTGIKPKNDDEFDVDAILLLELDEENEPQDILKWIASRIKSHKEFEKSVKTKDRCVRIDYAGDFHVDIVPALPCEGVIKIPSKKENEWCKTNPKGFTNWCNAINSKTDSYFEKTVKIMKHWRDDNVGKDTAPKSILMTTLIGNAFVKKNSIAETLVETLDVLIDDLNELIEEDDGDVFVKNPSLEDENLARNWDQTKAERFLKKVQKLKENCQDAMDEKNKEDSIEKWQDIFGKSYFPSELGEAQDMANNIKKGGIKVAPTGLLNQEQGTKIREHRFYGE

SEQ ID NO: 1996 - protein, 336 aa, Bacillus cereus
MKLNDYFKKFVANISLNPTRINRVESALSHWEKNFKEDEEIEDLFLDFYSQGSYSTNTGIKPKNDDEFDVDAILLLELDEENEPQDILKWIASRIKSHKEFEKCVKTKDRCVRIDYAGDFHVDIVPALPCEGVIKIPSKKENEWCKTNPKGFTNWCNAINSKTDSYFEKVVKIMKHWRDDNVGKDTAPKSILMTTLIGNAFVKKNSIAETLVETLDVLIDDLNELIEEDDGDLFVKNPSLEDENLARNWDQTKAERFLKKVQKLKENCQDAMDEKNKEDSIEKWQDIFGKSYFPSELGEAQDMANNIKKGVIKVAPTGLLNQEQGTKIREHRFYGE

SEQ ID NO: 1997 - protein, 336 aa, Bacillus cereus
MKLNDYFKKFVANISLNPTRINRVESALSHWGKNFKEDEEIEDLFLDFYSQGSYSTNTGIKPKNDDEFDVDAILLLELDEENEPQDILKWIASRIKSHKEFEKSVKTKDRCVRIDYAGDFHVDIVPALPCEGVIKIPSKKENEWCKTNPKGFTNWCNAINSKTDSYFEKVVKIMKHWRDDNVGKDTAPKSILMTTLIGNAFVKKNSIAETLVETLDVLIDDLNELIEEDDGDVFVKNPSLEDENLARNWDQTKAERFLKKVQKLKENCQDAMDEKNKEDSIEKWQDIFGKSYFPSELGEAQDMANNIKKGVIKVAPTGLLNQEQGTKIREHRFYGE

SEQ ID NO: 1998 - protein, 316 aa, Bacillus cereus
MNRVESALSHWEKNFKEDEEIEDLFLDFYSQGSYSTNTGIKPKNDDEFDVDAILLLELDEENEPQDILKWIASRIKSHKEFEKCVKTKDRCVRIDYAGDFHVDIVPALPCEGVIKIPSKKENEWCKTNPKGFTNWCNAINSKTDSYFEKVVKIMKHWRDDNVGKDTAPKSILMTTLIGNAFVKKNSIAETLVETLDVLIDDLNELIEEDDGDLFVKNPSLEDENLARNWDQTKAERFLKKVQKLKENCQDAMDEKNKEDSIEKWQDIFGKSYFPSELGEAQDMANNIKKGVIKVAPTGLLNQEQGTKIREHRFYGE

SEQ ID NO: 1999 - protein, 316 aa, Bacillus cereus
MNRVESALSHWGKNFKEDEEIEDLFLDFYSQGSYSTNTGIKPKNDDEFDVDAILLLELDEENEPQDILKWIASRIKSHKEFEKSVKTKDRCVRIDYAGDFHVDIVPALPCEGVIKIPSKKENEWCKTNPKGFTNWCNAINSKTDSYFEKVVKIMKHWRDDNVGKDTAPKSILMTTLIGNAFVKKNSIAETLVETLDVLIDDLNELIEEDDGDVFVKNPSLEDENLARNWDQTKAERFLKKVQKLKENCQDAMDEKNKEDSIEKWQDIFGKSYFPSELGEAQDMANNIKKGVIKVAPTGLLNQEQGTKIREHRFYGE

SEQ ID NO: 2000 - protein, 316 aa, Bacillus cereus
MNRVESALSHWGKNFKEDEEIEDLFLDFYSQGSYSTNTGIKPKNDDEFDVDAILLLELDEENEPQDILKWIASRIKSHKEFEKSVKTKDRCVRIDYAGDFHVDIVPALPCEGVIKIPSKKENEWCKTNPKGFTNWCNAINSKTDSYFEKVVKIMKHWRDDNVGKDTAPKSILMTTLIGNAFVKKNSIAETLVETLDVLIDDLNELIEEDDGDVFVKNPSLEDENLARNWDQTKAERFLKKVQKLKENCQDAMDEKNKEDSIEKWQDIFGKSYFPSELGEAKDMANRINNGLIKVAPTGLLNQEQGTKIREHRFYGE

SEQ ID NO: 2001 - protein, 306 aa, Bacillus cereus; identical to SEQ ID NO: 1995

SEQ ID NO: 2002 - protein, 336 aa, Bacillus cereus
MKLNDYFKKFVANISLNPTRINRVESALSHWGKNFKEDEEIEDLFLDFYSQGSYSTNTGIKPKNDDEFDVDAILLLELDEENEPQDILKWIASRIKSHKEFEKSVKTKDRCVRIDYAGDFHVDIVPALPCEGVIKIPSKKENEWCKTNPKGFTNWCNAINSKTDSYFEKVVKIMKHWRDDNVGKDTAPKSILMTTLIGNAFVKKNSIAETLVETLDVLIDDLNELIEEDDGDVFVKNPSLEDENLARNWDQTKAERFLKKVQKLKENCQDAMDEKNKEDSIEKWQDIFGKSYFPSELGEAKDMANRINNGLIKVAPTGLLNQEQGTKIREHRFYGE

SEQ ID NO: 2003 - protein, 332 aa, Bacillus sp.
MANISLNPTRIEKIESAVRNWEKKFKDDDEIKDIFVDYYTQGSYSTDTGVRPKSGEEFDVDVVLVMDIDEEADPKDILHHIKVRIKSHKEFEDRVKVKDRCVRIEYAKEFHVDVVPAFEFDSCIKIPSKKEKEWTKTNPSGFKDWCNDINKESDHYFSQVVKILKHWRDDNVGKDTAPKSILLTTLAGNAFTKKPSIAETLVETLDIMIQDIDDLLFWLSEDDDVPFVRNPSLQDENLARNWTKLKAQRYLNKLKSLKESCKEALDESDKDKSIEKWQDIFGKNYFPSELGEAKAMANTIQKGSAFVSSTGVLNKDSGIPIKDHRFYGTDTK

SEQ ID NO: 2004 - protein, 337 aa, Bacillus sp.
MKHTEHFKELIGGLSLNPTREERIDKAYSNWESLLKKDDEIKDLFVDFYLQGSYATKTSIRPQKKDEEFDVDAVLLLELDSDLKPKEALSWLAKRMKENDEYDIKERDRCVRINYAGDFHMDVVLAKPSSFGDYIYIPSKKEGQWKKTNPAGFKTWCDGIHADHNYQFQNIVKLLRYWRDLRVGKDTAPKSILLTTLIGENMVGKNSIAESLLETLNEMLDALDSYIQWDRTVFVGNPSLSEENLARDWDEDRLRTFKKKLTKLQSDVKDAFDETDKEKSLNKWKEIFPKFPKELSEASNMALKINSGAIVVNSLGQLSNTDGIPSPKHRFFGGSHQ

SEQ ID NO: 2005 - protein, 337 aa, Paenibacillus sp.
MKHTEHFKELIGGLSLNPTREERIDKAYSNWESLLKKDDEIKDLFVDFYLQGSYATKTSIRPQKKDEEFDVDAVLLLELDSDLKPKEALSWLAKRMKENDEYDIKERDRCVRINYAGDFHMDVVLAKPSSFGDYIYIPSKKEGQWKKTNPAGFKTWCDGIHADHNYQFQNIVKLLRYWRDLRVGKDTAPKSILLTTLIGENMVGKNSVAESLLETLNEMLDALDSYIQWDRTVFVGNPSLSEENLARDWDEDRLRTFKKKLTKLQSDVKDAFDETDKEKSLNKWKEIFPKFPKELSEASNMALKINSGAIVVNSLGQLSNTDGIPSPKHRFFGGSHQ

SEQ ID NO: 2006 - protein, 338 aa, Paenibacillus sp.
MKLFDHFKQLLGDISLNPSRVDRIDSAYETWNSILENDDEIKEKYLDFFLQGSYGTKTSIRPQKQGEEFDVDVVLKLDLADDMTPKDALDWLVKRMKTNESYKDKIKARDRCVRINYAGDFHMDIVLAKTSDNDDILIPSKKEGEWKKTNPEGFQEWCRDVHYDHNEQFRKITKLLRYWRDHKVGKQTAPKSILLTTLIGNSMVGKNSVAESLLETIKQILIDIDSYIQLDDTVFIENPSLTEENLARDWDKEKLEKFKKKLSTLKDDVQDAYDESNKAESIKKWQAIFDKFPTELNEASAMSTRINAGAVLVNTSGLLNTEEGINSPKHRFFGVNNK

SEQ ID NO: 2007 - protein, 346 aa, Unknown
  Description of Unknown: Bacillus cereus group sequence
MKLASYFKLFISNLSLNKGRKERINSALVTWEELLSTDEELSEKFKDFCSQGSYATKTAIRPSDDGEFDVDVILLLDVKKDDSKEFFNWVVERVKTKKAYEDKIKTKDRCIQINYAGDFHVDIVPARTTYGDSILIPSKKEDDWVKTNPAGFKKWCDKKHIKHDEKFRSTVKILKYWRDQNVSSSTAPKSILLTTLIGHYMIAKSSYAETLVETTKNMVIKLNALIEDKEDDEVIQICNPSLEDENLARDWTVNKCRIFKNKLDKLHQQSLEALEESNKEASIIKWQEIFGAKKFPSELPEAAKMASAVAAGSVFVNSDGILNQNNQGAVIKEHRFFGLNATHEKI

SEQ ID NO: 2008 - protein, 346 aa, Bacillus anthracis
MKLTSYFKLFISNLSLNKGRKERINSALVTWEELLSTDEELSEKFKDFYSQGSYATKTAIRPSDDGEFDVDVILLLDVKKDDSKEFFNWVVERVKTKKAYEDKIKTKDRCIQINYAGDFHVDIVPARTTYGDSILIPSKKEDDWVKTNPAGFKKWCDKKHIKHDEKFRSTVKILKYWRDQNVSSSTAPKSILLTTLIGHYMIAKSSYAETLVETTKNMVIKLNALIEDKEDDEVIQICNPSLEDENLARDWTVNKCRIFKNKLDKLHQQSLEALEESNKEASIIKWQEIFGSKKFPSELPEAAKMASAVAAGSVFVNSDGILNQNNQGAVIKEHRFFGVNATHEKI

SEQ ID NO: 2009 - protein, 346 aa, Bacillus mycoides
MKLTSYFKLFISNLSLNKGRKERINSALVTWEDLLSTDEELSEKFKDFYSQGSYATKTAIRPSDDGEFDVDVILLLDVKKDDSKEFFNWVVERVKTKKAYEDKIKTKDRCIQINYAGDFHVDIVPARTTYGDSILIPSKKEDDWVKTNPAGFKKWCNKKHIKHDEKFRSTVKILKYWRDQNVSSSTAPKSILLTTLIGHYMIAKSSYAETLVETTKNMVIKLNALIEDKEEDEVIQICNPSLEDENLARDWTVNKCRIFKNKLDKLHQQSLEALEESNKEASIIKWQEIFGAKKFPSELPEAAKMASAVAAGSVFVNSDGILNQNNQGAVIKEHRFFGVNAAHEKI

SEQ ID NO: 2010 - protein, 346 aa, Bacillus cereus
MKLTSYFKLFISNLSLNKGRKERINSALVTWEELLSTDEELSEKFKDFYSQGSYATKTAIRPSDDGEFDVDVILLLDVKKDDSKEFFNWVVERVKTKKAYEDKIKTKDRCIQINYAGDFHVDIVPARTTYGDSILIPSKKEDDWVKTNPAGFKKWCDKKHIKHDEKFRSTVKILKYWRDQNVSSSTAPKSILLTTLIGHYMIAKSSYAETLVETTKNMVIKLNALIEDKEDDEVIQICNPSLEDENLARDWTVNKCRIFKNKLDKLHQQSLEALEESNKEASIIKWQEIFGAKKFPLELPEAAKMASAVAAGSVFVNSDGILNQNNQGAVIKEHRFFGVNVAHEKI

SEQ ID NO: 2011 - protein, 346 aa, Unknown
  Description of Unknown: Bacillus sequence
MKLTSYFKLFISNLSLNKGRKERINSALVTWEELLSTDEELSEKFKDFYSQGSYATKTAIRPSDDGEFDVDVILLLDVKKDDSKEFFNWVVERVKTKKAYEDKIKTKDRCIQINYAGDFHVDIVPARTTYGDSILIPSKKEDDWVKTNPAGFKKWCDKKHIKHDEKFRSTVKILKYWRDQNVSSSTAPKSILLTTLIGHYMIAKSSYAETLVETTKNMVIKLNALIEDKEDDEVIQICNPSLEDENLARDWTVNKCRIFKNKLDKLHQQSLEALEESNKEASIIKWQEIFGAKKFPSELPEAAKMASAVAAGSVFVNSDGILNQNNQGAVIKEHRFFGVNAAHEKI

SEQ ID NO: 2012 - protein, 346 aa, Bacillus wiedmannii
MKLTSYFKLFISNLSLNKGRKERINSALVTWEELLSTDEELSEKFKDFYSQGSYATKTAIRPSDDGEFDVDVILLLDVKKDDSKEFFNWVVERVKTKKAYEDKIKTKDRCIQINYAGDFHVDIVPARTTYGDSILIPSKKEDDWVKTNPAGFKKWCDKKHIKHDEKFRSTVKILKYWRDQNVSSSTAPKSILLTTLIGHYMIAKSSYAETLVETTKNMVIKLNALIEDKEDDEVIQICNPSLEDENLARDWTVNKCRIFKNKLDKLHQQSLEALEESNKEASIIKWQEIFGAKKFPSELPEAAKMASAVAAGSVFVNSDGILNQNNQGAVIKEHRFFGVNVAHEKI

SEQ ID NO: 2013 - protein, 346 aa, Bacillus thuringiensis
MKLTSYFKLFISNLSLNQGRKERINSALVTWEELLSTDEELSEKFKDFYSQGSYATKTAIRPSDDGEFDVDVILLLDVKKDDSKEFFNWVVERVKTKKAYEDKIKTKDRCIQINYAGDFHVDIVPARTTYGDSILIPSKKEDDWVKTNPAGFKKWCDKKHIKHDEKFRSTVKILKYWRDQNVSSSTAPKSILLTTLIGHYMIAKSSYAETLVETTKNMVIKLNALIEDKEDDEVIQICNPSLEDENLARDWTVNKCRIFKNKLDKLHQQSLEALKESNKEASIIKWQEIFGAKKFPSELPEAAKMASAVAAGSVFVNSDGILNQNNQGAVIKEHRFFGVNAAHEKI

SEQ ID NO: 2014 - protein, 346 aa, Bacillus cereus
MKLTSYFKLFISNLSLNKGRKERINSALVTWEELLSTDEELSEKFKDFYSQGSYATKTAIRPSDDGEFDVDVILLLDVKKDDSKEFFNWVVERVKTKKAYKDKIKTKDRCIQINYAGDFHVDIVPARTTYGDSILIPSKKEDDWVKTNPAGFKKWCDKKHIKHDEKFRSTVKILKYWRDQNVSSSTAPKSILLTTLIGHYMIAKSSYAETLVETTKNMVIKLNALIEDKEDDEVIQICNPSLEDENLARDWTVNKCRIFKNKLDKLHQQSLEALEESNKEASIIKWQEIFGAKKFPSELPEAAKMASAVAAGSVFVNGDGILNQNNQGAVIKEHRFFGVNAAHEKI

SEQ ID NO: 2015 - protein, 346 aa, Bacillus thuringiensis
MKLTQYFKLFISNLSLNKGRKERINSALVTWEELLSTDEELSEKFKDFYSQGSYATKTAIRPSDDGEFDVDVILLLDVKKDNSKEFFNWVVERVKTKKAYKDKIKTKDRCIQINYAGDFHVDIVPARTTYGDSILIPSKKEDDWVKTNPAGFKKWCDKKHIKHDEKFRSTVKILKYWRDQNVSSSTAPKSILLTTLIGHYMIAKSSYAETLVETTKNMVIKLNALIEDKEDDEVIQICNPSLEDENLARDWTVNKCRIFKNKLDKLHQQSLEALEESNKEASIIKWQEIFGAKKFPSELPEAAKMASAVAAGSVFVNSDGILNQNNQGAVIKEHRFFGANAAHEKI

SEQ ID NO: 2016 - protein, 346 aa, Bacillus cereus
MKLTKYFKLFISNLSLNKGRKERINSALVTWEELLSTDEELSEKFKDFYSQGSYATKTAIRPSDDGEFDVDVILLLDVKKDNSKEFFNWVVERVKTKKAYKDKIKTKDRCIQINYAGDFHVDIVPARTTYGDSILIPSKKEDDWVITNPAGFKKWCDKKHIKHDEKFRSTVKILKYWRDQNVSSSTAPKSILLTTLIGHYMIAKSSYAETLVETTKNMVIKLNALIEDKEDDEVIQICNPSLEDENLARDWTVNKCRIFKNKLDKLHQQSLAALEESNKEASIIKWQEIFGTKKFPSELPEAAKMASAVAAGSVFVNSDGILNQNNQGAVIKEHRFFGVNAAHEKI

SEQ ID NO: 2017 - protein, 346 aa, Unknown
  Description of Unknown: Bacillus cereus group sequence
MKLTQYFKLFISNLSLNKGRKERINSALVTWEELLSTDEELSEKFKDFYSQGSYATKTAIRPSDDGEFDVDVILLLDVKKDNSKEFFNWVVERVKTKKAYKDKIKTKDRCIQINYAGDFHVDIVPARTTYGDSILIPSKKEDDWVKTNPAGFKKWCDKKHIIHDEKFRSTVKILKYWRDQNVSSSTAPKSILLTTLIGHYMIAKSSYAETLVETTKNMVIKLNALIEDKEDDEVIQICNPSLEDENLARDWTVNKCRIFKNKLDKLHQQSLEALEESNKEASIIKWQEIFGAKKFPSELPEAAQMASAVAAGSVFVNSDGILNQNSQGAVIKEHRFFGVNADHEKI

SEQ ID NO: 2018 - protein, 346 aa, Bacillus cereus
MKLTQYFKLFISNLSLNKGRKERINSALVTWEELLSTDEELSEKFKDFYSQGSYATKTAIRPSDDGEFDVDVILLLDVKKDNSKEFFNWVVERVKTKKAYKDKIKTKDRCIQINYAGDFHVDIVPARSTYGDSILIPSKKEDDWVKTNPAGFKKWCDKKHIIHDEKFRSTVKILKYWRDQNVSSSTAPKSILLTTLIGHYMIAKSSYAETLVETTKNMVIKLNALIEDKEDDEVIQICNPSLEDENLARDWTVNKCRIFKNKLDKLHQQSLEALEESNKEASIIKWQEIFGAKKFPSELPEAAQMASAVAAGSVFVNSDGILNQNSQGAVIKEHRFFGVNADHEKI

SEQ ID NO: 2019 - protein, 346 aa, Bacillus cereus
MKLTSYFKLFISNLSLNKGRKERINSALVTWEELLSTDEELSEKFKDFYSQGSYATKTAIRPSDDGEFDVDVILLLDVKKDDSKEFFNWVVERVKTKKAYKDKIKTKDRCIQINYTGDFHVDIVPARTTYGDSILIPSKKEDDWVKTNPAGFKKWCDKKHIKHDEKFRSTVKILKYWRDQNVSSSTAPKSILLTTLIGHYMIAKSSYAETLVETTKNMVIKLNALIEGKEDDEVIQICNPSLEDENLARDWTVNKCRIFKNKLDKLHQQSLEALEESNKEASIIKWQEIFGAKKFPSELPEAAKMASAVAAGSVFVNSDGILNQNNQGAVIKEHRFFGVNADHENI

SEQ ID NO: 2020 - protein, 346 aa, Bacillus cereus
MKLTSYFKLFISNLSLNKGRKERINSALVTWEELLSTDEELSEKFKDFYSQGSYATKTAIRPSDDGEFDVDVILLLDVKKDDSKEFFNWVVERVKTKKAYKDKIKTKDRCIQINYTGDFHVDIVPARTTYGDSILIPSKKEDDWVKTNPAGFKKWCDKKHIKHDEKFRSTVKILKYWRDQNVSSSTAPKSILLTTLIGHYMIAKSSYAETLVETTKNMVIKLNELIEDKEDDEVIQICNPSLEDENLARDWTVNKCRIFKNKLDKLHQQSLEALKESNKEASIIKWQEIFGAKKFPSELPEAAKMASAVAAGSVFVNSDGILNQNNQGAVIKEHRFFGVNAAHEKI

SEQ ID NO: 2021 - protein, 346 aa, Bacillus thuringiensis
MKLSSHFKLFISNLSLNTGRNARINSALVTWEELLSTDDELSEKYKEFYPQGSYATETAIRPSDDGEFDVDVILLLDVKKDNSKEFFKWVLERVKTKKAYKDRIKPKDRCIQINYAGDFHVDIVPSRTTQGDSILIPSKKEDDWVKTNPVGFKKWCSKKQIKHDGKFQSIVKILKYWRDQNVSSNSAPKSILLTTLIGHYMVAKNSYAETLVETTKNMVTKLTELIEGKEDDEVIQICNPSLEEENLARDWTVKKCRIFKSKLETLYQQCLEAFEESNKETSIAKWQMIFGTKKFPSELPEGAKMASAVATGSVFVNADGILNQNNQGAALKEHRFFGVNTNNEKI

SEQ ID NO: 2022 - protein, 346 aa, Bacillus cereus
MKLTSHFKLFISNLSLNTGRKGRINSALLTWEDLLSTEKELSEKYKEFYPQGSYATETAIRPSDNGEFDVDVILLLDVKKDDSKEFFKWVLERVKTKKAYENNIKPKDRCIQINYAGDFHVDIVPARTTQGDSILIPSKREGDWIKTNPVGFKKWCDKQQIRHDGKFQSIVKILKFWRDQNVSSSSAPKSILLTTLIGHYMVAKNSYAETIVETTKNIVTKLTELIEGKEEDEVIQICNPSLEEENLARDWTVKKCRIFTSRLEKLYQQCLEAFEELHKETSIAKWQTIFGSKKFPSELPEAAKMASAVAAGSVFVNGEGILNQSNQGAAIKEHRFFGVNTDNEKV

SEQ ID NO: 2023 - protein, 346 aa, Bacillus wiedmannii
MKISDYFKLFIANLSLNKGRKEKIDGALSTWEVLLSEDKEFNEKFKGFYSQGSYATKTAIRPSKDAEFDVDVILLLDVKKEDSKEFFNWVAERIKSKKTYEGKIKPQDRCIRIDYAGDFHVDIVPARTTYGDSILIPSKKEGNWVKTNPAGFKKWCDKKHIEHNEKFRSMVKILKYWRDENVGDNTAPKSILLTTLVGKYMIAKSSYAETLVATLDNMVTELDELIKDTPKDDAIKISNPSLEDENLARDWTVEKCRIFRDKLKNFHSKSLEALNDSNKESSIEKWQAIFGKKKFPNELPDGAKMAQAVAKGSIFVNSQGILNHNSQGVTIKEHRFFGIDKTNEEV

SEQ ID NO: 2024 - protein, 346 aa, Geobacillus jurassicus
MKLTNHFKQFIVNISLNKGRKERIDQALSTWKKILSEDEELSEKFKELFPQGSYATKTAIRPSNDGEFDVDVILLLDVKNQDSKEFFNWVTKRIKTKKAYEDKIKPKDRCIRIEYAGEFHVDIVPAKTTYGDSILIPSKTEGDWVKTNPVGFIKWCNKKHTEHNEKFRPIVKILKYWRDNNVGDNTAPKSILLTTLVGKCMVAKNSYAETLVATLENMITKLDELMNEASEDGIIEVVNPSLEDENLARDWSVEKCRIFRDKLQKLYSNSLEALTDPDKESSIEKWQAIFGKEKFPSELSEGAKMAEAVATGAVFVNREGILNQRNEGIPIKEHRFFGKGEINEEF

SEQ ID NO: 2025 - protein, 449 aa, Mycobacterium mageritense
MSDIQSHFDTFLDEISLGQTQVDRIVSASNTLRNFLTEHYGLSDADVFLQGSYANGTAVKPVEGGDYDVDIVCVSASADDTAPGAIQDLYDALDSNGRYSGKLTSKQPCVRIQYADDAIGSFHVDVVPARIGQSDGPLDAPRKATGWHATAPNEYTSWCERQGVHFRQIVQMLKRWRDEHQGVRSAIKSIVLQVLIAEHMPQIAVNDADWIAQTILNMNDALQPLNSPPEVWNPVLPSENLAARWTNEAFTDFKRELAEAADLITKATETDDLVEQVEHWQDLFGEDFPDVDKDLFHVELADTSHAQSPETKGWYELLDSRYSVSLRACSQLGKRAKRVPYPNDGGLLFKGRNLVFKATASGPTDFSVWWRVTNTGEHARKESSLRGDFFRAKARNQRKPSPDPTENWESTAYTGTHLVEVFLVVGQRVVARSEPFKVNIYNSIFQWRR

SEQ ID NO: 2026 - protein, 446 aa, Mycobacterium mageritense
MQSHFDTFLDEISLGQTQVDRIVSASNTLRNFLTEHYGLSDADVFLQGSYANGTAVKPVEGGDYDVDIVCVSASADDTAPGAIQDLYDALDSNGRYSGKLTSKQPCVRIQYADDAIGSFHVDVVPARIGQSDGPLDAPRKATGWHATAPNEYTSWCERQGVHFRQIVQMLKRWRDEHQGVRSAIKSIVLQVLIAEHMPQIAVNDADWIAQTILNMNDALQPLNSPPEVWNPVLPSENLAARWTNEAFTDFKRELAEAADLITKATETDDLVEQVEHWQDLFGEDFPDVDKDLFHVELADTSHAQSPETKGWYELLDSRYSVSLRACSQLGKRAKRVPYPNDGGLLFKGRNLVFKATASGPTDFSVWWRVTNTGEHARKESSLRGDFFRAKARNQRKPSPDPTENWESTAYTGTHLVEVFLVVGQRVVARSEPFKVNIYNSIFQWRR

SEQ ID NO: 2027 - protein, 446 aa, Mycobacterium sp.
MQSHFDTFLDEISLGQTQVDRIESASNTLRNFLTEHYGLSDADVFLQGSYANGTAVKPVEGGDYDVDIVCVSASADDTAPGAIQDLYDALDSNGRYSGKLTSKQPCVRIQYADDAIGSFHVDVVPARIGQSDGPLDAPRKATGWHATAPNEYTSWCERQGVHFRQIVQMLKRWRDEHQGVRSAIKSIVLQVLIAEHMPQIAVNDADWIAQTILNMNDALQPLNSPPEVWNPVLPSENLAARWTNEAFTDFKRELAEAADLITKATETDDLVEQVEHWQDLFGEDFPDVDKDLFHVELADTSHAQSPETKGWYELLDSRYSVSLRACSQLGKRAKRVPYPNDGGLLFKGRNLVFKATASGPTDFSVWWRVTNTGEHARKESSLRGDFFRAKARNQRKPSPDPTENWESTAYTGTHLVEVFLVVGQRVVARSEPFKVNIYNSIFQWRR

SEQ ID NO: 2028 - protein, 449 aa, Mycobacterium sp.
MSDIQSHFDTFLDEISLGQTQVDRIESASNTLRNFLTEHYGLSDADVFLQGSYANGTAVKPVEGGDYDVDIVCVSASADDTAPGAIQDLYDALDSNGRYSGKLTSKQPCVRIQYADDAIGSFHVDVVPARIGQSDGPLDAPRKATGWHATAPNEYTSWCERQGVHFRQIVQMLKRWRDEHQGVRSAIKSIVLQVLIAEHMPQIAVNDADWIAQTILNMNDALQPLNSPPEVWNPVLPSENLAARWTNEAFTDFKRELAEAADLITKATETDDLVEQVEHWQDLFGEDFPDVDKDLFHVELADTSHAQSPETKGWYELLDSRYSVSLRACSQLGKRAKRVPYPNDGGLLFKGRNLVFKATASGPTDFSVWWRVTNTGEHARKESSLRGDFFRAKARNQRKPSPDPTENWESTAYTGTHLVEVFLVVGQRVVARSEPFKVNIYNSIFQWRR

SEQ ID NO: 2029 - protein, 450 aa, Mycobacterium abscessus
MTNIQSYFTAFVDKISLGQTQVGRIESASNTLGDFLKAQYGLSDAEVFLQGSYANGTAVKPIEGGEYDVDIICVSASQQGSAAGAIQDLYDVLDSNGRYAGKLTQKQPCVRIQYADDAIGSFHVDVVPARASTSAESPLDAPRKSSGWHPTAPNEYTSWCEQQGVHFRQTVQMLKRWRDEHQGVRSAIKSIVLQVLIATHLPQFANNDAERVSQTIVNMNDALQSLDSPPEVWNPVLPSENLASRWTKEAFVDFKHELAEAADLVTKATDAEDLVEQVEYWQDLFGEEFPSVDKDDLYHVELADASHAESPGTRGWYELLDARYHVTVRAWSQLGKRGKRISYPNDGSLLFKGRNIVFKATPTGPTDYSVWWRITNTGEHARRESSLRGNFIRAKQRNGKQSHDPTENWESTSYTGTHLVEVFLVVGTRIVARSAPFKVNIHNPLFRWRR

SEQ ID NO: 2030 - protein, 447 aa, Mycobacterium abscessus
MQSYFTAFVDKISLGQTQVGRIESASNTLGDFLKAQYGLSDAEVFLQGSYANGTAVKPIEGGEYDVDIICVSASQQGSAAGAIQDLYDVLDSNGRYAGKLTQKQPCVRIQYADDAIGSFHVDVVPARASTSAESPLDAPRKSSGWHPTAPNEYTSWCEQQGVHFRQTVQMLKRWRDEHQGVRSAIKSIVLQVLIATHLPQFANNDAERVSQTIVNMNDALQSLDSPPEVWNPVLPSENLASRWTKEAFVDFKHELAEAADLVTKATDAEDLVEQVEYWQDLFGEEFPSVDKDDLYHVELADASHAESPGTRGWYELLDARYHVTVRAWSQLGKRGKRISYPNDGSLLFKGRNIVFKATPTGPTDYSVWWRITNTGEHARRESSLRGNFIRAKQRNGKQSHDPTENWESTSYTGTHLVEVFLVVGTRIVARSAPFKVNIHNPLFRWRR

SEQ ID NO: 2031 - protein, 449 aa, Mycobacterium abscessus
MNGIQSHFDVFLDNISLTQTQVDRIESASNTLTDFLKSHYDLGDYEVFLQGSYPNGTAVKPVEGGEYDVDIVCVCASSEDSAANAIQDLYDALDANGRYSGKLTSKRPCVRIQYADDTIGSFHVDVVPARAGQEDAPFDAPRKSSGWHPTAPNEYTSWCEQQGVHFRRTVRMLKRWRDEHQGVRNAIKSIVLQVLIAEHSPAFADNDFERIFQTIVNMNEVLQPLGSPPAVTNPVLPSENLAARWSREAFADFKRELSEAADLVAKATKTDDLVEQVEYWQDLFGEDFPSVEKQVRYHVELADASHAESPETKGWYEQLDPRYQVTIQAWSQLGKRRQRSSYRNDGPLLFKGRNLIFKASPSGPTDYSIWWRVTNTGEHARKESSLRGNFIRAKRSDGKPSDDPTENWENTAYTGTHLVEVFLIVGSRIVARSTPFKVNVYNAPFPWRR

SEQ ID NO: 2032 - protein, 446 aa, Mycobacterium abscessus
MQSHFDVFLDNISLTQTQVDRIESASNTLTDFLKSHYDLGDYEVFLQGSYPNGTAVKPVEGGEYDVDIVCVCASSEDSAANAIQDLYDALDANGRYSGKLTSKRPCVRIQYADDTIGSFHVDVVPARAGQEDAPFDAPRKSSGWHPTAPNEYTSWCEQQGVHFRRTVRMLKRWRDEHQGVRNAIKSIVLQVLIAEHSPAFADNDFERIFQTIVNMNEVLQPLGSPPAVTNPVLPSENLAARWSREAFADFKRELSEAADLVAKATKTDDLVEQVEYWQDLFGEDFPSVEKQVRYHVELADASHAESPETKGWYEQLDPRYQVTIQAWSQLGKRRQRSSYRNDGPLLFKGRNLIFKASPSGPTDYSIWWRVTNTGEHARKESSLRGNFIRAKRSDGKPSDDPTENWENTAYTGTHLVEVFLIVGSRIVARSTPFKVNVYNAPFPWRR

SEQ ID NO: 2033 - protein, 449 aa, Amycolatopsis orientalis
MQTYFRRFRDEISLGDPQVQRIESASTTLIAYLRDHYELTTSQVFLQGSYANGTAVKPVAGGEYDVDIVCVSSSEDDTAADALEDMYSTLESNGRYIGKLKPKQPCVRIEYADDNIGSFHVDVVPVRSSSASDAPLDAPRRNSGWHSTAPNEYTAWCAKQGQAFIDCVKMLKRWRDEHQEVRSAVKSIVLQVLVARHLPQWATNDAERIYRTLVSLNNELSSIATPPMVLNPVLESENLAARWEVKAFRNFKTELTEAITIARRAIEAPTIIEACEQWRALFGDAFPLAEKGGQFIVALSDTSHAQLPEARGWYEHLDPRYSASIEAWEYRGKRGKKSPYHSDGPLLFAGKQLQFKANYTGPTPVDIWWRVINTGQHARDESGLRGDFFRAKRRGDGNRQSPDPAENWESTSYTGTHLIEVFLLVGTRVVARSSSFKVNVFGSRFTWRP

SEQ ID NO: 2034 - protein, 450 aa, Gordonia terrae
MEDCFTSFVEKISLGQKQVDRIESSSSTLMKYLRDTYNLTDEQVFLQGSYANGTAVKPVDGGEYDVDIICVCASTEDSATSAIEDLYQTLDDNGRYSGKLTSKQPCVRIQYADDEIGSFHVDVVPVRVSDDPIAPLDAPRKSSGWHPTAPSEYTSWCEDQGVEFRETVKMLKRWRDENQDVRGAIKSIVLQVLISEHMPASSSTTADRVASVFTGLADALADLESAPDVWNPVLPTENLAARWTNESFQDFKRELKSAAETVQLAVDAETDVEATEYWRDIFGGDFPAVQKNAASYAVKLGDTSHAQSPDAMNWYVHHDSRYRVSVKAWVQLGNKRNKRLSPYQSDGGLVSPGRWIKFNADLVSPTTASIWWRVTNTGKHARDQQGLRGDFFKGRLANRRESPDERENWESTSYTGSHLVEVFVVVGNRVVAESQPYYVNIHHPRIFWRP

SEQ ID NO: 2035 - protein, 452 aa, Rhodococcus fascians
MDQHFDEFLSRISLGQKQVDRIESAWLTLKGYLIDEYDLSEADIFVQGSYANGTAVRPVEGGEYDVDIICICAPRSVTAKDAIDDLYASLESHGRYKGKLTSKQPCVRIQYADDEIGSFHVDVVPVRPSDDDVAPLDAPRKSTGWHPTAPSEYTSWCQTQGPLFRQTVQMLKRWRDEHQKVRGAVKSIVLQVLVSQSMPVASGSTGERIARTLENMNNALAGLCWPPEVSNPVLKKENLAERWPQQAFENFQSELREATELAQAALDADDDVEAAENWRNLFGDAFPAIEKNQAKGIYSVALADTSHALTPGAKNWTVALDPRYSINIRAWEQLGKNGRRIPYESDTRLLFPNKWINFKANIVAPTECSVWWQVTNTGKHARDRSGLRGEFFKAKARGSAGKPSKDEADNWEATSYTGTHVVQAFLLVGTRVVAQSDRFFVNIFNKAQFWQR

SEQ ID NO: 2036 - protein, 452 aa, Mycobacterium kansasii
MTDTSTQFQEFLEGIELKQKQVDRIESARKSLSDVLKSSYGLTDNEVFVQGSYANGTAVRPVEGGEYDIDIVAVTADENDGATDAIRDLYSSLENSRYKNMIEERKPCVRVTYVDDEIGGFHVDVVPVRTSTNDSDAPYEAPRKGSGWHDTAPTEYTAWCASRGDDFRRTVRMFKRWRDEQQDVRKAVKSIVLQVLVSQYMPSGVADDADRVATAFIDMNAALGDLDSPPDVFNPVLEAENLTARWSDTDFANFKKELKEAADIAVEATDADNLVEACEKWGEIFGDAFPVVASEVLNMCIADRSHAKPPESQGWVVNFDARYTVRVHAQEVHGRRSKTRSYQSGGHAIFASPFNSLRFKAIVTGPSGVEIWWRVTNTGEHARLQSGLRGDFFKGKGLNGNPNADQTVNFEKTSYTGSHIIEAFALVGGNVVAKSEPFVVNIFSPYRQFWRP

SEQ ID NO: 2037 - protein, 453 aa, Mycobacterium avium
MIDASEQFQEFLEAIELKQKQVDRIQSAQKSLSDLLKESYGLTDNEVFLQGSFANGTAVRPVEGGEYDIDLVAVTATDDDGATDAIRDLFGTLENSRYKNMIAERKPCVRVTYADDEIGGFHVDVVPLRVSTTDDSDAPYEAPRKGSGWHDTAPTEYTAWCAEQSEDFRRTVRMFKRWRDEQQDVRKAVKSIVLQVLVSQHMPVGVDDDADRVATTFINMNADLESMDSAPEVLNPVLESENLTALWSDGDFSNFKKELKEAATLAAEAIDADNLVEACEKWGEIFGDAFPVVSSEKLSMRVADRSHAKPPESQGWVLNRDSRYSVRILAREVHGRRGKSREYPSDGHAIFASRFNNLRFKAVVSGPSGVDVWWRVTNTGEHARVQSGLRGDFFKGKELNGRETTDQTINFERTAYTGSHIIEAFALVGGNVVATSDPFVVNIFSPLRQIWRP

SEQ ID NO: 2038 - protein, 453 aa, Mycobacterium avium
MIDASEQFQEFLEAIELKQKQVDRIQSAQKSLSDLLKESYGLTDNEVFLQGSFANGTAVRPVEGGEYDIDLVAVTATDDDGATDAIRDLFGTLENSRYKNMIAERKPCVRVTYADDEIGGFHVDVVPLRVSTTDDSDAPYEAPRKGSGWHDTAPTEYTAWCAEQSEDFRRTVRMFKRWRDEQQDVRKAVKSIVLQVLVSQHMPVGVDDDADRVATTFINMNADLESMDSAPEVLNPVLESENLTALWSDGDFSNFKKELKEAATLAAEAIDADNLVEACEKWGEIFGDAFPVVSSEKLSMRVADRSHAKPPESQGWVLNRDSRYSVRILAREVHGRRGKSREYPSDGHAIFASRFNDLRFKAVVSGPSGVDVWWRVTNTGEHARVQSGLRGDFFKGKELNGRETTDQTINFERTAYTGSHIIEAFALVGGNVVATSDPFVVNIFSPLRQIWRP

SEQ ID NO: 2039 - protein, 454 aa, Mycobacterium avium
MIDASEQFQEFLEAIELKQKQVDRIQSAQKSLSDLLKESYGLTDNEVFLQGSFANGTAVRPVEGGEYDIDLVAVTATDDDGATDAIRDLFGTLENSRYKNMIAERKPCVRVTYADDEIGGFHVDVVPLRVSTTDDSDAPYEAPRKGSGWHDTAPTEYTAWCAEQSEDFRRTVRMFKRWRDEQQDVRKAVKSIVLQVLVVSQHMPVGVDDDADRVATTFINMNADLESMDSAPEVLNPVLESENLTALWSDGDFSNFKKELKEAATLAAEAIDADNLVEACEKWGEIFGDAFPVVSSEKLSMRVADRSHAKPPESQGWVLNRDSRYSVRILAREVHGRRGKSREYPSDGHAIFASRFNNLRFKAVVSGPSGVDVWWRVTNTGEHARVQSGLRGDFFKGKELNGRETTDQTINFERTAYTGSHIIEAFALVGGNVVATSDPFVVNIFSPLRQIWRP

SEQ ID NO: 2040 - protein, 453 aa, Mycobacterium avium
MIDASEQFQEFLEAIGLKQKQVDRIQSAQKSLSDLLKESYGLTDNGVFLQGSFANGTAVRPVEGGEYDIDLVAVTATDDDGATDAIRDLFGTLENSRYKNMIAERKPCVRVTYADDEIGGFHVDVVPLRVSTTDDSDAPYEAPRKGSGWHDTAPTEYTAWCAEQSEDFRRTARMFKRWRDEQQDVRKAVKSIVLQVLVSQHMPVGVDDDADRVATTFINMNADLESMDSAPEVLNPVLESENLTALWSDGDFSNFKKELKEAATLAAEAIDADNLVEACEKWGEIFGDAFPVVSSEKLSMRVADGSHAKPPESQGWVLNRDSRYSVRILAREVHGRRGKSREYPSDGHAIFASRFNNLRFKAVVSGPSGVDVWWRVTNTGEHARVQSGLRGDFFKGKELNGRETTDQTINFERTAYTGSHIIEAFALVGGNVVATSDPFVVNIFSPLRQIWRP

SEQ ID NO: 2041 - protein, 453 aa, Mycobacterium avium
MIDASEQFQEFLEAIGLKQKQVDRIQSAQKSLSDLLKESYGLTDNGVFLQGSFANGTAVRPVEGGEYDIDLVAVTATDDDGATDAIRDLFGTLENSRYKNMIAERKPCVRVTYADDEIGGFHVDVVPLRVSTTDDSDAPYEAPRKGSGWHDTAPTEYTAWCAEQSEDFRRTARMFKRWRDEQQDVRKAVKSIVLQVLVSQHMPVGVDDDADRVATTFINMNADLESMDSAPEVLNPVLESENLTALWSDGDFSNFKKELKEAATLAAEAIDADNLVEACEKWGEIFGDAFPVVSSEKLSMRVADGSHAKPPESQGWVLNRDSRYSVRILAREVDGRRGKSREYPSDGHAIFASRFNNLRFKAVVSGPSGVDVWWRVTNTGEHARVQSGLRGDFFKGKELNGRETTDQTINFERTAYTGSHIIEAFALVGGNVVATSDPFVVNIFSPLRQIWRP

SEQ ID NO: 2042 - protein, 449 aa, Conexibacter woesei
MAVDLSANFEQFLQNISLGDPQVPRMNSAARTVSDFLLASYDIAQGNVFLQGSYANGTAIEPVRGGEYDVDLVAVCVGGNTTADDALSELEKRFRSDGRFRARVRRKQPCVRLEYAEDNVGGFHVDVVPVRYANHDAPLEAPRRGEGWHETAPAEYTRWCTSQGAYFLRTVKMLKRWRAEQQSVRTAVKSIVLQVLVAQCMPSVADDADRITQTFRNLHAHLAGMTRPPVVLNPVLPTENLAGRWTQESFASFVRELDEAVQWADQAMAATDVIEATDIWRELLGDDFPARTPTSLGFHVGDYSHAQTPSDRGWAERSDARYAVEITASTQRGKRGQTRRPYSSGGPVVFAGHKLRFKAEISAPNHVDVWWQVANTGAHARNASGLRGEIFRARDSRRGTNSDQTENWENTAYTGSHLVRALLVRNNEVVATSAWFVVNIYARGRPFRP

SEQ ID NO: 2043 - protein, 449 aa, Acidithrix ferrooxidans
MSVDLGAYFNQFLQNISLGEPQISRMNSAAEAISRFLVQQYGVPSANVFVQGSYANNTVVEPVDGGEYDIDLVAVCVGPNVSSDKALDELETAFRSTALFSDRVTRKQPCVRLEYAHDHVGSFHVDVVPVRWSGQATPPLEAPRREDGWHGTAPAEYTQWCRNQGPLYIRTVMAMKRWRDEQQPVRNAVKSIVLQVLVSQYMPQTGDDASRMAETFKVLHSDLSRLRVPPVVPNPVLPSENLAKRWTAESFNNFVVELKEAVEWATTIQNTTDIMEAADACRELLGNDFPVLSPKDVRLELLDYSHAQTPAQMGWLEAYDSRYQISIKAVVQRGKRGQTRRPLLHDGELLLQGHNLHFKADLVAPNHVDVWWQVANTGGHARSVNELRGEIFKGKNLQGKLIAEDENWESTAYTGSHLIRSLLVRENRVLAVSPWFQVNIYAKGQPFRR

SEQ ID NO: 2044 - protein, 478 aa, Paracoccus denitrificans
MKLTATFKSFLQDTVNLNDSRIASLESSVDAIKKFIRQSEYKPKFIAFHEQGSWAHETIIKPLNGDEFDADLLLAVEPVDGWSASDYVAKLGKIFSESATYKDKTKVYDFCVTIVYANDKRIDISPLVKDRGGIRRYEVCDRGNDAFVQSEPMEYTAWIKQRNGYSGSNSFRKVTRLIKYIRDIKGTFTCPSVLLTTLIGNQIDWYDHGSAAFSDTPTTLKTVLGRLDDWLQARPKKPRVQNPKLATEDFASQLTDDQYENLRKVMKRYRTWVDDAYDEKDRDESIKKWQRVFGSDFAKGEVLTKAAAQIVSPYRALLDTTARHSSDLVEAFYRFGAKLLPAGFYTPPYLRQPTWRTNGHVSENVYVIASWHRHKNSGGRRIEDGEILPSNGGVWLAPRVGFDQDVPDNCRVEWRVTNTGVVALTAQAGRGDFYPASTGTRRWEELRYRGVHFVEAFIVLRSGDILVGKSKPFHVVIE

SEQ ID NO: 2045 - protein, 478 aa, Paracoccus denitrificans; identical to SEQ ID NO: 2044

SEQ ID NO: 2046 - protein, 478 aa, Paracoccus sanguinis
MKLTATFKSFLQDTVNLNDSRIASLESSVDAIKKFIRQSEYKPKFVAFYEQGSWAHETIIKPLNGDEFDADLLLAVEPVDGWSASDYVAKLGKIFSESATYKDKTKVYDFCVTIVYANDKRIDIAPLVKDRGGIRRYEVCDRGSNAFVQSEPMEYTAWIKERNGYSGSNSFRKVTRLIKYIRDIKGTFTCPSVLLTTLVGNQIDWYDHGSSAFSDTPTTLKTVLGRLDDWLQARPKKPRVQNPKLATEDFASQLTDDQYENLRKVMKRYRTWVDDAYDEQDRDESIKKWQRVFGSDFAKGEVVTKAAAQNVSPYRALLDTTARHSSDLVEAFYRFGAKLLPAGFYTPPYLRQPTWRTNGHVSENVYVIASWHRHRNSGGRTIEDGEILPSNGGVWLAPRVGFDQDVPDNCRVEWRVTNTGVVALTAQAGRGDFYPASTGTRRWEELRYRGVHFVEAFIVLRSGDILVGKSKPFHVVIE

SEQ ID NO: 2047 - protein, 480 aa, Bradyrhizobium japonicum
MKLVALFDDFLKETVNLNKTRIDLLEASFPALKSFVRESDWKPKVRTFVEQGSWAHETIIRPVDGGEFDADLLVMVDPADGWTAAEYVENLGRVFSGSKTYEDKTKTWNYCVTITYAGDRKIDLAPCVVGRRWDGSMEVCNRKGGFELSAPVDYTAWMKERNTYSGGNSFRKVTRLMKYLRDVKTTFTCPSVLLTTLLGNQIHWFDKDTDAFADVPTTLQTVVGRLDDWLRMHPNRPSVTNPKLSSEDFSPLFGSDDQYSNFRTVIARYRKWIDEAHAMEGRQESIAAWQKVFGEEFGKASVIKVAADAAADGLAKVRGLLSSTAAHLNELVDVVKNYGISVLPLDFCRPPHIRQPTWRQAPNLATVLVTAEWRERRASTGRAIRAGDVLRPHGGLHFKTFDTDGRPIPPAFEVQWRITNTGAVAMAKGAGRGGFYPENSSHGRWETLDFRGVHLAEAFVVRRSDDVLVGVSKPFYVVIE

SEQ ID NO: 2048 - protein, 480 aa, Bradyrhizobium arachidis
MKLVALFDDFLKETVNLNKTRIDLLEASIPALKSFVRDSDWTPKVRSFAEQGSWAHETIIRPVDGGEFDADLLVMADPVEGWTAAEYVESLGRVFSGSKTYEDKTKTWDYCVTITYAGDRKIDLAPCVVGRRWDGSMEVCNRKGGFELSAPVDYTAWMKERNAYSGGNSFRKVTRLMKYLRDIKTTFTCPSVLLTTLLGNQIHWFDKDTDAFADVPTTLQTVVGRLDDWLRMHPTRPSVTNPKLSSEDFSPLFGSDDQYSNFRTVIARYRKWIDEAHAMESRQESIAAWQKVFGEEFGKASVIKVAADAAADGLAKVRGLLSSTAAHLNELVDVVKNYGISVLPPDFSRPPHIRRPTWRHAPTLATVLVTTEWRERRASTGRAIRAGDVLRPHGGLHFKAIDTDGRAIPPDFEVQWRITNTGAVAMAKGAGRGGFYPDNSSQGRWETLDFRGVHLAEAFVIRRSDDVLVGVSKPFYVVIE

SEQ ID NO: 2049 - protein, 483 aa, Bradyrhizobium sp.
MKLISLFDEFLKDTVNLNKTRIDLLEASIPALKSFVRGADWKPKVRTFEEQGSWAHQTIIKPVNNGEFDADLLVMVDPVDGWTAAEYVESLGRTFAASKTYEDMIKTWDYCVTIDYAGDRKVDLAPCVVGRRWDGSMEVCNRKGGFELTSPVDYTAWMKERNAYSGNNSFRKVTRLVKYLRDIKETFTCPSVLLTTLLGNRIQWLDKGTDAFADVPTTLQTVVGRLDNWLRMYPTRPTVTNPKLPSEDFSPLFGTDDQYSNFRTVIARYRKWIDEAIATEGRQESIKAWQKVFGTEFAKGDVVKAAADGLSESTSSSLVGRFLDSTAAHLSGIVDMVRDYGLSILPPGFARPPHMQTPRWRSVPQPVDIAVSAEWRPASGSQVGKAVAAGQALKPQGGLYFRASLVDGTPVPPEFYVEWRITNTGAVAMSAKAGRGGFEVSNKADGRWEELAYRGIHMAEAFVVRRSDDVLVGMSKPFYVVIE

SEQ ID NO: 2050 - protein, 483 aa, Bradyrhizobium manausense
MKLVSLFDDFLKETVNLNKTRIDLLEASIPALKSFVRESDWKPKVRTFVEQGSWAHETIIRPVDNKEFDADLLVVVDPVEGWTAAEYVESLGRAFSGSKTYEDKTKTWDYCVTITYAGDRKIDLAPCVVGRRWEGSMEVCNRKGGFELTAPVEYTEWMKERNAYSGNNSFRKVTRLVKYLRDIKETFTCPSVLLTTLLGNQIQWFEKGNDAFADVPTTLKTLMGRLDDWLRMYPSRPAVTNPKLPSEDFSQLFGTDEQYSNFRTVIARYRKWIDEAHATEGRQESIKAWQKVFGSEFAKGDLVKVAADGAMESTGNSLVARFLDSTAAHLNGIVDMVRDYGISILPASFARPAHMQTPRWRSVSQPADIAVSAEWRSASHAQVGRPVVAGQMLKPQGGLYFRATLVDGTPVPPEYYVEWRITNTGAVAMSAKAGRGGFEVPNKADGRGETLAYRGIHMAEAFVVRRSDDVLVGLSKPFYVVIE

SEQ ID NO: 2051 - protein, 482 aa, Rhizobium etli
MKLVALFDDFLKEVVNINATRLGLLTDGVYALKKFIRRSGYAPRIRTFYKQGSWAHQTIIRPVGGGEYDADLLVFVDPVKGWTAKDYVEKLYNEFSASGTYSDKVKIWEYCVTIEYAGDRKIDIAPCVVDRLWPGQGHEVCNRADDQFHESRPIEYTSWLIEKNGYSGGNSFRKVTRLLKYLRDYKKTFTCKSVLLTTMIGEQIEWMDQGKTNYADVPTALLTLISRLDEWLQANATKPQVRNPKLSSEDFSTMWSEEQYQNFRSCIHRYREWIEQAYHAENRDESIKLWQKVFGDDFGRSANVLAQKADTGSVTLADTLLPATGAHHDSLVEIIKRTGLSILPKWFFSPPYLKHPEWRTEGEIIRSILVIAEWRPGRESSETAPVRAGDALPPRGGLWFDVRQADGSPIPDGYRVEWRVANTGAVAIAKNAQRGGFYVSHRQNKRWEDLQYRGVHMVEAFVVRMRDDILVAQSDPFGVVIE

SEQ ID NO: 2052 - protein, 494 aa, Unknown
  Description of Unknown: Rhizobium sequence
MRDSSRVRRKRAVKLVALFDDFLKEVVNINATRLGLLTDGVYALKKFIRRSGYAPRIRTFYKQGSWAHQTIIRPVGGGEYDADLLVFVDPVKGWTAKDYVEKLYNEFSASGTYSDKVKIWEYCVTIEYAGDRKIDIAPCVVDRLWPGQGHEVCNRADDQFHESRPIEYTSWLIEKNGYSGGNSFRKVTRLLKYLRDYKKTFTCKSVLLTTMIGEQIEWMDQGKTNYADVPTALLTLISRLDEWLQANATKPQVRNPKLSSEDFSTMWSEEQYQNFRSCIHRYREWIEQAYHAENRDESIKLWQKVFGDDFGRSANVLAQKADTGSVTLADTLLPATGAHHDSLVEIIKRTGLSILPKWFFSPPYLKHPEWRTEGEIIRSILVIAEWRPGRESSETAPVRAGDALPPRGGLWFDVRQADGSPIPDGYRVEWRVANTGAVAIAKNAQRGGFYVSHRQNKRWEDLQYRGVHMVEAFVVRMRDDILVAQSDPFGVVIE

SEQ ID NO: 2053 - protein, 481 aa, Rhizobium anhuiense
MKLVALFDDFLKEVVNINSTRLGLLTDGVYAIKKFIRRSSYAPRIRTFYKQGSWAHQTIIRPVGGGEYDADLLVFVDPVNGWTAKDYVEKLYDEFAANGTYAGKVKMWEYCVTIEYAGDRKIDIAPCVVDRLWAGQGHEVCNRAEDQFHESRPIDYTTWLIEKNGYSGGNSFRKVTRLLKYLRDYKLTFTCQSVLLTTMIGEQIEWMDQGKTNYSDVPTALLTLISRLDVWLQANPHKPQVRNPKLSSEDFSTKWTEAQYQNFRNCIHRYRDWIEQAYNSESRDESIKLWQKVFGDEFGRSANVLAQKADTASVLAETLLPTTGAHRDSLVEIVKKAGLSILPNWFFAPPYLKQPQWRIEGEIIKSIKVVAEWRPGKESNEVTRVSAGDALPARGGLWFDVRQWNATPIPDGYRVEWRVANTGAVAIAQNAQRGGFYSSQRQNRRWEELRYRGIHMVEAFVIRTSDDVLVAQSDPFGVVVE

SEQ ID NO: 2054 - protein, 235 aa, Sphingobium ummariense
MKLVSQFTSFLKDTVNLNQTRIDLLESNVEAIRNFIRQCEWSPRVRGFEEQGSWAHDTIIKPVDGGEFDADLLVVVDPVDGWSAKDYVAKLGKAFADSSVYGSKAKTWDYCVTITYPGERKVDIAPLVRSRKYDGSLEVCNRAADRFDASEPVEFTAWLRERNALSGSNSFRKVTRLMKYLRDIKTTFTCPSVLLTTLLGMQIYWYDKGLCCKDWRQSEVGCRSAPIRRLLRNGG

SEQ ID NO: 2055 - protein, 481 aa, Sphingopyxis sp.
MKLVPQFSDFLRDTVNLNATRIGLLEKSVDAIKDFVRQCEWDPRVRGFEEQGSWAHDTIIRPLSGGEFDADLLVKVAPVSGWTAKDYVKKLGEAFADSATYGSKCKTWDYCVTVTYAGERKIDIAPLVMDRKHAGSLEVCNRLADEFEDSEPMHYTVWLRDKNLLSGSNSFRKVTRLLKYLRDIKTTFTCPSVLLTTLLGMQIDFHDKDTEAFADVPTTLRTLMRRLDDWLQARPVKPRVENPHLRSEDFAAGWTDLQYANFRSFIHKYRGWIDEAYDMEGKAASILAWRKIFGDGFAKGETAIAAASINEGTSLIATLLSTTAAHLDGIVDAVRRYGLSILPGNFNRPPHMEEPAWRREAVVSTDVAVIARRHRGRDSAPDRLLRSGDIVSRDGGIWFEATVNGGQPVPDGFRVQWRITNTGAMALRLNNGRGKFYAPTRQGLRWEELQYRGIHIAEAFIIRVRDDVLVGQSPPFNVVIE

SEQ ID NO: 2056 - protein, 481 aa, Novosphingobium sp.
MKLVSQFKSFLTDTVNLNQTRLDALESNVEAIKNFVRQCDWDPKIKSFYPQGSWAHDTIIKPVDGGEFDADLLVMVEPVKDWTAADYVKSLGKAFADSSTYGDKCKTWDYCVTITYAGDRKVDIAPCVLGRQIPGRLEVCNKPLDTFERSEPVGYTEWLKKQNGYSGGNSFRKITRLLKYLRDIKTTFTCPSVLLTTLLASHIHWTDKDSDSFANVPTTLKTVMGRLDDWLQARPAKPVIANPHLTSEDLASCWSEVQYSNFRNFINKYRKWIDEAYDEPDRSASITAWRRIFGDDFAKGEEVLAKASVSEGTSLVGRLLASTAAHLDELVDAVANYGVRILPSDFFAPPHMHAPRWPRAETFTRNVQVVAKWYGSKSAANGRPLQREEVLHRHGGIWFDVTVNGGQELPAGYRVQWRITNTGIMAIALNAGRGDFYAPQSGNRRWEELSYRGVHLAEAFIIRRGDDKLVGQSDPFPVIIE

SEQ ID NO: 2057 - protein, 491 aa, Rhizobium rhizogenes
MLREPTCIAEAKMKLADDFKEFLRDTVNLNQTRITQLEERVETIKTFLRASDWEPKISKFLEQGSWAHDTIIRPVDGGEFDADLLVMVKPVDGWSAAQYVKELGRVFRESGRYSDKTQVDDYCVTIIYADDCKIDIAPLVMDRDYQGTLEVCNKQEDCFEESSPVEYTRWIREKNGYSGNNSFRKATRLIKYIRNIKKRFSCQSVLLTTLIGHRIEWWDKDSAGFADTPTALQTIIGKLDDWLQDRPEKPQVENPSLPSEDFADLWNETQYANFRNFVNKYRKWIDEAIAAETRTDSIEKWRKVFGDEFAKSENVKKAEASASSQALALLRDGAAHLDALVETVIDFGISILPSSFRTPTHLHRPPWAAAEHISRSVRISAEYRASKHSGRGHPVNPGEALPPRGGLWFDVRVNKFQTVPSDCYVRWRITNTGAVAMALNKGRGWFEKPTEGDRRWEELQYRGVHMAEAFIIRRRDDRLVGYSEPFYVVIK

SEQ ID NO: 2058 - protein, 479 aa, Agrobacterium rhizogenes
MKLADDFKEFLRDTVNLNQTRITQLEERVETIKTFLRASDWEPKISKFLEQGSWAHDTIIRPVDGGEFDADLLVMVKPVDGWSAAQYVKELGRVFRESGRYSDKTQVDDYCVTIIYADDCKIDIAPLVMDRDYQGTLEVCNKQEDCFEESSPVEYTRWIREKNGYSGNNSFRKATRLIKYIRNIKKRFSCQSVLLTTLIGHRIEWWDKDSAGFADTPTALQTIIGKLDDWLQDRPEKPQVENPSLPSEDFADLWNETQYANFRNFVNKYRKWIDEAIAAETRTDSIEKWRKVFGDEFAKSENVKKAEASASSQALALLRDGAAHLDALVETVIDFGISILPSSFRTPTHLHRPPWAAAEHISRSVRISAEYRASKHSGRGHPVNPGEALPPRGGLWFDVRVNKFQTVPSDCYVRWRITNTGAVAMALNKGRGWFEKPTEGDRRWEELQYRGVHMAEAFIIRRRDDRLVGYSEPFYVVIK

SEQ ID NO: 2059 - protein, 484 aa, Sinorhizobium meliloti
MQGGLLMKLVSDFNDFVIDTVNLNQTRLDRLEERIETIKDFIRGSEWEPRISTFIEQGSWAHDTIIRPVDGGEFDADLLVKVYPVEGWSAAQYVKELGRLFLDSGRYGDKTVVYDYCVTITYADDCKIDIAPLVMDREYQGTLEVCNKRKDAFEGSQPVEYTRWMREKNGYSGNNSFRKATRLIKYIRDIKKRFSCQSVLLTTLIGHRIEWFDKDSGAFSDTPSALQTIIGRLDDWLQAHPNKPEVPNPALPSQDFADLWNDTQYANFRNFVHKYRKWIDEAFNAATRSESIEKWRKVFGDEFAKGENVKKAEATAIQRTSALLMEGAAHLDSLVDNVIDFGITILPSWFKTPAHMQPPRWRPAQHVSRNVQVSAEYAFQRTGRAYSINSGEAVPPRGGLWFDVRVNKFQMVPSDCYVRWRITNTGAVAMALKKGRGGFERPIEGNRRWEELEYRGVHMAEAFIIRIIDDRLVGYSEPFYVVIG

SEQ ID NO: 2060 - protein, 478 aa, Pelagibacterium luteolum
MKLVSDFKDFLTDTVNLNQARLDLLEVRVETIKDFIRGSEWEPRISTFIEQGSWAHDTIIRPVDGGEFDADLLVKVYAIDGWSAAQFVKELGRIFLDSGRYGDKTVVYDYCVTITYADDCKIDIAPLVRDRECQGTLEVCNKRKDEFEESQPVEYTRWMREKNGYSGNNSFRKATRLIKYIRDIKKRFSCQSVLLTTLIGHRIEWFDKDSSAFSDTPSALQTIMGRLDDWLQARPNKPQVPNPALPSQDFADLWNDTQYANFRNFVNKYRKWIDEAINATTRSDSIEKWRKVFGDEFAKGENVKKAEASAMQRTSALLMEGAAHLDSLVDNVIDFGITILPSWFKTPAHIQPPRWQPAEFVSRNVQVSAEYARQKTGRAYLINSGEALPPRGGLWFTVRVNKFQMVPADCYVRWRITNTGAIAMALKKGRGGFEQPTEGNRRWEDLEYRGVHMAEAFIIRRNDDRLVGFSEPFYVVIR

SEQ ID NO: 2061 - protein, 478 aa, Cohaesibacter sp.
MKLVNQFKEFLADTVNLNQTRIDRLEERVETIKSFIRGSDWEPKISTFIEQGSWAHDTIIRPVDGGEFDADLLVKVHTVNGWSAAQYVKELGRVFLDNGRYGDKTVIYDYCVTITYADDCKIDIAPLVMEREHQGTLEVCNKRKDEFEESQPVEYTRWMREKNGYSGNNSFRKATRLIKYNRDIKKRFSCQSVLLTTLIGHRIEWSDKDSSAFSDTPSALQTIMGRLDDWLQAHPDKPAVPNPALPAQDFADLWNDTQYANFRNFVNKYRKWIDDAINATTLSDSIEKWRKVFGDDFAKGETVQKAEALAMQRANAMLLESAAHLDSLVDSVIDFGIAILPARFKNPAHKHAPPWQSAEHVSRNVQVSAEYSNHKTDRSYPVQNGEALPPRGGLWFDVRVNKFQLVPADCYVRWRITNTGAVAIALKKGRGGFEHPTEVNRRWEDLQYHGVHMAEAFVIRKSDDRLVGYSEPFYVVIK

SEQ ID NO: 2062 - protein, 479 aa, Mesorhizobium ciceri
MKLVNDFKNFLSDTVNLNQTRITLLEDRAETINSFLRASDWEPTISTFIEQGSWAHDTIIRPVDGGEFDADLLVRVRPVDGWSAAQYVKDLGRVFLESGRYADKTVVYDYCVTITYADDCKIDIAPLVMDREYRGTLEVCDKRNDKFDESQPIEYTQWMREKNGYSGNNSFRKATRLIKYIRDIKKRFSCQSVLLTTLVGHRIEWFDKDSDGFADTPTALQTIMGRLDDWLQARPDKPGVNNPSLPTEDFADLWNDTQYANFRNFVNKYRKWIDEAIDAETRSDSIEKWRKVFGDDFAKGENVKKAEASAMQQASALLMEGAAHLDSLVDNVIDFGISILPLWFRTPSHLQAPRWQPAEQVSRNVQVFAEYRASQYSGKGHPINSGEALPPRGGLWFDVRVNKFQTVPADCYVRWRITNTGAVAMALKKGRGGFEKPTDGDRRWEALEYRGVHMAEAFIIRRSDDRLVGFSEPFYAVIK

SEQ ID NO: 2063 - protein, 479 aa, Mesorhizobium sp.
MKLVNDFKNFLSDTVNLNQTRITLLEDRAETINSFLRASDWEPTISTFIEQGSWAHDTIIRPVDGGEFDADLLVRVRPVDGWSAAQYVKDLGRVFLESGRYADKTVVYDYCVTITYADDCKIDIAPLVMDREYRGTLEVCDKRNDKFDESQPIEYTRWMREKNGYSGNNSFRKATRLIKYIRDIKKRFSCQSVLLTTLVGHRIEWFDKDSDGFADTPTALQTIMGRLDDWLQARPDKPGVNNPSLPTEDFADLWNDTQYANFRNFVNKYRKWIDEAIDAETRSDSIEKWRKVFGDDFAKGENVKKAEASAMQQASALLMEGAAHLDSLVDNVIDFGISILPLWFRTPSHLQAPRWQPAEQVSRNVQVFAEYRASQYSGKGHPINSGEALPPRGGLWFDVRVNKFQTVPADCYVRWRITNTGAVAMALKKGRGGFEKPTDGDRRWEALEYRGVHMAEAFIIRRSDDRLVGFSEPFYAVIK

SEQ ID NO: 2064 - protein, 479 aa, Mesorhizobium temperatum
MKLVSDFKDFLSDTVNLNQTRITLLEGRAETIKSFLRASDWEPTISTFIEQGSWAHDTIIRPVDGGEFDADLLVKVRPVDGWSAAQYVKDLGRVFLESGRYSDNTVVYDYCVTITYADDCKIDVAPLVMDRDYQGTLEVCDKRNDKFDESQPIEYTRWMREKNGYSGNNSFRKATRLIKYIRDIKKRFSCQSVLLTTLIGHRIEWFDKDSDAFADTPSALQTIMGRLDDWLQARPDKPVVSNPSLPTEDFADLWNDIQYANFRNFVNRYRKWIDEAIDAETRSDSIEKWRKVFGDEFAKGENVKKAEASAMHQASALLMEGAAHLDSLVDNVIDFGISILPSWFRTPAHLQTPRWQPAEHVSRNVQVFAEYRASQFSGKGYPINSGEALPPRGGLWLNVRVNKFQTVPADCYVRWRITNTGAVAMALKKGRGGFEKPTDGDRRWEALEYRGVHMAEAFIIRESDDRLVGFSEPFYVLIK

SEQ ID NO: 2065 - protein, 479 aa, Rhizobium leguminosarum
MKLVDDFKDFLRDTVNLNQTRITQLSDRVETIKSFLRASDWEPTISGFIEQGSWAHDTIIRPVDGGEFDADLLVKVRDVEGWSAAQYVKELGRVFLASGRYADKTVVYDYCVTITYADDCKIDIAPLVMDREYQGTLEVCNKREDEFDESQPVEYTRWIREKNGYSGNNSFRKATRLIKYIRDIKKRFSCQSVLLTTLIGHRIEWYDKDSSAFADTPTALQTIMGRLDDWLQARPDKPTVLNPSLMSQDFAELWNDIQYANFRNFVNKYRNWIDEAVEAPTRSDSIEKWRKVFGDEFAKGENVKKAEDSAVRQALLLLKEGAAHLDTLVDTVIDFGINVLPLAFRSPPHLQAPRWQPAETVSRNVQVTAEYRASGSTGRGHRVNSGERLPPRGGLWFDVRINKFQTVPADCYVRWRITNTGAVAMALRKGRGGFEKPTDGDRRWEALEYRGVHMAEAFIIRRRDDRLVGYSEPFYVVIK

SEQ ID NO: 2066 - protein, 479 aa, Ensifer adhaerens
MKLVSDFKDFLEDTVNLNQTRIDLLSARVDAIKDFLRASDWDPQILRFIEQGSWAHDTIIRPVDKGEFDADLLVKVKPVDGWSAAQYVKELGRVFRDSKRYGEMTVVYDYCVTITYADDCKIDIAPLVTDREYQGTLEVCNKRADEFEESQPIEYTRWIKEKNGYSGNNSFRKATRLIKYIRDIKKRFSCQSVLLTTLIGHRIEWWDKDTTAFADTPSALQTIMGRLDDWLQERPEKPKVENPSLKSQDFADLWNDTQYANFRNFVHKYRTWIDDAIEAPNRAESIEKWCRVFGDDFAKGENVKKAEASVTDRARVLLMDTAAHLDGLVDTVIDYGVGILPSIFNKPPHQQAPPWPMAETVSRNVQVFAEHSGTKLKGRGHRISSGEALAPKGGLWFDVRINKFQAVPSDCYVRWRITNTGAAAMAQKCGRGGFEKPTEGDRRWEGLQYRGVHMAEAFIIRRRDDRVVGQSDPFYVVIK

SEQ ID NO: 2067 - protein, 479 aa, Rhizobium sp.
MKLVSDFKDFLTDTVNLNQTRIDLLTARVDAIKDFLKASDWDPQILRFIEQGSWAHDTIIRPVDKGEFDADLLVKVKTVNGWSAAQYVKELGRVFRDSKRYGEMTVVYDYCVTITYADDCKIDIAPLVTDREYQGTLEVCNKRADEFEESQPIEYTRWIKERNGYSGNNSFRKATRLIKYIRDIKKRFSCQSVLLTTLIGHRIEWWDKDSTAFADTPSALQTIMGRLDDWLQERPDKPRVENPSLKSQDFPDLWNDTQYANFRNFVHKYRTWIDEAIEAPNRAESIEKWRRVFGDDFAKGENVKKAEASVTDRARVLLMDTAAHLDGLVDTVIDYGVGILPAVFSKPRHQQTPPWPMAETVSRNVQVFAEHSATKVKGRGHRISSGEALAPSGGLWFDVRINKFQTVPSDCYVRWRITNTGAAAMAQKCGRGGFEKPTDGDRRWEGLQYRGVHMAEAFIIRRRDDRVVGQSDPFYVVIK

SEQ ID NO: 2068 - protein, 490 aa, Sphingomonas sp.
MKLIKHFSEFLTDTVNLNQNRIDTLEASVDAIKKFIREADWEPRVWKFVEQGSWAHNTIIRPVDSKEFDADLLVIVDPVEGWTAANYVSKLGDAFKASGLYKDKVEVWDYCVTIVYATDRRIDIAPCVRGRKVAERLEVCNRATNDFERTEPVKYTEWFNAKNGYSGSNSFRKVARLIKYLRDIRGDFACPSVLLTTLIGERIQWSDAGASEFKDVPTTLRTIMRRLDTWLQARPRRPQVPNPELISEDFAASLTDQAYADLRTAVSELRAKIDTAFETQGKFASILAWREIFGDKFAKGITVLSSSLTESADQDEVDEDPNVLLAGLIRSDAHHDSRIVDMVTRVGRWLWKPSLDRPSHMRQPIWPRADIVSDRVQIAATWRPNRNSPEGRRVEDFEQVPGRGGLWFDVLVNDGQRLPSGHSVRYRITNTGAIAMAIGKGRGGFETPQEGTRRWEPLEYRGVHLAEAFVIRDGDGRLVGQSRPFHVVIT

SEQ ID NO: 2069 - protein, 487 aa, Methylobacterium sp.
MKLTNHFSDFLRDTVNLNQTRIDTLESSIEAIENFIKSSDWKPRVWKFFEQGSWAHNTIIRPVEGGEFDADLLVIVEPVEGWTAADYVRTLGQIFQASGIYKDKTEVWEYCVTVTYVGDRKIDIAPCVRGREVKDRLEVCNRAKNAFEQTEPVKYTDWFNTKNGYSGANSFRKVARLVKYLRDIEDDFKCPSIVLTTLIGQQISWLDKESAEFEDVPTTLKTIATRLNGWLQARPVKPQICNPELTHEDFASAMSQEEYDDFRSAISNIKTKIDTAFDQTGRYASVLAWREVFGDRFAKTVTILSSVLAEDTELEKAEESLLSGVTRSDAWHDNRIVDLVGRMGRWLWKPSFDRPKHMSQPIWPRADIVSDQIQIHATWRPSRYSPESKQVADFQALARSGGLWFDITVNAGDALPAGFYVRYRITNTGSVAMGRGQGRGGFETPQEGTRRWEELQYRGIHLAEAFIIRESDRKLVGQSAPFHVVIT

SEQ ID NO: 2070 - protein, 488 aa, Methylobacterium sp.
MKLISHFTNFLRDTVNLNQTRIDDLDSSVEAIKKFVRESNWEPRVWKFIEQGSWAHNTIIRPVEGGEFDADLLVIVEPIDGWNPSDYIDSLGRIFISSGRYVDKVQIFDYCITITYAGYRKIDIAPCVRGRLLDGQLEVCNKREDTFERSEPLQYTEWFNTKNTYSGSNTFRKVTRLIKYLRDIEGGFECPSIILTTLIGERINWNDDGSANFVDVPTTLKTIIGRLDDWLQLHQIKPSIYNPHLRSEDFAKDFTQNSYSKFRNTIHQMRSKIDYAYDIEGKYASITAWRDIFGQNFAKGHSIVAIASVNEQLGFDKSEDTFLTDVAKPNADHDSTIVDLVRTYGRWLWKPKFDRPKHMSAPIWARADIVSDRVEVIASWQPSRHSPVSTKIRDFDELSNTGGIWFDVLVNNGASLPPEHRVRYRVTNTGAVAIALKKGRGGFETPQEFSRRWENLEYRGIHLVEAFIIRDRDDKIVGQSMPFHVVIQ

SEQ ID NO: 2071 - protein, 478 aa, Novosphingobium sp.
MKHVEHFRNFLKDTVNLNQTRITDLENSTGAIERFIRQSTWEPTIKRFAEQGSWAHDTIIKPVDQGEFDADLLVMVDPVDGWTAEDYVKTLGKTLKESSTYGEKTKVWDYCITVTYAKEHKVDVAPCVVERIWANTLEVCNKKHDEFEESRPEEYTQWLKDRNAISGTNSFRKVTRLVKYLRDIKLTFSCPSVILTTLLGNHIHDWDKGSSSFADVPTALKTLMGRLDDWLQARPDKPQIPNPKLLGEDFAANWPEAKYENFRNKIQRYRTWIDEAYDEPDKNESIIAWRRVFGPEFAKGVTVEVKKSLSEATALARVLASDAAYNHDLVRDVRLYGAAIVPASVSHPDHQEPAAWPISARPWIDLLITAHHQRKRSSAGKAVQSGEVLAPRGGLLFRAFAFGGQSFPSDCHIKWRITNTGITAMIAKCGRGDFYSSEKGNTRWEPLAYHGVHVAEAFLISADGALLGQSRPFHVVID

SEQ ID NO: 2072 - protein, 479 aa, Sphingomonas pituitosa
MKLTSCFTSFLKDTVNLNQTRIADLERSIEAIQRFIRQSTWKPSIRGFEEQGSWAHDTIIKPVDQREFDADLLVMVDPVDGWTAKDYVKELGKVFKASATYGDMTKTWDYCVTITYANERKIDIAPCIVDRAYVDTYEVCNAKIDTFENSAPIEYTQWMKDQNSYSGSNSFRKVTRLVKYLRDIKLTFSCPSVLLTTLLGNHIYSWDKGSDAFADVPTALKTIMGRLDDWLQERPFKPEVRNPKLWSEDFASSWADEKYSNFRDKIHRYRGWIDEAYDALTRSDSIIAWRRVFGSEFAKGETVELKKSLNEASAMARVMVASNSTYQNDLVRDVLIYGTAVVPTSITHPAHQTPSPWPISSRPWIDIYITATHQRKKSRAGKIIGSGDVIAPTGGLMFNALLANGQHLPHDCHIRWRITNTGAAAMLAGCGRGDFYSAEKGNTRWEPLQYHGVHTAEAFLVSSDGTLRGQSLPFHVVLD

SEQ ID NO: 2073 - protein, 468 aa, Stenotrophomonas maltophilia
MKHLNHFSAFLENVVNLNSTRLEQLDNSFVAIEGFLKDSNYLPKIIRLYKHGSWAHQTIIRPLDGRPFDADAILFVRPVQGWAAADYVDQLARTFEASPRYADKVKRYPYCVTLEYAGDRKMDIAPCVVDRLYAGSNEVCNRRNNTFQDSRPEEYTSWLRGKNSISGNNSFRKVTRLAKYLRDYKGTFTCPSFLFTTLLGERIHEGDRHGNDFSDVPTSLRTLFRRLDDWLQGHHYPPHVPNPVLPAEDQASEWTEEQYRNFRNAIHRYRQWIDAAFDEQDSTQSIELWRRILGDSFAVLRKPTVAMEAGLAGADVQLDDVDVLKTGGLQMVPLEILEPGHRKQPQWPLANFRLPATISGYLVDAAGAPSRVVRSGEPMQPNQDIRFEAKLGGLAPNHTYRTMWRVTNTGAVARRAGKLRGDFVGSDQPHSRRETLSYRGVHQVEAFVLSTTDNQIVGFSQPFYVVVE

SEQ ID NO: 2074 - protein, 467 aa, Stenotrophomonas maltophilia
MKNLNHFSSFLANVVNLNSTRLDQLENSFAAIEVFLGNSNYVPRIVRLYKHGSWAHQTIIRPLDGRPFDADVILFVRPVEGWTAADYVDQLARTFESSPRYADKVRRYPYCVTLEYAGDRKMDIAPCVVDRLYPDSKEVCNRRDNAFQASKPEEYTSWLRGKNSISGNNSFRKVTRLAKYLRDYKGTFTCPSFLFTTLLGERIHEVDRYGNDFSDVPTSLRTLFRRLDDWLQANYYPPHVPNPVLPAEDQASEWSEEQYRNFRNAIHRYRQWIDAAFDEQDSDQSIELWRRIFGDSFALVRQPVIAMEAGLVDADAQLDDVEALRIGGLQMVPVEVLEPGHRQQPPWPLANFRLPASVSSYLVDAAGIRLRTVRSGEPMAPNQDIRFEAKLGGVQPNDTYRTMWRVTNTGEAARRVRNLRGGFDHSDQPHSRRETLSYRGVHQIEAFILNADGQIVGFSQPFYVAIE

SEQ ID NO: 2075 - protein, 469 aa, Xanthomonas translucens
MKLLAYFNTFLANTVNLNETKLDQLDSSFEAIKKFLRDSDYKPSIGKFYKHGSWAHRTIIRPIDGRPFDADVIAFLKPVEGWSAADYIENLALVFRNSARYKDKVKTYSHCVTIEYAGERKMDIAPCVIGREMDDIHEVCNADLDEFQLTKPKEYTAWLNSKNGYSGLNSFRKVTRLLKFIRDYKRTFTCPSFLLTTLLGERINFSDKDTDFFRDVPTALKTVVARLDDWLQATAYPPYVPNPVLTAESQASAWTEAQYSNFREVIHRYREWIDDAYNEEDVAASLSKWRRIFGDNFGEVRKAEVVSTEVLAKDALVVDDAVDIARKSGLKPIPPAILEPVHKAPPQWPVVLIAQQVTVTAALDGVANHKGMSVENGEPVEAHQGIRFRAMLGGVVPGTMYRTMWRVTNTGEAARHAGALRGGFVASDVPHSRWEHLEYRGIHQVEAYIVRESDSILVGFSKPFYVVIE

SEQ ID NO: 2076 - protein, 470 aa, Rhodanobacter sp.
MKHVNSFDDFLKDVVNINSTRLQNLDDSFEAIKKFIRNSTYTPKVSSYFRHGSWAHQTIIRPVEGNPFDADIIVFVQPVEGWEACDYVDELMKVFEGSGTYKDKVRRFSHCATIEYVNDRKMDIAPCVLGRTYEGSVEVCNRVTNSFEASAPEDYTKWIKDRNSDGGNNYLRKVTRLLKYLRDIKTTFTCPSFLLTTLLGLQIYPGDKDNDGFKDLPSALKTVLGRLDTWLQTKPFRPSVFNPVLASEDQASGWTDVQYQNFRTQIHRYRGWVDEAYEEADQAKSLEKWRKVFGDDFGKAKLTKVEANANSERGILATTDDVDVIREHGLAALSPEVAAPCWRKTPAWDATNLQMNIGVQAWIAPFKDGRLMKRIANGEALESDQYIRFTAHLLGSASADAYRTEWRVTNTGPVAARRNSLRGGFELSKPDHTRWEQLSYRGVHMVEAFLIRKVDQVQVGMSNPFYVVIE

SEQ ID NO: 2077 - protein, 480 aa, Burkholderiales bacterium
MKLVQDFNTFLNDTVNLNSTRFDQLESSIDAIKMAVRGLDWKPSIVGFSAQGSWAHKTIIKPLPGDPFDADLLVYVKPVAGWEAKDYINDLYAEMGKLGLYKDKIRRYSHCITIEYTGERKIDVAPCVKERLQTGVWEVCNRDTNLFEKSNPLDYTDWLIERNNICGNNNFRKATRLLKYLRDIKTNFTCPSFLLTTLLGKHVYATDRGTAGFVDVPTTLKTLINRLDDWLQANPSKPTVRNPVLFEEIQSTAWDDTKYSNFRSKINLYRGWIDDAYDELDREESIGKWQRVFGDDFAVRETVEKASRVSEAALLVVRGSSVSAGVADLVALVKKIGRAALPSGFDRLPHMRRPRWRSTAGSRLTVNVGAQLRTSRYGQIVSSLVSLTPTPPGYWVRFNACNNLGLPFPETYMVEWRVTNTDEVARRANALRGDYYRSDEPGVRWEQLSYRGVHMVEAFLIRKADDALLGKSDPFYVVIE

SEQ ID NO: 2078 - protein, 480 aa, Comamonas testosteroni
MKLVQDFNAFLNDTVNLNSTRFDQLENSIEAIKTAVRGLDWKPSIIGFAAQGSWAHKTIIKPLPGDPFDADLLVYVKPVAGWEAKDYINELYAEMGKLGLYKDKIRRYSHCITIEYAGERKIDVAPCVKERLETDVWEVCNRDTNLFEKSNPIDYTDWLIERNSICGNNNFRKATRLLKYLRDIKTNFTCPSFLLTTLLGKHVYATDKGAAGFVDVPTTLKTLIDRLDDWLQANPSKPTVRNPVLFDEIQSTAWDDTKYSNFRSKINLYRGWIDDAYDETDREESIGKWQRVFGEDFAVREAAEKASRVSEAALSVVRGSPVLAGVTDLVALVKKIGRAALPNGFDRLPHMRRPRWRSTAGSRLTVNVGAQLWTSRYGQLVRPLDSLAPTQPEYWVRFNASNNLGLPFPETYKVEWRVTNTDEVARRANALRGDYYRSDEPGVRWEQLSYRGVHMVEAFLIRKVDDSLLGKSDPFYVVIE

SEQ ID NO: 2079 - protein, 480 aa, Achromobacter piechaudii
MKLVQDFNTFLNDTVNLNSTRFDQLERSVEAVKTAMRGLDWKPSIVGFAAQGSWAHKTIIKPLPGDPFDADLLVYVKPVAGWEAKDYINELYAEMGKLGLYKDKIRRYSHCITIEYAGERKIDVAPCVRERLQADIWEVCNRDTNLFEKSNPLDYTGWLIERNNICGNNNFRKATRLLKYLRDIKTNFTCPSFLLTTLLGKHVYATDKGAAGFVDVPTTLKTLIDRLDDWLQANPSKPTVRNPMLFQEIQSTAWDDTQYSNFRSKINLYRGWIDDAYDETDREESIGKWQRVFGEDFAVREAAEKAGKVSEAALSVVRGSPVLAGVADLVALVKKIGRAALPSGFDRLPHMRRPRWRSTEGSRLTVNVGAQLWTSRYGQLVRPLASLAPTQPGYWVRFNASNNLGLPFPETYTVEWRVTNTDEVARRANALRGDYYRSDEPGIRWEQLSYRGVHMVEAFLIRKVDDRFLGKSDPFYVVIE

SEQ ID NO: 2080 - protein, 480 aa, Xylophilus ampelinus
MKLVQDFNAFLNDTVNLNSTRFDQLESSIEAIKTAVRGLDWKPSIVGFAAQGSWAHKTIIRPLPGDPFDADLLVYVKPVAGWEAKDYINDLYAEMGRLGLYKDKIRRYSHCITVEYAGERKIDVAPCVKERLHTGVWEVCNRDTNLFEKSNPLDYTDWLIERNSICGNNNFRKATRLLKYLRDIKTNFTCPSFLLTTLLGKHVYASDRGDAGFEDVPTTLKTLIDRLDDWLQANPPKPTVRNPVLFEEIQSTAWDDAKYLNFRSKINLYRGWIDDAYDDPDKEESIGKWQRVFGEDFAVREAAEKAGKVSEAALSVVRGSPVSAGVADLVALVKKIGLAALPSGFDRLPHMRRPQWRMATGTRLTVNVGARLWTSRYGQNVCSLASLAPTQSGHWIRFNASNNLGLPFPETYMVEWRVTNTDEVARRANALRGDYYRSDEPWVRWEQLSYRGVHMVEAFLIRKSDDTLLGKSDPFYVVIE

SEQ ID NO: 2081 - protein, 480 aa, Variovorax sp.
MKLIQDFNAFLNDTVNLNSTRFDQLESSIEAIKTAVRGLDWKPSIVGFAAQGSWAHKTIIKPLPGDPFDADLLVYVKPVAGWEAKDYINDLYAEMGKLGLYKDKIRRYSHCITIEYAGERKIDVAPCVKERLYTGVWEVCNRDANLFEKSNPLDYTDWLIERNSICGNNNFRKATRLLKYLRDIKTNFTCPSFLLTTLLGKHVYASDKGGAGFEDVPTTLKTLIDRLDDWLQANPLKPTVRNPVLFEEIQSTAWDAAKYLNFRSKINLYRGWIDDAYDEPDKEESIGKWQRVFGEDFAAREAVEKATKVSEAALSVVRGSPVSAGVADLVALVKKIGRAALPSGFERLPHMRRPRWRAASGTRLTVNVTAQLWTSRYGQQVRPLASLAPTQPGYWVRFNASNNLGLPFPETYKVDWRVTNTDEVARQANALRGDYYRSDEPLVRWEQLSYRGVHMVEAFLIRKADDSLLGKSDPFYVVIE

SEQ ID NO: 2082 - protein, 480 aa, Achromobacter xylosoxidans
MKLVQDFNAFLNDTVNLNSTRFDQLECSIEAIRKSVRGLDWKPSIVGFAAQGSWAHKTIIKPLPGDPFDADLLVFVRPISGWEAKDYINELYAEMGKLGLYKDKIRRYSHCITVEYVGERKIDVAPCVKERLHSDVWEVCNRDTNLFEKSNPLDYTNWLIERNGICGNNSFRKVTRLLKYLRDIKTNFTCPSFLLTTLLGMQVYASDKGTVGFTDVPTTLKTLVDRLDDWLQANPSKPTVRNPVLFEEIQSSAWDDIKYSNFRAKINLYRGWIDDAYDEPDKEESIGKWQRVFGEDFATREAVEKAGKVSEAALSAVRGSAALAGVADLVALVKKIGREALPRDFDRLPHMRRPRWREAAGTRLTVNVGAQLWTERFGRQVSPFVSLAPTPPGYWVRFNASNNLGLPFPDTYKVEWRVTNTDEVARRANALRGDYYRSDEPWVRWERLSYRGVHMVEAFLIRRSDDFLLGKSDPFYVVIE

SEQ ID NO: 2083 - protein, 480 aa, Candidatus Accumulibacter phosphatis
MKLIQDFNTFLVYTVNLNSTRFGQLENGIEAIKTSVRGLNWKPTIVGFAAHGSWAHKTIIKPLSGDPFDVDLLVYVKPVARWEAKDYINELYAEMGKRGLYKDKIRRYSHCITIEYAGERKIDVAPCVKERLQSGAWEVCNRGTNSFEKSNPLDYTNWLIERNAISGSNNFRKTTRLLKYLRDIKTNFTCPSFLLTTLLGMQVYASDKGTPGFVDVPTTLKTLIDRLDDWLQANPSKPTVRNPVLFEEIQSNAWDDTKYSNFRAKVNLYRGWIDDAYDEPDKEESIGKWQRVFGDDFAVREAEEKASKVSEVALAAIRGTPLLEGVGDLVALVKKIGRAALPSGFDRLPHMRRPRWRNVLGTRLSVNVGAQLWTARDGQQLHTLRSLEPLTSGFWVRFNARNNQGLPFPDTYKVEWRVTNTDEVARRANALRGDYYRSDSSGVRWEQLSYRGVHMVEAFLIRKTDDVLLGKSEPFYVVIE

SEQ ID NO: 2084 - protein, 480 aa, Methylosarcina fibrata
MKLITHFDDFLRDTVNLNQTRVTLLEDSIEAIKTFINNSDWKPEIIEFKPQGSWAHKTIIKPLTDYPFDADLIVYVKPVDGWEAKDYVNNLYTEFQGSGIYKEKTRRYSHCVTIEYAGERKIDIAPCVKDRLYSGTYEVCNRNSNEFERSKPGEYTDWLIDKNSISGKNNLRKVTRLLKYMRDIKTNFICQSFLLTTLLGDRISYVDSINKPFTDVPTSLKILIGRLDDWLQANPTKPTVRNPVLYEEIQSNAWDETKYSNFRNKINLYRGWIDDAYDESDKEESIGKWRRVFGDDFAAEETVAKAACVSESAALELSGRSLASAGSDLVTLVRSLGSIALPKGFNRLPHMHRPKWRASSSAGVAVKVSAYLYTGRYGQPIRQITSLEPLKSGYWIKFSASSGSGLPFPNEYYVMWRVTNTDKAAQKAQALRGEFYESDSNNSRWEGLQYRGVHIVEAFLIRKATEVMQGKSDPFYVVIE

SEQ ID NO: 2085 - protein, 478 aa, Pseudomonas syringae
MKMISQFNSFLSDTVNINQTRFDRLESSIEAVKRYLSNSGWTPKIVRYAAHGSWAHRTIIKPVEGAAFDADLLVYIDPVEGWDAKSYINTLYDEFNASAIYSGKLRRSSHCITIEYAGERKIDIAPCLIERQSSGAYEVCNRASNMFEASRPGDYTKWLVEKNTESTGNNLRKVTRLLKYLRDIKTTFTCPSFLLTTLVGERVSYGDGNAPEFADVPSALKEIVGRLDDWLQQNYYLPEIRNPVLWEEIQSGSWDQTKYSNFRTVINRYRGWIDDAYNEEDKDESIAKWRKVFGDEFAKSEVVEKAARISSLATAGLESASSYFSDLVVAVKTIGRNALPIGFTSLPHMERPKWREANGAPLRVRIKAYRTSSENGQRLNEVVSLEPQNPGGWLQFQALDSVGLPFPTTFSVKWRITNTDMAAHAAKCMRGQFYSSDTHGVRTEGLQYHGVHMVEAFVIKKADDSIVGRSEVFYVVVD

SEQ ID NO: 2086 - protein, 478 aa, Pseudomonas syringae
MKMISQFNSFLSDTVNINQTRFDRLESSIGAVKRYLSNSGWTPKIVRYAAHGSWAHRTIIKPVEGAAFDADLLVYIDPVEGWDAKSYINTLYDEFNASAIYSGKLRRSSHCITIEYAGERKIDIAPCLIERQSSGAYEVCNRASNMFEASRPGDYTKWLVEKNTESTGNNLRKVTRLLKYLRDIKTTFTCPSFLLTTLVGERVSYGDGNAPEFADVPSALKEIVGRLDDWLQQNYYLPEIRNPVLWEEIQSGSWDQTKYSNFRTVINRYRGWIDDAYNEEDKDESIAKWRKVFGDEFAKSEVVEKAARISSLATAGLESASSYFSDLVVAVKTIGRNALPIGFTSLPHMERPKWREANGAPLRVRIKAYRTSSENGQRLNEVVSLEPQNPGGWLQFQALDSVGLPFPTTFSVKWRITNTDMAAHAAKCMRGQFYSSDTHGVRTEGLQYHGVHMVEAFVIKKADDSIVGRSEVFYVVVD

SEQ ID NO: 2087 - protein, 477 aa, Pseudomonas sp.
MKLVSQFNDFLQDTVNLNQTRFNQLESSIGAVQRFLSGSSWEPKIIRYASHGSWAHKTIIKPVEDASFDADLLVYVDPVDEWEPKQYINSLYEVFRTSAAYSDKVRKSSHCITIEYAGERKIDIAPCIKERTYSDFYEVCNRNSNEFEESRPGDYTDWLINKNSESSLNNLRKVTRLLKYLRDIKTTFTCPSFLLTTMLGERIQNGDKSSPKFSDVPSALKEVVGRLDDWLQSNYFLPEIHNPVLWGEVQSKCWDQTKYSNFRNVINRYRGWIDEAYDEQDKDESIAKWRRVFGDEFAKAEVVEKAARIKPVVVAAFESAGSWSDMVSAVIALGRRALPENFTKLPHMERPKWRNAGNAPVNVRVKANRADGEYGARQAEVQSLTPLHPGAWLEFSALNLNSLPFPKEYSVKWRITNTDAAAHEAKCMRGQFYPSDTHGVRREYLKYHGVHMVEAYVIRKSDDSVYGRSEVFYVVVN

SEQ ID NO: 2088 - protein, 477 aa, Pseudomonas sp.
MKLISLFDDFLTDTVNLNKDRFNKLESSIDTLKQFIQNSDWEPTVIEFSAQGSWAHKTIIKPLPECPFDADLLVYIDPVDGWEPKDYVNRLHNVFAASGVYREKLRRFSHCVTIEYAGERKIDIAPCIKERMYVDIYEVCNRISNEFEESNPKDYTDWLHEKNRETTKNNLVKVTRLVKYMRDIKGNFTCPSFLLTTLLGLQVRDGDLLNETFSDVPAALKILMGRLDDWLQLNPTKPIVKNPVLFTEVQSNAWDDVKYDNFRNKISKYRNWIDEAYSEDDRGKSISAWRLLFGEDFARTEVVEKASLISRAANESFAPSGSIFIDLVDRVKTLGRAALPSGFNSLPHMQKPQWRLAGSQLSVRVRAFLRTNKDSPRLWEVASLTALSPGKWLEFCAFTGNGLPFPRDYRVMWRVTNTDAVATRNNALRGDFYHSDIHAVRTEQLSYRGVHMIEAFLVRKSDEVLAGKSEVFYVTIE

SEQ ID NO: 2089 - protein, 482 aa, Mesorhizobium sp.
MKLLSHFNDFLKDEVNLNQTRVDSLETSIQAIEDYLDGSEWGDIIVDWVPQGSWAHKTIIKPVDKGEFDADLLVYVSPVEGWEAKDYINDLYAQFRATDTYRDKVKRWSHCVTVTYANDKKIDVAPCVVGRIVSDQLEVCNRDANTFERSEPKLYTDWLIERNKWTGSNTFRKVTRLLKYMRDIKTRFTCSSVLLTTMVGDRVTSQDQGQAYVADVPAALKTIFGRWDDWLQINAIKPAVRNPYLQSEDFAAGLTQDQWTNLRDKIHTYRQWIDEAYNEENQNESISKWRRVFGEKFAKNVDTEAAVSVSKAAVTVITETAGALADVGGDLIALLKRFGRRVITPDFPHFPYMRQPKWRRSPGQNLPVVVRASLYQSRGYNKIRDVQALELLPAGREIELRAVTSTGLPFSTDFEIQWRITNTDEEAKQRGQLRGGFEDSSTHGQRWETLQYRGVHIAEAFVIRKQDRTLVGVSKPFYVAIE

SEQ ID NO: 2090 - protein, 482 aa, Mesorhizobium sp.
MKLLNHFSDFLKDEVNLNQTRIGSLETSIDAIEAYIDGSEWADIIIDWVPQGSWAHKTIIKPVDKGEFDADLLVYVNPVEGWEAKDYINDLYAQFRASDTYRDMVRRWSHCVTVTYADDKKIDVAPCLVGRLVNGQLEVCNRDANAFERTEPRQYTAWLIERNGWTGSNTFRKVTRLIKYMRDIKTRFTCSSVLLTTMLGERVTSQDNGQAYVADVPTALKTIFGRWDDWLQIKATKPAVRNPYLWNEDFAAGLAQEQWTNLRDKIHTYRQWVDEAYDEPNQNESISKWRRVFGDKFAKNVDTEAAVSVSKAAANIITESAGALADVAGDLIALLKRYGGRVITPDFPHLPYMRQPKWRRSPGQGIAVNIKASLYQSKGYNRIRDVQSLELLPAGREIEFRAVTSTGLPFPTDFDVQWRVTNTDEEARQRGQLRGGFESSDTHGQRWETLQYRGVHIAEAFVIRKQDRSLVGISKPFYVAIE

SEQ ID NO: 2091 - protein, 483 aa, Mesorhizobium sp.
MKHVDLFAAFLKDEVNLNQTRVDSLAVSVEAIKEFVEASDWNASIIEWVGQGSWTHKTIIKPVDGGEFDADLLVMVSPVEGWEAKDYINDLNRVFKGSSTYADMTRRWSHCVTITYANDKKIDVAPCLIGRSYVGSIEVCNRDTNEFERSEPARYTEWLLERNSWSGSNSFRKVTRLVKYLRDIKTTFTCPSILLTTLLGDRVTAVDQYTNGVGDVPTALRTLFGRLDDWLQANVAKTAVYNPCLYGEDLAAALTDQQHTNLRDFIHRYRGWIDDAFLETERSESIGKWRRVFGDAFAKDVILNEAVEVSKSAAAVARQVVGALADTSGDLIALLKRYGTAVIPNGFRRHPHMVQPRWRIAAAPVVSVVVKAELYASQGYNKLRDVDSLGLLPSGCWLQFRATTANGLPLTSDEYDVQWRVTNTDQVAKSRNQLRGDFYPSSTRGYRWEKLEYRGVHLAEAFVIRKRDNVQIGKSEPFLVAIE

SEQ ID NO: 2092 - protein, 482 aa, Ochrobactrum pseudogrignonense
MKHIKLFDDFLRDTINLNTTRIDSLESSVDAIKNFIEASDWKPEIREWMAQGSWAHKTIIKPVDAGEFDADLIVFVDPVDGWTAKDYLNNLYLEFRGSPVYQNKVRRWSHCVTITYANEKKIDIAPCIMNRSWNGSLEVCNRDSDEYEHSEPKQYTDWLIERNTWSGANSFRKVTRLIKYLRDIKTTFTCSSILLTTMLGYRMSSIDRYGSDFVDTPTALKTIFSRWDNWLANNYNKPRVSNPFVDCDFASELTDVQYDNLKKMVSKYRGWIDDAYAETDRNESIAKWRRVFGDDFAKDEVIEEAKSVSKNAVLLLKEARNLAIDATADLVSLVKRFGGAALPSGFNNLPHMKRPTWRVATNTNISVQVKAELYQSKGYNKLYDIQSLQPLPPNNWIRFRATALNGFPFPKDDYEVHWRITNTDQEAYRANCLRGGFERSDTYGEKWEQLAYRGVHPVEAFVLRKRDNNLVAKSAPFYVTIE

SEQ ID NO: 2093 - protein, 482 aa, Unknown
  Description of Unknown: Bradyrhizobium sequence
MKLVDLFNEFLNDTVNLNQTRVNGLEDSIEAIKGAVKDSDWKPKIQSWEPQGSWAHKTIIKPVDQGEFDADLLVFVHPVDGWEAADYIEELYTAFRANGTYKDKVRRWSHCVTITYANESKIDIAPCVVNRVGNRLEVCNRVQNEFELSEPLQYTEWLTERNGYSGNNSFRKVTRLIKYLRDIKTRFTCSSVLLTTLLGYRINSTDKDSDAFVDTPTALKTIFGRLDDWLQTNNAKPTVSNPKLTSENFADNWTDDQYSNFREKIHTYREWIDEAYDEEDRNESIAKWRRVFGDEFASSVDIAEGKSISKMAIARLKESVSAAALFAGDLVDAVKAYGAQALPGGFNKRPYMKAPKWKKAKTGTFPIYIRAALYQSKGYNKLRDVQSLDPVPAGRWLEFSAVTSQGLPPSGQDFMVQWRVTNTDEAAFAARQLRGDFYESQGGQTRFEELKFRGIHLVEAFVVRKRDDALVAQSEPFRVLIE

SEQ ID NO: 2094 - protein, 483 aa, Bradyrhizobium japonicum
MKHVDLFKDFLNDVVNLNLTRVTALEDSIEAIKSAVKDSDWAPKIRSWMPQGSWAHKTIIKPVDQGEFDADLLVFVDPVSGWSAETYIEKLYEVFRANGTYKDKVRRWSHCVTITYANDRKIDVAPCVVNRGGFVRLEVCNRNTGEFEATEPVQYTEWLTERNSYSGSNSFRKVTRLIKYLRDIKTTFTCSSVLLTTILGSRINSLDKDSDAFADTPTALKTMFGRLDEWCQLSPTKPNVNNPFLQSENFAESWTDEQYANFRERVNTYRGWIDEAYDEADRNESIAKWRRVFGDDFAKSVDAEDAKSISKMAVARLKESVSTAALFVGDLVEAVKQFGVQALPLGFNKRPYMKAPRWKKAKAGTFTICIKASLYQSKGYNELRRVNSLDPVPKDRWLEVTAVTSAGLPPSKEEYEVQWRVTNTDEDAYNARQLRGDFYASEGGQSRFEELSFRGIHLVEAFVIRKRDNTLVAQSEPFRVLIE

SEQ ID NO: 2095 - protein, 485 aa, Acetobacter orleanensis
MKHVDIFNAFLNDVVNLNITRVQNLESSIGAIKSVVINSNWEPSLKGWMPQGSWAHKTIIKPVDLGEFDADLLVFVRPVVGWDAQKYIETLYQVFRGNGTYKDKVKRWSHCVTITYANEKKIDVAPCVIDRDGVSRFEVCNRNTNEFELSEPRRYTDWLITQNSYSGNNSFRKCTRLIKYLRDIKTRFTCSSVLLTTILGYRINESDKFSDDFIDTPTALKTIFARLDDWLQLNSKKPVVSNPFLTCEDFASGWTDEQYSNFRQKIHTYREWIDDAYMEQDRVESIAKWRRVFGSDFASHVVFDEGKSIGKAVISCVKESIEGGSLLVGDLVDAVKKFGASILPTNFNKTSYMEVPRWHRAPSTQQLSVSIRAELYQHKFSTTPLGFVNSLEPLQSGFFLQFKAIMNSGTPFSSALYKVYWRITNTDEAAAAENCLRGNIEEPESDNSRWEQLRYRGVHIVEAFVVNKRTNQIVGQSEAFRVMIE

SEQ ID NO: 2096 - protein, 481 aa, Caulobacterales bacterium
MKLVQHFTDFLTDVVNLNATRIDQLEDSVTALKTFVRDSSWEPRVRSFAGQGSWAHKTIIKPVEKKPFDADLLVYIDPKADWTAAQYVNTLYDVFAANGTYKDKVKAWSHCVTVTYAGERKIDIAPCLVDRDGVARLEVCNRDLDAFERSEPRLYTDWLIERNGWTGGNGLRKVTRLLKYLRDIKGNFTCPSVLLTTLLGLRITEADNTNTTDFADVPTALKTIVGRLDDWLQANTTRPTVLNPKLASETLSNAWDDVRYANFRSKIHTYRTWIDDAYDEADRDESIGKWRRVFGDDFAKSVTIERAAAVSTEAVVLAKSAGFAPQTFLGDLVNLFAQFGSRALPPGFDRLAHKQRPAWRVLQPPAFGVKVVATLHTQRTGGAWIDMVVPLPKHHWLKFDVRTPVGTPISADYEVYWRVTNTDRAAKDAGCLRGEILKSNDGSSHWEQLEFRGVHTVEAFIVRPRDQVLIAQSAPFYVVIG

SEQ ID NO: 2097 - protein, 491 aa, Loktanella salsilacus
MKNNRLFNDFLKNTVNLNQSRLDRLDASSGAVETFLRGSSWEPNITLWYPQGSWAHKTITKPVSGAPFDADVIAFVQPVSGWEPRDYIDKLFETFRLSDLYKDKVKRWSHCVTINYAGERKMDVAPCVVTNIEVNGSNLHQFHVCNRDANHFETSSPIDYTNWLTQKNAVCGSNSFRKVTRLLKYLRDIKKTFSCSSVCLTTLLAGLVSDFDKDHEDFSDTPTALRTMMQRLDGYLSQHYFKPRVPNPFTDEDFSDCWTEAQYHNFKNFVNKYRIWIEDAYSEKDRNKGIKKWRKVFGSEFGKGENLDQARSFGKRVASIFAPRQPDLAKLVASDSYDIIDFASVVEIDNLPSDFLNLSYVEDPIWANSTGRGLETFITATVHRQRGEGDGATVSSGRIVKKGQEMKFRLNLKTGTFFDWKDYQIFWRVTNTGDEAANAEQLRGDIIREYRSADRWESLSYRGLHFVEAFVVRERDSALVSRSAPFLVAIK

SEQ ID NO: 2098 - protein, 480 aa, Ralstonia syzygii
MKLLEHFKTFLEDHVNLNQTRIDQLSDSVEAVKAAIRESEWGPEIIQFATQGSWAHGTIIKPLPDKEFDADLLVFVKTVAGWEAKDYINKLHAALEKNATYKDKLRRYSHCVTIEYSGERRIDIAPVVRGRVSADQDEVCNRNSNEFESSAPTAYTDWVIKKNAIVGGNDLKKVARLLKYMRDIKGNFTCPSFLFTTLLGYQINDCDKNSAEFVDTPTTLKTLFGRLDDWLQVRPNLPEVRNPALTSEVQSSVWDETQYSNFRDKINLYRGWVDEAFDEPDLDESIGKWRRVFGEDFASNEAKEASRVSEKVLAKSAGAVALANQFMDLVDLVKRNGIQAIPADLLRRLPHIERPKWRPAKNGVAVKVSAQLVNGMFNRPVASGEPLQTGHSIRFTASSTTGASFPTNDFSIKWRVTNTDRAAYNANQLRGNFYDSDSGSPMSRRESLSYRGVHFVEAFLIRKADKSLAGQSAPFYVVIE

SEQ ID NO: 2099 - protein, 480 aa, Ralstonia solanacearum
MKLLEHFKTFLEDHVNLNQTRIDQLSDSVEAVKAAIRESEWGPEIIQFATQGSWAHGTIIKPLPDKEFDADLLVFVKTVAGWEAKDYINKLHAALEKNATYKDKLRRYSHCITIEYSGERRIDIAPVVRGRVSADQDEVCNRNSNEFESSAPTAYTDWVIKKNAIVGGNDLKKVARLLKYMRDIKGNFTCPSFLFTTLLGYQINDCDKNSAEFVDTPTTLKTLFWRLDDWLQVRQNLPEVRNPALTSEVQSSVWDETQYSNFRDKINLYRGWVDEAFDEPDLDESIGKWRRVFGEDFASNEAKEASRVSEKVLAKSAGAVALANQFMDLVDLVKRNGIQAIPADLLRRLPHIERPKWRPAKNGVAVKVSAQLVNGMFNRPVASGEPLQTGHSIRFTASSTTGASFPTNDFSIKWRVTNTDRAAYNANQLRGNFYDSDSGSPMSRRESLSYRGVHFVEAFLIRKADKSLAGQSAPFYVVIE

SEQ ID NO: 2100 - protein, 492 aa, Burkholderia pseudomallei
MARAKKERQGGSKSVKLVDHFNTFLDDEVNLNQTRVDLLTDSVEAVRTAIKASGWRPKILSFTAHGSWAHGTIIKPLPGDEFDADLLVIVEPVADWEAKDYVNKLGSVFDGHSTYKDKVRRYSHCITIEYAGDRRIDIAPCVKGRLRPDTYEVCNRISNTFEASSPLAYTNWVMGRNAVAGGNDLKKVTRLLKYLRDIKTNFTCPSFLFTTLVGSHIFDADKGSAAFADTPTCLKTVVDRLDDWLQQHYYVPVIRNPALPSEIQSRVWDQTQFSNFRDKINLYRGWIDDAYNEADRDESIGKWQRVFGDSFASGEAKESARISESVGVKRAAVALAGQFRDLVDLVKQTGRAALPARMTSLPYVQRPRWRTATQQQTVKISAELLTSMNGAYIQRVASLDPLRPGRAIRFTALNNVGVPFPSNYKVEWRIANTDKAAYDANSLRGGFYRSDAGFSRTESLVYRGVHFVEAFLIGKTDNRLYGKSEPFYVVIE

SEQ ID NO: 2101 - protein, 478 aa, Burkholderia pseudomallei
MKLVDHFNTFLDDEVNLNQTRVDLLTDSVEAVRTAIKASGWRPKILSFTAHGSWAHGTIIKPLPGDEFDADLLVIVEPVADWEAKDYVNKLGSVFDGHSTYKDKVRRYSHCITIEYAGDRRIDIAPCVKGRLRPDTYEVCNRISNTFEASSPLAYTNWVMGRNAVAGGNDLKKVTRLLKYLRDIKTNFTCPSFLFTTLVGSHIFDADKGSAAFADTPTCLKTVVDRLDDWLQQHYYVPVIRNPALPSEIQSRVWDQTQFSNFRDKINLYRGWIDDAYNEADRDESIGKWQRVFGDSFASGEAKESARISESVGVKRAAVALAGQFRDLVDLVKQTGRAALPARMTSLPYVQRPRWRTATQQQTVKISAELLTSMNGAYIQRVASLDPLRPGRAIRFTALNNVGVPFPSNYKVEWRIANTDKAAYDANSLRGGFYRSDAGFSRTESLVYRGVHFVEAFLIGKTDNRLYGKSEPFYVVIE

SEQ ID NO: 2102 - protein, 478 aa, Burkholderia catarinensis
MKLVDHFNTFLDDEVNLNQTRVGQLTDSVEAVKAAIKASGWRPKILSFTAHGSWAHGTIIKPLPGDEFDADLLVIVEPVADWEAKDYVNKLGSVFDGHSTYKDKVRRYSHCITIEYAGDRRIDIAPCVKGRLRPDTYEVCNRISNTFQASSPLVYTNWVMGRNAVAGGNDLKKVTRLLKYLRDIKTNFTCPSFLFTTLVGSHIFDADKGSAAFADTPTCLKTVVGRLDDWLQQHYYVPVIRNPALPSEIQSRVWDQTQFSNFRDKINLYRGWIDDAYNEADRDESIGKWQRVFGDSFASGEAKESARVSESVGVKSAAVALAGQFRDLVDLVKQTGRAALPARMTSLPYVQRPRWRTATQQQTVKISAELLTSMNGAYIQRVASLDPLQPGRAIRFTAINNVGAPFPSNYKVEWRVANTDKAAYDANSLRGGFYRSDAGFSRTESLLYRGVHFVEAFLIGKTDNRLYGKSEPFYVVIE

SEQ ID NO: 2103 - protein, 478 aa, Burkholderia ubonensis
MKLVDHFKTFLDEEVNLNQTRVDLLTDSVEAVKTAIKGSNWGPKILSFAAHGSWAHGTIIKPLSGDEFDADLLIIVEPLAGWEAKDYVNKLGSFFDGHSTYKDKVRRYSHCVTIEYAGDRRIDIAPCVKGRLGLDRYEVCNRISNAFEASSPLAYTNWVMGRNAVAGGNDLRKVMRLLKYLRDIKTNFTCPSFLFTTLVGSHIFDADKGSAAFADTPTCLKTVVGRLDDWLQQHHSVPVICNPVLPSEIQSRVWDQTQYSNFRDKINLYRGWIDDAYNEADRDESIGKWQRVFGDEFASGEAKESARVSESLIVKSAAVALAGQLRDLVDLIKQKGRVALPTRMTSLPYVRRPKWRAATQQHTVRVAAELLTSMNGTRLRQVVSLEPLQPGRAIRFTAMNNVGVPFPSNYKVEWRVTNTDKAAYNANSLRGDFYRSDAGFSRTEGLTYRGVHFVEAFLVGKSDGRLYGKSEPFYVVIE

SEQ ID NO: 2104 - protein, 477 aa, Unknown
  Description of Unknown: Xanthomonas sequence
MKLVDQFKIFLNGEVNLNDTRVSQLGSSVEAVKNAIKASNWEPKILNFKAHGSWAHGTIIKPQTGGVFDADLLVIVEPVEGWEAKDYVNKLGALFDVHSTYKEKVHRCSHCVTIEYAGERRIDIAPCVNGRLWSNAYEVCNRTTNEFETTAALSYTDWVVDRNGVAGGNDLKKVTRLLKYLRDIKTNFTCPPFLFTTLVGMHIYDSDKDTAVFADTPTCLKTLMGRLDDYLQAYPSVPVIRNPVLPSDIQSRVWDQTKYSNFRDKINLYRTWIDEAFAEEDRDESIGKWQRVFGDSFAAGEAKEAARLSESVSKSEALVVAGQFKDLVQRVIERGRVALPERITRLPYIRRPEWRTASQSYCVNVSAELLTEQKGVRLGGVASLQPLQRGRSIRFTASNAVGVPFDSSFKVVWRVTNTDQAAYEANSLRGNFYPSESGFSREEDLAYRGVHFVEAFLIGKSSNRLYGKSDPFYVVIE

SEQ ID NO: 2105 - protein, 477 aa, Xanthomonas axonopodis
MKLVDQFKIFLNGEVNLNDTRVSQLGSSVEAVKNAIKASNWEPKILNFKAHGSWAHGTIIKPQTGGVFDADLLVIVEPVEGWEAKDYVNKLGALFDVHSTYKDKVHRYSHCVTIEYAGERRIDIAPCVKGRFWSDAYEVCNRTTNEFETTAALSYTDWVVGRSGVAGGNDLKKVTRLLKYLRDIKTNFTCPSFLFTTLVGMHIYDSDKDTAVFADTPTCLKTLMGRLDDYLQAYPSVPVIRNPVLPSDIQSRVWDQTKYANFRDKINLYRTWIDEAFAEEDRDESIGKWQRVFGDSFAAGEAKEAARLSESVSKSEALVVSGQFNDLVQRVIERGRVALPERITRLPYIRRPKWRTASQSYRVNVSAELLTEQKGVRLGGIASLQPLQRGRSIRFTASNAVGIPFDSSFKVVWRVTNTDQAAYEAHSLRGDFYPSESGFSREEDLAYRGVHFVEAFLIGKSSNRLYGKSDPFYVVIE

SEQ ID NO: 2106 - protein, 477 aa, Xanthomonas campestris
MKLVDQFKTFLSGEVNLNDTRVSQLGSSVEAVKNAIKASNWEPKILNFKAHGSWAHGTIIKPQTGGVFDADLLVIIEPVEGWEAKDYVNKLGALFDVHSTYKDKVHRSSHCVTIEYVGERRIDIAPCVNGRLWSNAYEVCNRSTNEFETTAALDYTDWVVGRNGVAGGNDLKKVTRLLKYLRDIKTNFTCPSFLFTTLVGMHIYDLDKDTAFFADTPTCLKTLMGRLDDYLQAYPSVPIIRNPVLPSDIQSCVWDQTKYANFRDKINLYRTWIDEAFAEEDRDESIGKWQRVFGDSFAAGEAKEAARLSESVSKGEALVVAGQFKDLVQRVIERGRVALPERITRLPYIRRPKWRTASQSYRVNVSAELLTEQKGVRLGGVASLQTLQRGRSIRFTASNAAGVPFDSSFKVVWRVTNTDQAAYEANSLRGNFYPSESGFSREEDLAYRGVHFVEAFLIGKSSNRLYGKSDPFYVVIE

SEQ ID NO: 2107 - protein, 490 aa, Pseudomonas sp.
MKLVDQFKTFLSSEVNLNDTRVSQLGASVEAVQKAIKAANWGPKILDFAAHGSWAHGTIIKPCTGGEFDADLLVIVDPVEGWEAKDYVNKLGAFFDGHSTYKDKVHRYSHCVTIEYAGERRIDIAPCVKGRLWSNTYEVCNRTSNEFETTAALEYTAWVVGRNGVAGGNDLKKVTRLLKYLRDIKTNFTCPSFLFTTLVGMHIYDSDRSTSAFADTPTCLKTLMGRLDDYLQTRPNVPVIRNPVLWSDIQSRVWDQTKYGNFREKINLYRTWIDEAFGEADRDESIGKWQRVFGDRFAAHEAKESARLSESMSKSGVLVLASESMSGNEALVSASPFKDLVERVIELGRAALPERITRLPYVQRPKWRPASQSYHVKVSAELLTEKKGRRLCSVTTLQPLPKGNSIRFTASSSVGLPFPSSFKVRWRVTNTDQAAYYANSLRGDFYPSDSGFSREEDLAYRGVHFVEAFLIGKSDNRLYGKSEPFYVVIE

SEQ ID NO: 2108 - protein, 490 aa, Pseudomonas syringae
MKLIDQFKTFLSSEVNLNDTRMSQLGASVEAVQKAIKTSSWGPKILDFDAHGSWSHGTIIKPRTGGEFDADLLVIVEPVEGWEAKDYVNKLGAIFDGHSTYKDKVHRYSHCVTIEYVGERRIDIAPCLKGRLRSDTYEVCNRTTNEFETTAALEYTDWVVGRNGLAGGNDLKKVTRLIKYLRDIKTNFTCPSFLFTTLVGMHIYDSDKDTVAFADTPTCLKTLMGRLDDYLQAHPTVPVIRNPVLWSDIQSRVWDQTKYGNFREKINLYRTWIDEAFGEADRDESIGKWQRVFGDSFAASEAKESARLSESISRSDALVLASESMSGNESLVSASRFKDLVQRVIELGRAALPERITRLPYVQRPKWRAASRSYHVKVSAELLTEQKGRRLGSVTTLQPLSKGNSIRFTASNSVGLPFTSSLKVQWRVTNTDLAAYDANSLRGDFYSSDSGFSREEDLAYRGVHFVEAFLIGKSDNRLYGKSEPFYVVIE

SEQ ID NO: 2109 - protein, 490 aa, Pseudomonas syringae
MKLIDQFKTFLSSEVNLNDTRVNQLGASVEAVQKAIKTSSWGPKILDFDAHGSWAHGTIIRPPTGGEFDADLLVIVEPVEGWEAKDYVNKLGAVFDGHSTYMDKVHRYSHCVTIEYVGERRIDIAPCVKGRQWPNAYEVCNRTTNEFETTAALEYTDWVVGRNGVAGGNDLKKVTRLLKYLRDVKTNFTCPSFLFTTLVGMHIYDSDKGTAAFADTPTCLKTLMGRLDDYLQTQPTVPVIRNPVLWSDIQSRVWDQTKYGNFREKINLYRTWIDDAFGEADRDESIGKWQRVFGDSFAASEAKESARLSESVSRSDALVLASESMSGSEALVSASRFKDLVQRVIELGRAALPERITRLPYVQRPKWRKASQSYHVKVSAELLAEQRGRRLGSVATLQPLPKGNSIRFTASNSVGVPFDSSFKVQWRVTNTDMAAYDANSLRGDFYPSDSGFSREEDLAYRGVHFVEAFLIGKSDNRLYGKSEPFYVVIE

SEQ ID NO: 2110 - protein, 490 aa, Pseudomonas sp.
MKLIDQFKTFLSSEVNLNDTRVSQLGASVEAVQKAIKTSSWGPKILDFDAHGSWAHGTIIKPRTGGEFDADLLVIVEPVEGWEAKDYVNKLGAVFDGHSTYKDKVHRYSHCVTIEYVGERRIDIAPCVKGRQWPNAYEVCNRTTNEFETTAALEYTDWVVGRNGVAGGNDLKKVTRLLKYLRDIKTNFTCPSFLFTTLVGMHIYDSDKDTAAFADTPTCLKTLMGRLDDYLQARPTVPVIRNPVLWSDIQSRVWDQTKYGNFREKINLYRTWIDEAFGEADRDESIGKWQRVFGDSFAASEAKESARLSESVSRSDALVLASESMSGSEALVSASRGKDLVQRVIELGSAALPERITRLPYVQRPKWRNASQSYHVKVSAELLAEQRGRRLGSVATLQPLPKGNSIRFTASNSIGVPFPSSFKVQWRVTNTDLAAYDANSLRGDFYPSDSGFSREEDLAYRGVHFVEAFLIGKSDNRLYGKSEPFYVVIE

SEQ ID NO: 2111 - protein, 477 aa, Pseudomonas sp.
MKLIDQFKTFLSSEVNLNDTRVSQLDASVEAVQKAIKTSNWGPKILDFDAHGSWAHGTIIKPRTGGEFDADLLVIVEPVEGWEAKDYVNKLGAVFDGHSTYKDKVHRYSHCVTIEYVGERRIDIAPCIKGRQWPNAYEVCNRTTNEFETTAALEYTDWVVGRNGVVGGNDLKKVTRLLKYLRDIKTNFTCPSFLFTTLVGMHIYDSDKDTAAFADTPTCLKTLMSRLDDYLQARPTVPVIRNPVLWSDIQSRVWDQTKYGNFREKINLYRTWIDEAFGETDRDESIGKWQRVFGDSFAASEAKESARLSESVSRSDALVLASQFKDLVQRVIERGRAALPERITRLPYVQRPKWRNASQSYHVKVSAELLAEQRGRCLGSVATLQPLPKGNSIRFTASNSIGVPFPSSFKVQWRVTNTDLAAYDANSLRGDFYPSDSGFSREEDLAYRGVHFVEAFLIGKSDNRLYGKSEPFYVVIE

SEQ ID NO: 2112 - protein, 490 aa, Pseudomonas aeruginosa
MKLVDQFKTFLSSEVNLNDTRMSQLGSSVEAVQKAIKTSSWGPKILDFDAHGSWAHGTIIKPRTGGEFDADLLVIVEPVEGWEAKDYINKLGAVFDGHSTYKDKVHRYSHCVTIEYAGERRIDIAPCVKGRQWPNTYEVCNRTTNEFETTAALEYTDWVVGRNGVAGGNDLKKVTRLLKYLRDIKTNFTCPSFLFTTLVGMHIYDSDKGTAAFADTPTCLKTLMGRLDDYLQARPTVPVIRNPVLWSDIQSRVWDQTKYGNFREKINLYRTWIDEAFGEADRDESIGKWQRVFGDSFAASEAKESARLSESVSRSDALVLASESMSGSEALVSASRCKDLVQRVIELGRAALPERITRLPYVQRPKWRNASQSYHVKVSAELLAEQRGRRLGSVATLQPLPKGKSIRFTASNSIGVPFPSSFKVQWRVTNTDLAAYDANSLRGDFYPSDSGFSREEDLAYRGVHFVEAFLIGKSDNRLYGKSEPFYVVIE

SEQ ID NO: 2113 - protein, 477 aa, Dechloromonas denitrificans
MKLVNQFKTFLSEEVNLNDTRVSQLGTSVEAVQKALKASSWGPKILDFDAHGSWAHGTIIKPFTGGEFDADLLVIVEPVEGWEAKDYINKLGAFFEGHSTYKDKVHRYSHCVTIEYAGERRIDIAPCVKDRLWSNMYEVCNRITNEFETTAALDYTDWVVGRNGVAGGNDLKNVTRLLKYLRDIKTNFTCPSFLFTTLVGMHIYDSDKDSAAFADTPTCLKTVMGRLDDYLQARPALPVIRNPVLSSDIQSRVWDQTQYGNFRNKINLYRTWIDEAFAEEDRDESIGKWQRVFGDSFAAGEAKESARLSESVSKSDALVVAGKFKDLVQRVIERGRAALPNRITRLPYIRRPKWRTASQSYRVKVSAELLAGSNGMRLGAVTTLQPLPKGRSIRFSASNAVGVPFDSSFKVQWRVTNTDQAAYDANSLRGDFYASDSGFSREEDLAYRGVHFVEAFLIGKSDNRLYGQSEPFYVVIE

SEQ ID NO: 2114 - protein, 477 aa, Janthinobacterium sp.
MKLVDQFNTFLRGEVNLNDTRVSQLGTSIEAVQIAIKASNWGPKILDFDSHGSWAHGTIIKPLAGGEFDADLLVIVEPVEGWDAKDYINELGAFFDAHSTYKDKVHRYSHCVTIEYVGERRIDIAPCVKGRWWSNTYEVCNRITNEFETTAALDYTDWVVDRNGVVGGNDLKKVTRLLKYLRDIKTNFTCPSFLFTTLVGMHIYDSDKDSVAFADTPTCLKTVMGRLDDYLRARPTLPIIRNPVLSSDIQSRVWDQTQYGNFRNKINLYRTWIDEAFAEEDRDESIGKWQRIFGDSFAAGEAKESARLSESVSKSDALVVAGQFKDLVQRVIESGRAALPDRITRLPYIRRPKWRSASQSYRVNVSAELLTEQKGTRLGGVTSLQPLSKGHSIRFMASNAVGVPFDSSFKVLWRVTNTDQAAYEANTLRGDFYPSDLGFSREEDLAYRGVHLVEAFLIGKSDNRQYGKSDPFYVVVK

SEQ ID NO: 2115 - protein, 478 aa, Massilia timonae
MKLLEHFRTFLNDDVNLNTSRIDLLESSIEAVQKAVTASDWGPEIIKFAPHGSWAHQTIIKPMAGKEFDADLVVFVKPKSGWTAKDYVNKLASALRANGTYSDKLCCYSHCVTIEYAGERRIDIAPCVVDREYYGRYEVCNKTTDTFEASAPLAYTDWVVTKNGIAGGNDLKKVTRLLKYLRDIKGNFTCPSFLFTTLLGNRVQENDRDTAAFSDLPTTLKTLVGRLDDWLQMNPYVPYLSNPVLPTENQSRVWDQMQYSNFRDKINLYRGWIDDAYNEQDRDESIGKWQRVFGDKFAAGEAKESSRISESVARSDGAIVVAGHFRDLVEKVKSIGEKALPARILRLPYIERPKWRPASTMATVKIQAELYGGRYSTGIRQVRSLEPLQANYWIKFAAVNNVGVPFSSDYSVEWRITNTDKAAYDAQQLRGDFYPSEQGYTRMEQLAYRGVHLVEAFLVKKSNKRLAGQSQPFYVVVE

SEQ ID NO: 2116 - protein, 477 aa, Cupriavidus sp.
MKLHDLFRTFLEDHVNLNDTRLNLLEGSIVAVQNAVRALAWGPKIVSFAPQGSWAHETIIKPQAGQPFDADLLVFVEAKEGWTPKDYVNGLATELGKLPAYEGKVRRFSHCATIEYAGERKIDIAPCVMNRLYAGQYEVCNRGTDQFELSAPLEYTDWVKGQNGTAGGNDLKKVTRLLKYMRDIKGNFTCPSFLLTTLMGMQVYDSDRGSAQFADLTTTLKTLVGRLDNWLQARPNVPIVPNPKLPREDQASGWGQVQYSNFRDKVNLYRGWIDDAYAEEDRDESIGKWQRVFGEYFGAGEAKRAAEAVSESAADGASVVGGHFRDLVEKVKALGAAAVPMTLRRLPHVRRPVWRKGADQYTVKVTAELQTAKHGNVLRLIRSADPLQAGNWVRFTAANTMGIPFSDDYKVEWRVTNTDKVAARAGVLRGDFYPSDDRSSRAEQLSYRGVHFVEAFLVRKRDNRLVGQSEPFYVVIE

SEQ ID NO: 2117 - protein, 477 aa, Cupriavidus sp.
MKLHDLFKTFLEDHVNLNDTRLNLLEGSIVAVQNAVRALAWGPKIVSFAPQGSWAHETIIKPQAGQPFDADLLVFVEAKEGWTPKDYVNGLATELGKLPAYEGKVRRFSHCATIEYAGERKIDIAPCVMNRLYAGQYEVCNRGTDQFELSAPLEYTDWVKGQNGTAGGNDLKKVTRLLKYMRDIKGNFTCPSFLLTTLMGMQVYDSDRGSAQFADLTTTLKTLVGRLDNWLQARPNVPIVPNPKLPREDQASGWGQVQYSNFRDKVNLYRGWIDDAYAEEDRDESIGKWQRVFGENFGAGEAKRAAEAVSESAADGAIVVGGHFRDLVEKVKALGAAAVPMTLRRLPHVRRPVWRKGADQYTVKVTAELQTAKHGNVLRLIRSADPLQAGNWVRFTAANTIGIPFSDDYKVEWRVTNTDKVAARAGVLRGDFYPSDDRSSRAEQLSYRGVHFVEAFLVRKRDNRLVGQSEPFYVVIE

SEQ ID NO: 2118 - protein, 477 aa, Giesbergeria anulus
MKLHEHFKAFLNDHVNLNATRLRLLQDSIVAVENAVRALGWGPKIISFAPQGSWAHETIIKPQSGQPFDADLLVFVEAKEGWMPKDYVNELATKLGRLPAYEEKVRRFSHCATIEYAGERKIDVAPCVVNRLYAGQYEVCNRVTNQFEASAPEAYTKWVKDKNGVAGGDDLKKVTRLLKYMRDIKGNFTCPSFLLTTLMGLQVYESDRGSAQFADLSTTLKTLVGRLDDWLQARQSVPTVPNPKLPQEDQAGGWDQTQYSNFRDKVNLYRGWIDDAFAEQDRDESIGKWQRVFGENFAAGEAKQAAERVGEDSSSGALVVSGHFRDLVELVKTLGAAAVPAKLRQLPHVRRPTWRKAADQHTVLVSAVLRTGQYGTTIRAIKSAEALQPNYWVRFTATGKHGVPFTDDYKVQWRVTNTDKVASKAGALRGEFYPSDEGTSRSERLEYRGVHFVEAFLIRKRDNRLVGQSEPFYVVIE

SEQ ID NO: 2119 - protein, 481 aa, Giesbergeria anulus
MKLHSHFKTFLEDYVNLNDTRLRLLTDSVEAVKTAVKRLTWEPEITDFAELGSWAHETIIKPQPDKPFDADLLVLVKAVPDWTAKDYVNKLATALNALPAYKDKVRRFSHCATIEYAGERKIDIVPCIVDRLYPGAYEVCNRGTDAFENSEPIAYTDWVKSRNGVAGGNDLKKATRLLKYLRDIKGNFTCPSFLLTTLLGYRIYDADRNSAQFADLPTTLKTLVGRLDDWLQARPNVPEVPNPVLYGEDQASGWDQTKYANFRDKVNLYREWIDDAYDEDDKEESIGKWRRVFGDGFAEGETKRAAGQISETVTHSNGTSLVTEHDFTDLVSMVKVYGTRAVPTRIHRLPHIERPKWRRASEQLTVRLTAELKTANYGQLMRSIRSAEPLQPGYTVKFCARDIHGVPYQTDDYSIKWRVTNTDKAAVAANQLRGEFYPSDEGAIRSESLSYRGVHFVEAFVVRKRDQRLMGHSEPFYIVIE

SEQ ID NO: 2120 - protein, 480 aa, Janthinobacterium sp.
MKLHNHFKTFLDDFVNLNRTRLTLLENSVDAVKIAVRELEWGPKVTGFAIQGSWAHQTIIKPQKGKPFDADILVFVEPVQDWAAKDYVNTLATALANHPLYKDKIRRFSHCATIEYVGDRKIDIAPCVVGRQYAGRYEVCNRITDDFEHSEPIGYTEWVNNRNGIAGGNDLKKVTRLIKYLRDIKKNFAVPSFILTTLLGDRIYDSDRYVNTFPDLTTTLKVLFGRLDDWLQAHPQVPQISNPVLLSEDQAENWNSTKYANFREKVNLYRGWIDDAYEEEDLEESIAKWRRVFGENFAASAVRQAAEKVSESVAASGTALEHYGRVKDLVTMVKEQGVRAIPQSLIKLPHVNRSKWRHAQEMVTVRVIGALCSEEHGPKLRTLESGEVLKPGSWINFDAVNHLGIQFSTDMYKVRWRVTNTDKVAADANALRGEFYLPEIGTSRREKTEYRGVHFVEAFLVRRRDSKLAGKSIPFYVVIE

SEQ ID NO: 2121 - protein, 479 aa, Aureimonas jatrophae
MSLQLSDEFARFLADDVNLNKTRIGTLETRVETIERFIESSTWTPKIREFSRQGSWAHKTIIKPPGNRGFDADLLVMVEPEPGWSAADYVEKLYEPFRASGTYREMVSRKTRCVVVTYAGDFSLDVVPCVVGRQTYFGKEICNRYEDAYEGTDGKGYAEWWDGRCRYASDDSLREAVRLLKYLRDIKGTFSAKSVLLTTMVGERVNAFDSVLGTLPDAVTTLKVVVGRLDDHLKQNPTMPDVRNPAWPEESFTRHWDADKYANFRAKIATYRSWIDDAFDEPDRNESIRKWRRVFGEAFAAQTLMEEARAIRGTMATRAAVPVVGDAVALVRAAGREVLSRIPATLPWVKKIPWHMAPTLTVNVRADVYNARVGGRRLGPLQSGEIVSKGRELLLSAVNNLGNPFPTDYDVRWRVVNTDEEAARQVSNLRGGFYKSEAGHGQRWEATLYRGPHWVEALLIRRRDKVCVGRSERFFVVVE

SEQ ID NO: 2122 - protein, 449 aa, Aureimonas jatrophae
METIERFIESSTWTPKIREFSRQGSWAHKTIIKPPGNRGFDADLLVMVEPEPGWSAADYVEKLYEPFRASGTYREMVSRKTRCVVVTYAGDFSLDVVPCVVGRQTYFGKEICNRYEDAYEGTDGKGYAEWWDGRCRYASDDSLREAVRLLKYLRDIKGTFSAKSVLLTTMVGERVNAFDSVLGTLPDAVTTLKVVVGRLDDHLKQNPTMPDVRNPAWPEESFTRHWDADKYANFRAKIATYRSWIDDAFDEPDRNESIRKWRRVFGEAFAAQTLMEEARAIRGTMATRAAVPVVGDAVALVRAAGREVLSRIPATLPWVKKIPWHMAPTLTVNVRADVYNARVGGRRLGPLQSGEIVSKGRELLLSAVNNLGNPFPTDYDVRWRVVNTDEEAARQVSNLRGGFYKSEAGHGQRWEATLYRGPHWVEALLIRRRDKVCVGRSERFFVVVE

SEQ ID NO: 2123 - protein, 475 aa, Methylobacterium zatmanii
MRLSQQFEDFLRDEVNLNQTRIDLLEARVGTLKGFVEAAAWGPEILEFAAQGSWAHETIIKPSKGREFDADLLVFVDPVASWSAADYVRTLRGAFAGSGIYGDMLLPANRCVTVNYAGDFHLDVVPCVIGRPGGSGAEVCNKDDDVFEPTDGHGYAEWWEGRNAWAHHRLKHVVRLLKFLRDRKATFSVKSVLLTTLVGERITSLDAYGTDFDDVPTALRTVIGRLDDYLQANPAMPTIRNPVLWSETFDRHWDQDKYDNFRSCMNRYRRWIDDAYAEPDRTESVRKWHRVLGEDFAPEIVLEEARGVRDAVVAKAGLPNAVRDVVAAIQQFGTAVLAHVPWKLAHVEPSRWRTGGSIDVRVKCYLCSARNGQLVRQLGSGEILGRGRDLLFEAVSPMGTPFGARDFDIHWQVVNTDEAAGYAKALRGGFYKSDDAGRRWERTEYRGAHWVEAFVIRKRDKVCVGRSGRFFVVIE

SEQ ID NO: 2124 - protein, 477 aa, Acaryochloris sp.
MKLSEHFDSFIDDIVNLNQTRIDRLEGHVNAIQDFLINSGYDAKIIRFSAQGSWAHGTIIKPLSGREFDADLVMFIDRFEAWSPRDYVNNLYYIFKSSDRYKDKISRGTRCVALDYAGDFHLDIVPCITDNNAVATFQVCNRTVDKFEPTAPEAYSSWLLERNTWTGNNMLQHSIRLLKYLRDIKTTFSVKSILLTTLVGNCVNQFDQSFQKQIFPDLPTSLKVLVGRLDDYLQVRSSMPIVTNPVLPSETFNRHWNQEKYENFRECIHRYREWIDDAYEEDDRAESIRKWRKIFGNEFAKREVNDIAAFSESTSLVRDTGCTDIVHAVLVRGANFLEKLISPSLPHVEKLSWPFQQRLTVAISATEYLDQYGNQRVRILQSGEVVEKDRWIRFEARNSNGILHASSDFVVKWQVVNTDNEAVQANQLRGGFEKSNKPGVRWESTSYHGAHWVEAFVISRRTRSCWGRSGRFFVVVK

SEQ ID NO: 2125 - protein, 302 aa, Moorea producens
MKLVEHFETFLKDVVNLNQTRIDRLEEHVKAIQDFLENSDYRADIVRFSPQGSWAHKTIIKPCSSKEFDADLVMFVDRLEGWSCKDYVNNLYYIFSNSDRYKKKVSRGTRCVALDYAGDFHLDVVPCVLNGYDGMTFNVCNRKNNAFEATAPEAYSDWLSERNTWTGNNMLRYSIRLLKYLRDIKTTFSVKSILLTTLVGSCVKASDQSCQQQFFSDIPTSLKTLTGRLDDYLQANPSMPVVKNPVLAKETFNRHWNQEKYENFRKCIYRYRNWIDDAYDEKNRNESIRKWRILFGDEFAKY

SEQ ID NO: 2126 - protein, 480 aa, Bradyrhizobium sp.
MKHLGEFKTFLEGQVNLNKTRIETLTDRVETIENFLWRTDLSRIIKRFSSQGSWAHKTIIKPPGENGFDADLLMFVDPVPGWTTNDYILKLRSLFLESKTYKDMVGLKNRCVTLNYAGDFELDVVPCVVERPGHTHRYEVCNRTEDRFEPTDSERYTEWFQHANNLAGGDHLVHVMRLIKYLRDTKTTFSCKSVLLNTLVANQISQADINYRPSYFPDLPTAFRTLISRLDHYLQGRADLHKIPNPILPIEDFNRHWDHDKYANFREMIHKYRQWTDEAYSETDEKQSIKKWRWIFGDEFAKGADALTEEVTRSLVPIPNFNVQRFRDTVQAVKLVGLSVLGLVRRDLPWVQRPPFVLANQTIPISIKVTVHLHENGPPAGTVASGQVLPADHHIRFEAVGGTGVPFASKDHDVQWQVVNTDRYAGYAKALRGGFYPSKPRSVRWERTEYRGIHWVEAFLIRKRTGACVGRSDRFFVVIE

SEQ ID NO: 2127 - protein, 441 aa, Pseudoalteromonas piratica
MKLVKHFNEFLKNEVNLNQHRIDTLEYRVQVVTNFIKGSDSFKSAFIEAIPQGSYAHRTIIKPTAKKKVFDADVVVYLKPIDGWEAKDYIEQIYKTFNASKHYQGKVSRQTRCVKLNYAGEFHIDIVPCIRSKFLFTETERVCNRLTNEFESCSSIEFSKWVQKKNAVAGNNNLIKAIRLCKYLRDFKQTFSVKSILLTTLLASRITLSEELFGTDSFKDLPMSLKTLFNRLDEWLDEQDEMPIVNNPVDDDENFNRHWDEDKFQNFKKQVKKYNGWINTAYQEMDKEESIKGWRKVFGDKFAPESTAKAVEKQQSLPSHCERLRWPMATSPQKLNVKAVLQKDKSSVSIGDLAAYNTIPKHHWIRFNVKDTLDHQTSIFWQVVNTGSEAANDDCLRGKFFQGSTIHKESTLYRGTHWVEAVAVRQGVCIARSGPIVVKIA

SEQ ID NO: 2128 - protein, 270 aa, Pseudoalteromonas luteoviolacea
MKLTDHMETFLKSEVNLNQHRIDTLEKRVGIIIGFIQTSEVFRSSFAKAIPQGSYAQRTIIKPTPKKQEFDADLVVYLDSIWGWKPKDYIEQIYHLFNSSPTYQGKVSRHTRCVKLNYAGDFHIDIVPCVRKGIILKEGKICNKATNKYESCSSTEFTKWVNKKNYAVGNNNLLKAIRLSKYLRDYKQNFSVKSILLTTLLAERVTGWEYHWGTDKFKDLPTTLKILFNRLDSWLDKQKSMPNVSNPVAIDDEDFNRHWDERKFQNFKTQ

SEQ ID NO: 2129 - protein, 302 aa, Aureispira sp.
MKSIALFKKFMHANVNLNKTRINRLNRHVGAVQNFLDKSSFQIKGMYPQGSYAHHTIIKPAKKNKEFDVDVVIRVNEERGWEARDYIENLYTLFKANPVYRRKVGRKSRCITLDYTGEFHLDIVPLLRTDIFNGLFGKKYQILNRNTNEYERTDSFGYTNWLMEKNSIIPKNYFVMSIRLLKYLRDSKQNFSVKSILLNTMLGNLISENEDISIEFCDFPTSFKTIVNRLNEWLQAHSVMPIVMNPCLEMENFNRHWDEIKYQNFKRKVEFYAEWVNDAYSERNRKLSILKWQRIFGGNFGI

SEQ ID NO: 2130 - protein, 445 aa, Unknown
  Description of Unknown: Bathymodiolus platifrons methanotrophic gill symbiont sequence
MKLDHYLTNFLKDTVNLNQSRIDTLKQRVDTISEFVKQLDEFEDLFIETTPQGSWAHKTIIRPVGNDDFDADLVFFLNENEDWQPKDYIDTLYHCFMASNTYKDMVSRNTRCVTLDYAGDFHLDVIPCIRRDSVWDGETEWILNRQDNSEEQTNPDGYSEWFADKTRETDGYLIKVVRLFKYLRDHKKTFSAKSVLLTTLLGNRIHLFDNLSNNFSDTSTSLQTIFNRLNDYLQENPIMPTVQNPSMPSENFNRHWDQNKYDNFRNCIQRYREWIEDAIAEQDREECILKWRKVFGGDFAKSVIIESRSSGSTIIASEDTSHVIVPPWPIQRVGSLNINASLHSSKEGGFLGNYTSDGPRLKPDTWIHFSANHTFSQHIRIKWQVVNTGLVARLARSLRGDINQVGSDIWEHTEYKGTHWVECFAVDIKKGVCLGKSGRFYVNVS

SEQ ID NO: 2131 - protein, 482 aa, Sulfitobacter delicatus
MEHNSYFEDFLKDVVNIDQGRLNSLDTSITAIQNYILKSNFGAKVRFFRRQGSLAHGTIVRPLNGQEFDADVVMMVAENAEWEPKDYLLDLRRVLWANSTYRGKTRLSDVCVTLDYAGDKKIDLMPMIQVSDKDHKINICHHRHNHFIRSEPLEFTEWLVQRNKLSGGNSFRKMSRILKYIRNHKKSFTCPSVLLTALIGYRITDNDRGTDAFSSVPKTLVTILERLDRYLARHIDVPEVLNPSPSIDYEDLGELWTIDQFRNFKDKMHLYASWARDALLEEDHNASLAKWRKLLGNNFGAGKEKTEAARNVLAVKPEAIALANDAGHSDSLVEAVMRSGVRILNATFYRPPHLRPPTWTPSHETASCYVSATFHRSGRGSSGVNVDDGSALPRDGWLRFKCTTFQLQYDKTEYFVQWRVTNTGFVAKLKGQMRGEFYDQDGQFIKWEKLSYRGVHFVEAFVIRKYDNTLACKSAPYNVVIK

SEQ ID NO: 2132 - protein, 198 aa, Vibrio nigripulchritudo
MKHIKAFNHLLNDVVNLNQTRLNKLEVAVPAVTKAIKDSEQFGGIYRNYSSQGSYGHRTIIKPVAGREFDADVVIFVSKHDEWEPKEYISNIYQVFKKHPTYKDKVHYNTRCISLDYADDMHIDLVPCIVDDSLEWLLDTCTYSICNRSTNEYESTDPEAYKAWIADKNKTTGGNNLIKSIRLFKYLRDIKCTNSDLI

SEQ ID NO: 2133 - protein, 198 aa, Vibrio nigripulchritudo; identical to SEQ ID NO: 2132

SEQ ID NO: 2134 - protein, 454 aa, Vibrio splendidus
MKHIKAFNHLLNDVINLNQTRLNKLETAVPAVTNVIKDSEQFGSIYKKSSSQGSYGHRTIIKPVAGREFDADIVIFVNKHDEWEPKEYISNIYQVFKNHPTYKDKVHYNTRCISLDYADDMHIDLVPCIVDDSLAWLLDTCTYSICNRSTNKYESTDPEAYKAWIADKNRTAGGNNLIKSIRLFKYLRDIKCTFSCKSILLTTLLGNQVMDSYDLLSDEFKDVPTTFKTLINRLDHDLQKHAYMPNIENPVQSGEYFTRHWDETKFQNFKAFVSKYASWVNEAYNESDKKRSIEKWRKVFGEQFFSVNATQANKSESASLEALNERYVSIPAHYLPHPWKSCDSEVKLNVEVKYKQDFTQNFVNKLKFGSLIPKKHNLRFEIMNPVDDEFKIYWQVTNTGAEAEVNKQLRGGFELGEQVHEESTSYKGDHFVEAFVVHDNVLLARSDKMIISIS

SEQ ID NO: 2135 - protein, 454 aa, Unknown
  Description of Unknown: Vibrio sequence
MKHIKAFNHLLNDVVNLNQTRLSKLETAVPTVTKAIKDSSQYGSIYKKYSSQGSYGHRTIIKPVAGREFDADVVIFVDQHDEWGPKDYIHNIYQVFKNHPTYKDKVHYNTRCISLDYADDMHIDLVPCIVEETIGWLENFYTYSICNRSTNEYESTDPEAYKAWISGKNKTTGNNNLIKSIRLFKYLRDIKCTFSCKSILLTTLLGKQVMDSYDLFSEDFKDLPTSFRTLINRLDHDLQQHSCMPDIENPVQSGEYFTRHWNETKFQNFRVFVSKYTGWVNEAYEETDKNLSIEKWRKVFGDQFFSVKATQTKKSESVSLEALNERFVSIPSHYLPHPWKSDGSEIALDVEVKYKQDFSQHFVNKLKFGSLIPKKHNLRFEIINNIDEMCEIYWQVTNTGAEAAAKGQLRGGFELGKQVREESTSYKGDHFVEAFVVHDNVLLARSEKIIISIS

SEQ ID NO: 2136 - protein, 454 aa, Aliivibrio salmonicida
MKHIKAFHHLLTDVVNLNQTRLSKLETAVPTVIKVIKDSEQFGGIYQSSSPQGSYGHRTIIKPVAGREFDADVVVFVDRHDEWEPKDYINNIYQAFKDHPTYKNKVHYNTRCISLDYADDMHIDLVPCTVEESMGWLGNSYTYSICNRSTNKYEATDPDAYKAWIADKNKTTRNNNLIKSIRLFKYLRDIKCTFSCKSILLTTLLGSQVIDSYDLVSNDFKDLPTSFKTLINRLNHDLKTYSSMPEIENPVQSGEYFTRHWDETKFQNFKKFVSKYADWVNDAYDETDKDASIEKWRKVFGNQFFSVKTTQASKADSLSLEVLDERFVSIPSHYRPHPWKSNGSEVTLDVDVKYKQNFSQHFVNKLRFGSLIPKQHNLRFEIMSNVDDLHEIYWQVTNTGAEAAANNQLRGNFELGERVREESTSYKGDHFVEAFVVHENVLLARSEKIIISIS

SEQ ID NO: 2137 - protein, 454 aa, Vibrio splendidus
MKHQKIFTEFLTGVVNLNQARINKVTTTSVSVERYVKDHDDFKGIFRNASPQGSYGHRTIIKPVKHKEFDADIVFFMDENDNWEPKDYITKLHQAFKGSSVYKDMVHYNTRCVYLDYSGDFHIDVVPCIVRVTETIIGNHTQYLIANRHTNEFELTDPEAYKKWVANKNSVVGNNNLVKCIRLIKYLRDIKTTFSCKSILLTTLICNMVHDYESNSDDFKDIATTLKTIFTRLDDYLSFCDSMPEIVNPVRTEETFTRHWNEEKYTNFKTKIGDYRAWIEDAFDETDQTESIKKWRRVFGDSFHSVIKKSATTATYDEILGEASQHNFPIPPHCVPHRWKEVENVGSVNLDVEYRNKNSVNLFSRAVQQVVYGRNYSLKFTVTDDIPPSSDVYWQITNTGEEASRLGELRGGFEIGEKIKVETTSYKGNHFVEAFVVKNEVLLARSGKLVVPIS

SEQ ID NO: 2138 - protein, 454 aa, Enterovibrio nigricans
MKHQQIFSEFLTGVVNLNQARINKVTTTSASVEKYVKEHDDFEGIFRNASPQGSYGHRTIIKPVKNKEFDADIVFFMDENDNWEPKDYITKLHQAFKGSSIYKDMVHYNTRCVYLDYSGDFHIDVVPCIVRVTETVFGNHTQYFIANRHTNEFELTDPEAYKKWVADKNSVVGNNNLIKCIRLIKYLRDIKTTFSCKSILLTTLICNMVHDYESNSDEFKDIATTLKTIFTRLDDYLSFYDSMPEIVNPVRTEETFTRHWTEEKYKNFKTKIGDYRAWIEDAFDETDRTESIKKWRRVFGDNFHSVTKRSATAATYDEILDEASQPNFPIPPHCAHHRWEEVENVGSVNLEVEYRNKNSVNPFARAVQQIVFGKNYSLKFTVTDDIHPGSDVYWQITNTGEEANRLGQLRGGFEIGGKIKEETTSYKGNHFVEAFIVKDEVLLARSGKLVVPIN

SEQ ID NO: 2139 - protein, 454 aa, Vibrio vulnificus
MRHQKIFTEFLTGVVNLNQARINKVTTTSASVEKYVKDHDDFKGIFRNTSPQGSYGHRTIIKPVKNKEFDADIVFFMDENDNWEPKDYITKLHKAFKGSSIYKDMVHYNTRCVYLDYSGDFHIDVVPCIVRVTETVFGNHTQYLIANRHTNEFELTDPESYKKWVADKNSVVGNNNLIKCIRLIKYLRDIKTTFSCKSILLTTLICNMVQDYESNSDHFKDIATTLKTIFTRLDDYLSFYDSMPEIVNPVRTEETFTRHWNEEKYTIFKTKIGDYRTWIEDAFDETDRTESIKKWRRVFGDSFHSVTKKSATAATYDEILDEASQPNFPIPPHCAHHSWEEVGNVGSVNLDVEYRNKNSVNPFARAVQQIIFGKNYSLKFTVTDDIPPGSDVYWQITNTGEEASRLGQLRGGFEIGGKIKEETTSYKGNHFVEAFVVKDEVLLARSGKLVVPIN

SEQ ID NO: 2140 - protein, 454 aa, Vibrio sp.
MRHQKIFTEFLTEVVNLNQARINKVTTTSASVEKYVKDHDDFKGIFRNTSPQGSYGHRTIIKPVKNKEFDADIVFFMDENDNWEPKDYITKLHQAFKGSSIYKDMVHYNTRCVYLDYSGDFHIDVVPCIVRVTETVLGNHTQYLIANRHTNEFELTDPEAYKKWVADKNSVVGNNNLIKCIRLIKYLRDIKTTFSCKSILLTTLICNMVQDYEPNSELFKDIATTLKTIFTRLDDYLSFYDSMPEIVNPVRTEETFTRHWNEEKYTIFKTKIGDYRTWIEDAFDETDRTESIKKWRRVFGDSFHSVTKKSATAATYDEILGEASQPNFPIPPYCARHRWEEVESVGSVNLDVEYRNKNGVNPFARAVQQIIFGKNYSLKFTVTDDIPPNSDVYWQITNTGEEAGRLGQLRGGFEIGGKIKEETTSYKGNHFVEAFVVKDEVLLARSGKLVIPIN

SEQ ID NO: 2141 - protein, 454 aa, Unknown
  Description of Unknown: Vibrio sequence
MKHQKIFTEFLTNVVNLNQARINKMKTSSNSVETYIKGHDDFKDLFKNASPQGSYGHRTIIKPLKNKEFDADIVFFMDENDNWEPKDYITKLHQAFKSSPTYKNMIHYNTRCVYLDYAGDFHIDVVPCIVRTTKTILGDHTEYFIANRHTNEFEQTDPEAYKQWVADKNSIVGNNNLIKCIRLTKYLRDIKTTFSCKSILLTTLMCNMIHDYESNSDDFKDIATTLKTIFVRLDNYLSHHETMPEIVNPVQTEETFTRHWTEDKYTNFKAKIGDYRTWIEDAFGEADRAESIKKWRKVFGDNFHSVVKKSATAANYNEILNEASQQHYPIPPHCAPHKWSEDGIVSSINLDVEYRNKNSINQFARAVQQFVFGKNYSLKFTITDDIPTGSDIYWQITNTGEEASRLGQLRGGFEIGGKTKEETTSYKGNHFVEAFIVKNDVLLARSGKLVVPIN

SEQ ID NO: 2142 - protein, 454 aa, Vibrio coralliilyticus
MKHQKIFTEFLTNVVNLNQARINKMKTSSNSVETYIKGHDDFKDLFKNASPQGSYGHRTIIKPLKNKEFDADIVFFMDENDNWEPKDYITKLHQAFKSSPIYKNMIHYNTRCVYLDYAGDFHIDVVPCIVRTTKTILGDHTEYFIANRHTNEFEQTDPEAYKQWVADKNSIVGNNNLIKCIRLTKYLRDIKTTFSCKSILLTTLMCNMIHDYESNNDDFKDIATTLKTIFVRLDNYLSHHETMPEIVNPVQTEETFTRHWTEDKYTNFKAKIGDYRTWIEDAFGEADRAESIKKWRKVFGDNFHSVVKKSATAANYNEILNEASQQHYPIPPHCAPHKWSEDGIVSSINLDVEYRNKNSINQFAKAVQQFVFGKNYSLKFTITDDIPTGSDIYWQITNTGEEASRLGQLRGGFEIGGKTKEETTSYKGNHFVEAFIVKNDVLLARSGKLVVPIN

SEQ ID NO: 2143 - protein, 454 aa, Aliivibrio fischeri
MKHQKIFTEFLTNVVNLNQARINKMKTSSNSVETYIKGHDDFKDLFKNASPQGSYGHRTIIKPVKNKEFDADIVFFMDENNNWEPKDYITKLHQAFKLSPTYKNMIHYNTRCVYLDYAGDFHIDVVPCIVRTTKTIFGDHTEYFIANRHTNEFEQTDPEAYKQWVADKNSIVGNNNLIKCIRLTKYLRDIKTTFSCKSILLTTLMCNMIHDYESNSDDFKDIATTLKTIFVRLDNYLSHHETMPEIVNPVQTEETFTRHWTEDKYTNFKAKIGDYRTWIEDAFGEADRAESIKKWRKVFGDHFHSVVKKSATAANYNEILNEASQQHYPIPPHCAPHKWNEDGIVSSINLDVEYRNKNSVNQFARAVQQFVFGKNYSLKFTITDDIPTGSDIYWQITNTGEEASRLGQLRGGFEIGGKTKEETTSYKGNHLVEAFIVKNDVLLARSGKLVVPIS

SEQ ID NO: 2144 - protein, 454 aa, Vibrio cholerae
MKHQKIFTEFLTNVVNLNQARIDKMKTSSNSVETYIKGHDDFKNLFKNASPQGSYGHRTIIKPVKNKEFDADIVFFMDENGRWEPKEYITKLHQAFKSSPTYKNMIHYNTRCVYLDYAGDFHIDVVPCIVRTTKTVLGDHTEYFIANRHTNEFEQTNPEAYKQWVADKNYIVGNNNLIKCIRLIKYLRDIKTTFSCKSILLTTMICNVIHDYESNSDDFKDIATTLKTIFVRLDNYLSHHETMPEIVNPVQTEETFTRHWTEDKYTNFKAKIGDYRTWIEDAFSEADRAESIKKWRKVFGDNFHSVVKKSATAANYNEILNEASQQHYPIPAHCAPHKWKEDGIVSSINIDVEYRNKNSINRFARAAQQFVFGKNYSLKFTITDDIPTGSDVYWQITNTGEEASRLGQLRGGFEIGGKTKEETTSYKGNHFVEAFIVKNDVLLSRSGKLVVPIS

SEQ ID NO: 2145 - protein, 453 aa, Photobacterium damselae
MKHDKIFKDFLNNVVNLNQTRIEKLTKSSTSVINFIKNHDDFKDMFIEESAQGSYGHRTIIKPLAGKEFDADIVVFLKEQENWEPKDYINNIKSALEKNTKYKDMLINGNRCVCINYAGDFHIDIVPCVVKELAIGPDAKQYFVCNKRENKFEQTDPDAYKSWVKEKNKIAKNNQVIKCIRLFKYLRDIKTTFSCKSILMTTLIANQIHDYEVTSTYFTDAATSLRTIISRLDDYLQQHEQMPIIKNPVQSEENFNRHWDQQKYENFRKFITKYRTWIEDAYDEQDREISITKWRRIFGSKFHSTTGKMTKSANYEQVLNEASLESYPIPAHCQSHRWVEAENVEHIEISVHHRARLSVANFSKAIGSLTFPKEQSLRFEIVDSLPEDSAIYWQITNTGDEATQRRQLRGGFELGSRIKEEITSYKGNHFVEAYIVKDNILIARSGKRVIPIN

SEQ ID NO: 2146 - protein, 318 aa, Omnitrophica bacterium
MELTAFFDKFLADTVNLNQSKLDTLSEKMNVIDSFFKNNNTIKKHYIGLLPQGSYGQKTIIKPPKDKDFDVDILLSLQPISGWQPEDYVVNVHTEFMKDGNYKKITELNPRCATIYYSGDFHIDIVPFLRIDGRQYITNKDDNRLEETNPIGYSEWLMSKNTTANNYLIKAIRLTKYLRDIKENFSVKSILLNTLIGNCIADKEVFSEFKNLPTAFLTAFTRLNAFLQSSPNMPTVKNPTLSSEDFNRHWDQKKYSNFREKIKLYYDKTKDAYSEGSKPESIKKWQAVFGDEFPSDVEGDEKAKVFSALSSKSRPWGN

SEQ ID NO: 2147 - protein, 453 aa, Leptolyngbya boryana
MKNINDFFRDFLKDEVNLNPTRLEVAKAGIKTMENFLRRNDLFKDSIIDITPQGSYRQETIIKPFGDSDFDVDLLISLRKFDGWEPKDYLNNLHQEFKSTIRYADLVDRRGKSRCVTIDYANDFHIDLVPSISIYGVGKVMNKNSNEFEDTDGDSYAQWFEKKNLITTNQYLTKVVRLVKYLRDSKLTFSIKSVLLTSLIGRQVNEYDNYFNPECYKNLSTSLKTLFNRLNDYLQNRPNLTDEILVNPVLPTEFFNRHWNQDRYSNFRNKISNYNTWINDAYEESDINEAVKKWRKIFGEDFGEIQKTMASFSAYQSFDVKASRHDSRINQEEFISEQFPMNLDDRWSLKIAVSPDRSSGGFRPYVYRKNEGLTFMVNRNKSNLPQGIFFKWKVKNSGSEAKRYNAMRGQLENDKGDGVKFEWTLYKGKHYVECYAIYRDSVVATDSVYINVV

SEQ ID NO: 2148 - protein, 445 aa, Cyanobacterium aponinum
MKSINTFFNEFLRDEVNLNPTRLTIAKKGIEVITTFLKNNDLFKNNFIKISPQGSYRQGTIIKPVDDREFDVDILLLLHEFDDWQPRDYINNLHREFKNTSRYENIVDRKGKSRCITIDYANDFHIDIVPAIKRNGQYQIMNKNSNEFEDTDGDGYAQWFEEKNQITSKKYLTKAIRLTKYLRDIKTTFSIKSVLLTTLLGKQVHETDKLDQDILYKNLPTALKTLFNRLNNYLKFRPNLTDEIITNPVLPSEKFNRHWDEDRYTNFRDKVDKYNQWINEAYEEQDINESVNKWRKIFGDDFGEIQEQMSMVSLYASQSIKHQEEFIDKIYTLDLYKGWKLSIAVKSSQPRNGFRQLHFRKGVNLTFFVDKAKSYLPPDTIIKWKVKNSGQEAKLKNQLRGNIEDDQGYRCKEETTLYQGRHYVDCYALKDNIVIAMDTIYITVI

SEQ ID NO: 2149 - protein, 448 aa, Calothrix sp.
MKTIATFFNDFLKDEVNLNPTRLKVAKKGIKTMEKFLKNNELFKDHIIDITPQGSYKQGTINKPSGEADFDVDLLVLLKEFPGWEPKDYLHKLHQEFENTGRYKDIADRKGKSRCVTIDYASDFHIDLVPAIKKNGGYKIMNKNSNQFEDTDGEGYANWFIVKNEITTNKFLTKTVRLVKYLRDYKKTFSIKSVVLTSLLGKQVYELDKYNQNEYYKDLPTTLKTLFNRLNDYLQSLPDLTDEIITNPVLPTEKYSRHWNQDNYSTFRQKVYDYNIWINEAYAESDVNKAVKKWQRLFGDEFGEIQETTAKFSDSNRDLVGSIVQKEDFIFGSCTENLDNNYKLILSVYPRQSNGFRSQHYKKDEKLFFSINKSQSSLPSGVTFKWKVKNSGLEAKLANQLRGNIEDDIDSKGEKTETTAYKGKHYVDCYALLGNTVVATDTVNVIVV

SEQ ID NO: 2150 - protein, 460 aa, Candidatus Moranbacteria bacterium
MKFEKLFKTFVTDEVNLNPDRFNTATDGIRIITEFLENNEFFKNKIVNISPQGSFRQKTIIKPNGNKEFDVDMLVEMKEVEGFEPKNYLEALHKAFKDSKRYEDIVDKRGKSRCVTLDYASDFHMDVVPCIYKDGGYKIMDKNGNVFEKTDADGYAEWFVQKNNITKGNLVETVKLIKYLRDIKTTFSAKSVLLTTLLGNQVLAFDDAEKLYADIPTTLKNLLNRLNEYLQANENMPIVNNPSLADEDFNRHWDQDKYANFRNMIALYSSKVNEAYDGEDEEQSLKKWQEVFGDGFVLPEEESKELSLKFPDGLEIKDHSHKQELAEVGLKESLQCKKVNLRAELYFGKPDCKIMNRYYRGDFSSGAKLPLFHWLKFSVAHNIDPRYEIYWQVVNTGNHAKLEGGLRGQIFKGNSSQWERTMYTGVHWIECFVVNPITNVCVGRSGPFHVAFNNPAYQLQ

SEQ ID NO: 2151 - protein, 446 aa, Sinomonas atrocyanea
MSQSSDFKSFLINKVNLNQTRLNVLSQRVAAIENFLANDDVLGESITEVIPQGSFAHGTIIKPVGTKEFDADVLVPMDEVDGWTAADYVQKLYEAFGRSATYATMRSRKKRCVTLDYAGDFHLDVVPFVTRQGEAYVTNRITNQFELAAPDEFTEWLEEKNRITGGNLVKVVRLLKYLRDHKARYTVPSVTLTAALAHHVSEAVSIATPDAYRNVAATLRTLSDALAVQLTTYPYNPPYIRDPGTGQDLAGRWRNENYQTFRSRFTAHAEKIGTACDEADYDRAVVIWQDLFGPEFGAIAKASSVLASVSAETAAPASERFLDRDFDIRDALNPSYRFKVVGYVVARKGFRDGSLPKRGDRVGKNRSLKFKIEGSNIPGPYDVYWKIRNYGQEAELAGSLRGDIHKDDGTRSWSESTSYIGHHYVEAMIVKSGFCVARSRQNVIVI

SEQ ID NO: 2152 - protein, 450 aa, Nocardioides sp.
MTQTSDFRNFLTNKVNLNQTRINTLSAKVASLQTFLTNDEVFGDHVSELLPQGSFAHGTIIKPVGTRDFDADVLMPMDDVPGWSAADYVENLYTAFGRSNSYKTMRGRHSRCVRIDYSGDFHVDVVPFVTRNGATYITNRVKNEFQVSAPDEFTAWLEGQNRITDGNLVKVVRLLKYLRDHKSTYKVPSVTLTAALAHQVSDTATVLDPDAYKNVANTLRTLSSALSAQVDGYETVPPYIKDPGTGQDLTDRWKPENYIAFRDRFRRHATLIANACDAQTYAEALAIWRDLFGPDFGESVTLTAAVEAHYAAAPPATEKFLDKNFGIEERINPAYTVKAVGEVVPKKGFRNRPLPATGDLVDKYRDIIVRIKDCNVPEPYDLYWKVRNHGEEAEQASALRGDIHKDDGSKSRKESTQYVGRHYVEAYIVKDGVCVAKSRQPVIVTSRSGS

SEQ ID NO: 2153 - protein, 453 aa, Corynebacterium glutamicum
MTARIGEFNDFLRDFVNLNQGRVNTLQQGVSTLDEFLSLKSSLTHMINGDVIPQGSFAHKTIIKPFTGNDFDADVLLPMEEQSDWAPRKYTIELQKALEASQYTEMTILGKRCVTINYANDFHIDVVPFVTRDDGLTYITHRTDDEFVRQDPVAFTTWIKEKSSFTNGHLIRVIRLVKYLRDRSSIEVPSVVLTTLLAERVMSFNGNEDYTNVATTFTNLIEDLRDYICLMSVPPFIDDRIGGNLADRVTQSGFDNLKSQVKTWASKARNALDASSNESIEAWQKLFGSEFGRSSNKNVSSGIIAATGAISNLKTYENSMAPGEQTLQSKFGIVLKLDKNAHMKVVGRFSPRSNGKGRPRQMSSNGDHVPIGRKLTFRIEDHNISAPYEIYWKVRNAGPEAARFNNFRGEIRKGGLTIEETSNFSGSHWVEAWIVKDGFAIATARQDVTIMPK

SEQ ID NO: 2154 - protein, 453 aa, Corynebacterium glutamicum; identical to SEQ ID NO: 2153

SEQ ID NO: 2155 - protein, 447 aa, Leifsonia sp.
MTARVREFNLFLRDYVNLNQTRINTLQTRVGSLDDFLVEDSTLADVVADGLIPQGSFAHKTIVRPYSGNDFDADVLLPIEEQDEWEPKKYTIQLQKALEASSRYVGKTVLKKRCVTVEYANDFHIDVVPFITRGDGNTYITNRTDNEYVRCDPVAFTTWVEDCARTTNGHLIRVIRLVKFLRDRSSIQVPSVVLAALLAERVHSFAGVDYYTNVATTLVALLENLDDYIGPMTTRPWVDDRIGQNLADRLTETGFKNLQSQVKTWARKMREALDADSADSVEKWRTVFGDNFGAENKEQGLLASAQVDTYEKSAAPGEQWLDRDYGIPIRLNPRYGFRVVGRAAGTMRARSRPRPLSASGNHVRTGRDLNFTVEGCTVPEPFDVYWKVRNAGEEAASRKNFRGEIRKEGLRITETSNFPGNHWVQAWIVKDGVAVATDVQDVTIVSR

SEQ ID NO: 2156 - protein, 451 aa, Gordonia hirsuta
MTARIREFNLFLRDHVNLNQSRIDTLHSRVSALDTALEESVILEDKLDGSLIPQGSFAHRTIIKPLYGNDFDADVLIPMSEQDEWEPKRYTVELKKALDAVPRYAEKTELGKRCVTIQFANDFHIDVVPFIERADGNTYITHRTRNEFIRQDPTALTDWLNEQNSTTNGHLVRTIRLVKWLRDRSSIDCPSVVLAALLAGQVEGSTSLDGYGNVATTFTALLEDLRDYLELHSAPPWVDDRIGQNLADRLTQTGFNNLKSQLKRWARLARKALDADASESIDKWRKLLGDSFGASNVNSAQVLSASVASATPTYEHQMVPGEMTITEQFGFPEQRSVTDAFRIVARMSPTKKGHGRYRPLSANGNLVPIGRSLRFEIDGCTVQEPYDVYWKVRNAGPEAARRKAFRGEIIKRGKQIEETSNFPGAHWVQAWIVKDEVAVATATHDVIIMSR

SEQ ID NO: 2157 - protein, 451 aa, Unknown
  Description of Unknown: Frigoribacterium sequence
MTARIKEFNLFLRDYVNLNQTRLDLLHTRTSSLDTALEESTLIGDKLDGSLIPQGSFAHGTIIKPLSGNDFDADVLLPMIEQVDWEPKKYTVELKKALDAVPRYADKTVLGKRCVTIQFASSFHIDVVPFVERADGKTYITHRTKNEFLLQDPTEFTRWLKDQNSTTNGHLIRVIRLAKWLRDRSSIDCPSVVLGALLAERVKSFAGVDDYGNVATTFTALLEDLRDYLDMHSAPPWVDDRIGQNLADRLTQTGFDNLKSQLRRWARLAREALDAGASDSVEKWQKLFGVSFGASTTSSLALSASATTATLPTYERQMVPGEKTLTEQYNFPERRDPTSTFRIVGRMSPTKGGRGRFRPLATNGNLVPIGRALEFQITDCTVDGPYDVYWKVRNAGTEAASRKAFRGEILRRGELIRETSDFPGAHWVQAWIVKDGVAVATATQDVIIMSR

SEQ ID NO: 2158 - protein, 451 aa, Plantibacter sp.
MTPRIKEFNLFLRDYVNLNQTRLDLLHTRTSSLDTALEESALLEDKLDGSLIPQGSFAHGTIIKPLSGNDFDADVLLPMVEQVDWEPKKYTVELKKALDAVPRYADKTVLGKRCVTIQFANSFHIDVVPFVERADGKTYITHRTKNEYLLQDPTEFTRWLKEQNSTTNGHLIRVIRLAKWLRDRSSIDCPSVVLGALLAERVKSFAGVDDYGNVATTFTALLEDLRDYLDTHAAPPWVDDRIGQNLADRLTQTGFDNLKSQLRRWARLAREALDAEASDSVEKWQKLFGVSFSASTTSSLALSASAATATLPTYEHQMVPGEKSLTEQYGFPERQDPTSTFRIVGKMSPTKRGRGRFRPLATNGNLVPIGRALEFQITDCTVDGPYDVYWKVRNAGPEAASKKAFRGEILKRGELISETSDFPGAHWVQAWIVKDGVAVATATQDVIIMSR

SEQ ID NO: 2159 - protein, 451 aa, Unknown
  Description of Unknown: Curtobacterium sequence
MTARIKEFNLFLRDHVNLNQTRLDLLHTRTSSLNSALEESALLEDKLDGSLIPQGSFAHGTIIKPLSGNDFDADVLLPMVEQVDWQPKKYTVELKKALDVLPRYADKTVLGKRCVTIQFANSFHIDVVPFVERADGRTYITHRTKNEFLLQDPTEFTRWLKDQNSTTNGHLVRVIRLAKWLRDRSSIDCPSVVLGALLAERVKSYAGIDDYGNIATTFTALLEDLRDYLNMHSTPPWVDDRTGQNLADRLTQTGFDNLKSQLKRWARLAREALDAEASDSVTKWQKLFGVSFGASTTSSLALSASAAAATLPTYEHQMFPGEKTLTEQYGFPERRNPASTFRIVGKMSPTKRGRGRFRPLAMNGNLVPIGRALEFQITDCTVDGPYDVYWKVRNAGPEAASRKAFRGEVLKRGELIRETSDFPGAHWVQAWIVKDGVAVATATHDVIIMSR

SEQ ID NO: 2160 - protein, 450 aa, Arthrobacter sp.
MTARIREFNFFLRDYVNLDATRTKTLHSRVTAVNTFIADHVDIGGIVSGDVIPQGSFAHKTIIRPFTGNDFDADVLVPMVEQEGWEPKQYTQALHKALESSARYRDKAVVGKRCVKLDYAGDFHIDLVPFVTRDDGNTYITHRTRNEFIRQDPVAYTAWFEDNNRTTHGHLVRVVRLMKYLRDRSSVQIPSVVLSALLAGRVRSFAGVNDYDNVAATLTSLVRGLHEYVQHTATPPWVDDRIGQNLADRLTQSGFENLKSQLKTWSKLMTEALEADPDESVEKWRKLFGESFGSSVRKASEGEALTASASPHYEKSYAPGEEDLQKDHGIRIALDPTQRVRVVGRMSPNRKGTGRYRPLAGSGNHVPLSRSLKFSIEGCTVEKPFDVFWKVRNAGEEAARRKMFRGEIRNRGEQITESSNFHGEHWVEAWIVKDGVAVATDTQDVTILPN

SEQ ID NO: 2161 - protein, 448 aa, Rhodococcus sp.
MTPRHNEFKAFLDDHVNLNPDRTKKLNARVEAINSFVNEHADLQICLDGDLIPQGSYASRTIIKPQRRNDFDADVLLPMKEVDGWEPKHYTIKLHKAFDDSARYGDNAKLGKRCATIDYAGDFHIDIVPFVTRADGLTYITHRTKNQFILAEPTALSSWFVGQNKAAGGHLVKTVRLMKYLRDNSSAEIPSVVLSSLLAGRVQPFTSYTDLPRTLVALVNDLKTYLDSHFFVPFVDDQTGQNLADRWPQSAFVTFKSRLSTWAKDMQSALDAPADESVDAWRTVFGTNFGSASTSAAAGGSRSALSAAIAQHYAEQPAPREQFLEQHFGIPTRLDPAYTVRLVGRMSPTKSGFHRYRPLPQAGNLVPIGRSLKFKIEECTAPAPYQLFWKVRNVGEEARRQNAERGEINEYGEVITEHSSFVGAHWVQVWVVKDGVAVATDRQDVRIV

SEQ ID NO: 2162 - protein, 446 aa, Oerskovia enterophila
MKLTAYFAHFLTSCVNLNDNRIARLNARVDSITSFLKSHPVFEEYFLDVIPQGSYAQRTIIKPVGGREFDADVLLALTEHPDWTPAQYTAELKKAFEHSTTYQGKAHKRTRCVYIDYADDFHIDVVPYVESRKGITHNKDDAWVHTDPEAFTAWFEAKSRVVGAGRLEAALRLLKYLRDTKTTFSIKSVLLTILAAGQVDSWRTTIDTKYYADLPTVFVHVLEDLDTYLQANPALPDIWDPAGTGQNFKERWTPDGYETFRTKIHDYAIKARAAYDDPNKVTSLATWQEIFGPAFTAPPVQESAAALQTSAASDPGEEFLDTDRQIPIRLTQTVKLIGRVRKAGIMRSYDLPTRGDRVAKNRDIDFYLEHCTVPKPYTVMWKVKNTGTEAHDARQLRGTIEHGDTGRHEHTNYAGSHYVEVYIIRDGVCVATDRQPVIVLQHHPHR

SEQ ID NO: 2163 - protein, 441 aa, Dietzia alimentaria
MKLHAYFKHFLENTVNLDDSRIETLNKRVDAISSFLRDHEVLGECFLEVIPQGSFAQRTIIKPVGSREYDADVLLSLKEHPDWAPAQYTQELYRAFEGSGRYKGMSHRRTRCVYIDYADPFHVDVVPYVESRMVITDNKTDDWVHTDPESFTAWLEGKTRITGGRLPAILRLLKYLRDSKMTFSVKSVILTILVGERIDASRTSIDADHYKNIPTALVNIVEDLDQYLQANYFIPAIWDPAGTGQDFSTRWDQDGYANFRRQIHYYAGKIREAYDEPDKVTSLAAWQAIFGSGFQAPPPDDPVTASAVRNTGEQFIDTTLCIPIRISKAVRLVGRVRRAGVLRAYDLPKRGDQVGQGRYIDFRLEACTVEEPYQVYWKVKNFGAEAEQLNELRGQVRRGESSTYEHTAYVGSHYVEVYIVKDGACVARDRQQVIIRRGLSG

SEQ ID NO: 2164 - protein, 441 aa, Actinoplanes derwentensis
MKLHAYFKHFLASTVNLDDSRIEKLNQRVDALASFLRGHETFGEFFIDLVPQGSFAQRTIIKPVGSREYDADVLLAMKEHPSWTPAEYTQELYKAFRGSGRYRQMAHRRTRCVFIDYADPFHVDVIPFVESRKDITNNKTDDWEHTDPEGFTAWLEGKTRATGGRLPAILRILKYLRDSKTMFSVKSVLLTILVGGRIETWHADLEDGYYGDIPTALVHILEDLDAYLQANYWMPPIYDPAGTGQDFSQRWDQDEYANFRRQIHSYTAKVRDAYDEPDQAKSLAAWQAVFGDGFQAPPANTVEASAARDDSGEQFINSAKQIPVRLTESVRLVGHVRRAGVLRSYALPARGDRVGKNRTIDFTLAECSVEQPYSVYWKVKNTGREARDRRQLRGQVELGGTSRHESTSYVGSHYVEVYIVKDGVCVARDRQQVIIPPGMGA

SEQ ID NO: 2165 - protein, 450 aa, Mycobacterium abscessus
MKLIKHFDAFLVNKVNLSDGRIAQLDSRVTAVGNYLSSGDDVIAENYLELIPQGSYAHRTIINPVQTNDEFDADVLLSMDEVDGWEAKDYVQELYTVFRASSTYRDMVSRHDRCVKVDYANEFHIDVVPYLERHNEHFITNRVTDIYELTNPEGFNEWLDEQNKITGGRLIKIIRLLKFVRDYKNTFTVRSVILNILVGERINDVLVMNDADYYKDVPTALKNILKDLNDYLQANPTLPLISDPSCPTASFNHRIDQNQYSNFRDKISFYCGKVVAAYDETDLELSKTKWREVFGPLFGTYDTAAVTTSKNAHIGRAGINNTEQTLESRWNIPTVLNSTYTVRIGAVVEKKDGFRHFDLRKHGNVVGRGRTIKFEIARINVPAPYSVYWKVRNTGDEAINANCIRGQVVQDSGSRTLREPTAFRGQHYVDCYIVKDGICVAMDRQIVTIK

SEQ ID NO: 2166 - protein, 448 aa, Mycobacterium abscessus
MIKHFDAFLVNKVNLSDGRIAQLDSRVTAVGNYLSSGDDVIAENYLELIPQGSYAHRTIINPVQTNDEFDADVLLSMDEVDGWEAKDYVQELYTVFRASSTYRDMVSRHDRCVKVDYANEFHIDVVPYLERHNEHFITNRVTDIYELTNPEGFNEWLDEQNKITGGRLIKIIRLLKFVRDYKNTFTVRSVILNILVGERINDVLVMNDADYYKDVPTALKNILKDLNDYLQANPTLPLISDPSCPTASFNHRIDQNQYSNFRDKISFYCGKVVAAYDETDLELSKTKWREVFGPLFGTYDTAAVTTSKNAHIGRAGINNTEQTLESRWNIPTVLNSTYTVRIGAVVEKKDGFRHFDLRKHGNVVGRGRTIKFEIARINVPAPYSVYWKVRNTGDEAINANCIRGQVVQDSGSRTLREPTAFRGQHYVDCYIVKDGICVAMDRQIVTIK

SEQ ID NO: 2167 - protein, 450 aa, Mycobacterium abscessus; identical to SEQ ID NO: 2165

SEQ ID NO: 2168 - protein, 295 aa, Mycobacterium immunogenum
MKLIKHFDAFLVNKVNLSDGRIAQLDSRVTAVGNYLSSGNDIIAENYLELIPQGSYAHRTIINPVQVNDEFDADVLLSMDEVDGWEAKDYVQELYTVFRASSTYRDMVSRHDRCVKVDYANEFHIDVVPYLERHNEHFITNRVADTYELTNPEGFNEWLDEKNKITGGRLIKIIRLLKFVRDYKNTFTVRSVILNILVGERINDVLVMNDADYYKDVPTALKNILKDLNDYLQANPTLPLISDPSCPTESFNHRIDQNQYSNFRDKIAFYYGRVVAAYDEIDLELSKTKWREVFG

SEQ ID NO: 2169 - protein, 450 aa, Mycobacterium immunogenum
MKLIKHFDAFLVNKVNLSDGRIAQLDSRVTAVGNYLSSGNDIIAENYLELIPQGSYAHRTIINPVQVNDEFDADVLLSMDEVDGWEAKDYVQELYTVFRASSTYRDMVSRHDRCVKVDYANEFHIDVVPYLERHNEHFITNRVADTYELTNPEGFNEWLDEKNKITGGRLIKIIRLLKFVRDYKNTFTVRSVILNILVGERINDVLVMNDADYYKDVPTALKNILKDLNDYLQANPTLPLISDPSCPTESFNHRIDQNQYSNFRDKIAFYYGRVVAAYDEIDLELSKTKWREVFGPLFGTYDTAAVTTSKNAHIGRAGISNTEETLESRWKIPTVLNPTYTVRIGAVVEKKDGFRHFELRKHGNVVGLGRTINFRIARIDVPTPYSVYWKVRNTGEEAINANCIRGQVVRDSGSRTLREPTAFRGQHYVECYIVKDGICVAMDRQGVTIK

SEQ ID NO: 2170 - protein, 317 aa, Curtobacterium sp.
MKLVKHFDAFLANKVNLSDARITQLNERVAAITNFLQTGEDQFAENFIDVLPQGSYAHRTIINPVQQNDEFDADLLLEMDEVEGWEAEDYVQELYTVFRSSATYRDMVSRHARCVKVDYANAFHIDVVPYMERHGEHYITNRDENLFELTNPEGYNEWLDGKNRLASGRLVKVIRLMKYLRDFKNTFDCKSVILSILLGNSVNDAAAWGDDSQYKDVPSALKSIIGSLDDYLQDNEVMPSIDDPSEPSQNFNHRWTQEKYENFRNRIHTYRGWVDEAYDETDLEQSKAKWRRLFGDKFATFDTELKKASAAHLGLAG

SEQ ID NO: 2171 - protein, 448 aa, Curtobacterium sp.
MKLVKHFDAFLANKVNLSDARITQLNERVAAITNFLQTGEDQFAENFIDVLPQGSYAHRTIINPVQQNDEFDADLLLEMDEVEGWEAEDYVQELYTVFRSSATYRDMVSRHARCVKVDYANAFHIDVVPYMERHGEHYITNRDENLFELTNPEGYNEWLDGKNRLASGRLVKVIRLMKYLRDFKNTFDCKSVILSILLGNSVNDAAAWGDDSQYKDVPSALKSIIGSLDDYLQDNEVMPSIDDPSEPSQNFNHRWTQEKYENFRNRIHTYRGWVDEAYDETDLEQSKAKWRRLFGDKFATFDTELKKASAAHLGLAGVKNTEETLEGKWGIRTRLDGEHRIRIAGQTARRQGFRDRVLTKSGNVVLRGSTIRFRVTHNATGKVDVYWKVRNTGAEAIKANCIRGQVFLDEGTLRRNEPTAYRGRHYVEVYLVKDGVCVATDHQEVRII

SEQ ID NO: 2172 - protein, 448 aa, Microbacterium sp.
MKLMKHFDAFLVNKVNLGDGRIKQLDQRVTAITNFVQAGDDAFATNFIDILPQGSYAHRTIINPVRANDEFDADLLLEMDEVDEWEAEDYVQELYTVFRGSSTYRDMVSRHDRCIRIDYANEFHIDLVPYMERHSARYITNRAENQFELTNPEGYNKWLDEQNRLASGRLVKVIRLVKYLRDFKDTFSCKSVILSILLGNSVSDAAAWGDDSQYSDVPTALRSIVGALDDYLQDNELMPSIDDPSEPTENYNHRWDQDEYANFRTRIHVYRGWIDEAYLEEDAEESKVKWRRLFGDKFGTYDTTVKKASEAHIGVEGVRNTDETIGDRWGIPIRLDTRYRVNLTGRVAKRRGFRDYELSKYGNVVPVKSVIKFRVQHNVPGPIEVYWKVRNTGEEAIRADCIRGEVVRDNGTLTRTEPTSYRGRHYVEAYVVKDGVCVGISRQEVRIK

SEQ ID NO: 2173 - protein, 445 aa, Arthrobacter sp.
MKLTKHLDAFLKNKVNLSDARIDLLDSRVEAVENFLRRGEDDFAGNFIDLIPQGSYAHRTIINPVGSSDEFDADVLLEMNEIDGWESEDYVEELYKKFRGSSVYRDMVSRHDRCVKVDYANEFHIDVVPYMERHGQHFITNRITNEFELTNPEAFNDWLVERNKLASGHLIKVIRLMKYLRDFKNTFSVKSVILTILLGNRVNDQAVWGANDEYSDLPTALKSIVGALDDYLQENVTMPSIDDPSEPTENFNHRLSQEEYANFRNKLHLYRGWIDDAYEETDVEESKIKWRKLFGDKFGTYSEVKKSTEAHKGVPGVSDTEQSITDRFGLRLDPRLKVKIGARVAKRSGFREYELSTKGNVVMRNQKIRFRVSHNIPGSFDLYWKVRNTGAEAIKANAIRGQLEKDSGNLQRTEPTAYRGHHFVEVYVVVNDACVAMDHHDVIIK

SEQ ID NO: 2174 - protein, 448 aa, Actinobacteria bacterium
MKLTDHLDGFLKNKVNLSDGRIAALDSHVEAVTKFLSTGEDAIATNFNELIPQGSYAQRTIINPVGSGDEFDADVLLDMDEVDDWDAEDYVENLYSAFRASSTYKDMVGRKSRCVTVNYAGDFHMDVVPYLTRHGEHYITNRSQNRYERTNPEGFNEWLDEQNRITGGNRLIKVIRLLKYVRDFKNTFSVKSVILTILLGERVSSTVIMADPDHYKDLPTALLNLMTDLNTYLQANPTMPSIDDPSCPGENFNHRWDQEQYANFRSKIATYTEWAEDAYFETDREESYRKWRKLFGDKFGTYSTAGATLAVAHRGLPGVRDTEEFIEDRFAVSINPHYRVKLQGRTLRRNGWRNYTLAERGNIVDPNRRIQFTIRSSNVPEPYEVWWKVRNTGPEAIRRDMIRGQIERDAGSRSCTEPASFRGDHYVEVYIVVNGTVVATDRQPVIIR

SEQ ID NO: 2175 - protein, 447 aa, Ferrithrix thermotolerans
MKLVKQFDAFMKGKVNLGESRIEKLDARVEAVENFLSSGDNAIANNFNELIPQGSYAQRTIINPVGTTDEFDADILLDMDEVEGWDAHDYVEELYRVFRSSSTYRDMVNRRSRCVVVDYAGDFHMDVVPYLTRHGQWFITNRNENSYELTDPEGFNEWLDEQNRLTSGRLVKVLRLLKYLRDYKNTFSVKSVILTILVGGRVSSTELLSDPDHYQDLPTALVKLLKDLNTYLQANPQMPSLDDPSCPTENFNHRWDQDQYANFRNWIKTYTEWAEDAYYEADVQESYTKWRKLFGDKFGTYSTTVAKASESHRGVPGVSDTEERVQAKFVVDLNPVYQVKLQARTVRRDGFRTYTLATRGNKVTKDRKINFSLQSCNVPEPYDVWWKVRNTGPEAIARNMIRGQIVKDGGGRMRTEPTTFRGNHYVEVYIVKDGVVVAMDHHPVIIT

SEQ ID NO: 2176 - protein, 448 aa, Agrococcus lahaulensis
MKLIKHFDAFLKNRVNLSDGRIETLDKRVDAVSSFLSSDDDVISNNYIDLIPQGSYAHRTIINPVDANDEFDADVLLDMNEVDGWEAEDYVEHLYQVFRSNGTYKDKVSRRSRCVTVNYAGEFHMDVVPFLTRHGERFITNRSTNQFERTNPEGFNEWLDGQNRITSGRLVKVIRLLKYIRDFKNNFSVKSVILTILVGEQVNDAALWADPDHYKDVPTALVNLLTDLNDYLQANPSMPSIDDPSCPTENFNHRWDQDQYANFRNWIATYTSWAKDAYDETDVDESHTKWRKLFGDKFGTYDTNSSKASEAHRSIAGVRDTEEFIEHKFAGVALNPAYSIKLQAKTVSRNGWRNFVLATRGNKVSPGRSIKFSIKSSNLPGSYELWWKVRNVGAEAIAKNMIRGQIEPDDGSRSRTEPASFRGSHYVEIYAVQNGVVVAKDHHPVLIQ

SEQ ID NO: 2177 - protein, 450 aa, Actinobacteria bacterium
MKLIKHFNSFLSDHVNLSESRLQSLDSRVNSVSKFLKTGDDPISSRYIGIIPQGSYAHRTMINPVAKDDEFDADVLLEMEENADWSAKDYVEELYKVFYASGTYGHMVSRHAHCVKVDYANDFHIDVVPYLERHGSHYVTNRDYDLFELTNPEGFNEWLDGKNTIASGRLVKVIRLFKYLRDYKNTFSAKSIILNILLGGRVNSVLLLGDSKRYCDLPTAFTNILSDLNDYLQSNPSMPSVDDPSCPGQNFNHRWNENQYQNFRNRVKLYHDWARAAFDEIDRAESIRLWRKIFGDSFAEAPAASIAKSSTTAVAVRNYKDTEQFIDRDYGIPEILDARYKVTITANVVAKDGFRNFNLRRHGNVVGPDRIIEFRVSECTVPGSYQIYWKVRNTGLEARSANCVRGQIERDNGSRSRREPTKYRGKHYVECYVVLDGICVAKDHQVVVIK

SEQ ID NO: 2178 - protein, 306 aa, Chryseobacterium sp.
MKLINYFKNFLDNQVNLNSSRIKTLDERTEAITQFLKNSDLLEENFIDVIPQGSYAHKTIIKPVRTTDEYDADILLQLEEFTDWEAQDYVENLYTLFRGSNVYRDKVSRKTRCVTITYANDFHMDIVPFMERHGQKYITNRHENIFELTDPEKFTDWLDERSRITKHHFVKVVRLIKYIRDYKRTFSVKSIILNTLLGEQINDAALLENENCYDDVPTALYNIMKKLKNYVESNYYMPTIADPSETGENFGDRWDQDGWLVFRDKMIYYSDKITDAYEDQDLNSSLEKWQSIFGEEFKKTISENSK

SEQ ID NO: 2179 - protein, 445 aa, Chryseobacterium sp.
MKLINYFKNFLDNQVNLNSSRIKTLDERTEAITQFLKNSDLLEENFIDVIPQGSYAHKTIIKPVRTTDEYDADILLQLEEFTDWEAQDYVENLYTLFRGSNVYRDKVSRKTRCVTITYANDFHMDIVPFMERHGQKYITNRHENIFELTDPEKFTDWLDERSRITKHHFVKVVRLIKYIRDYKRTFSVKSIILNTLLGEQINDAALLENENCYDDVPTALYNIMKKLKNYVESNYYMPTIADPSETGENFGDRWDQDGWLVFRDKMIYYSDKITDAYEDQDLNSSLEKWQSIFGEEFKKTISENSKLKQLSDGSVLSFNDTEERLEDHNIQRKINPRYKVTLKGRVTPKNGFRTYNLSERGNKVDKGRSVAFSVTCNVPQPYTIYWKVLNRGDEALRNDCIRGQIKMGYSSHTEPTSFRGNHYVECYIVKEGICVAMDRQSVFIV

SEQ ID NO: 2180 - protein, 446 aa, Mucilaginibacter polytrichastri
MKLTNYFKNFLDNSVNLNATRITLLDERTETITTVLKNSELLKDNFLDVIPQGSYAHKTIIKPLRATDEFDADILLYLEEFADWEACDYVENVYQLFRNNSIYRDKVSRKTRCVTIDYANDFHIDVVPFLERHGNKYVTNRHKDNFELTDPEKYTEWLDERNRITKHHFVKVIRLVKYLRDYKRTFSIKSILLNTLLGEQVNDAALLENEDCYNDIPTTLYTVMKKLKKYVDDNYYMPTILDPGDTGENFGDRWDQAGWATFRTKMIYYSDKITEAYEETDLQKSLEKWQFIFGEDFKKPEAKAENQLQIANRGLVVYNNTEQQITDLGFPVRINPFYKVRLLGRVTKKQGFREYDLSTNGNKVGRSRNIAFSIRQCDVPQPYQVYWKTLNRGEEAIKINCVRGQISEGLATHNEPTSFRGNHFVECYIVKNGVCVAKDRQSVIII

SEQ ID NO: 2181 - protein, 446 aa, Mucilaginibacter gossypiicola
MKLIEYFKNFLDRSVNLNSSRITLLDERTTAITNFLKESDLLKDNFVDIIPQGSYAHKTIIKPVRSTDEFDADVLLELEEFEDWEACDYVEKLYELFRSRAIYREKVGRKTRCVTIDYANDFHIDIVPYLKRHGSNYVTNRRDNSYELTDPEKFTEWLDEKNRVTKHHFVKVIRLLKYLRDYKRTFAIKSIILSTIVGEQVNDVALLENPNCYDDIPTTLYTIMKKLKAYVQQYQIMPTINDPGQTGENFGDRWHQDGWANFRNKMIFYADKVVEAYEESDKEKSLTKWREIFGEDFKKAEAVNEQRSEASNTALVRFDQTEQQITDLGIPVNMNPVYQVRMIGRVTKKTGFREYDLNTQGNKVSTGRYINFRISRCTVPQPYQVYWKTLNRGNEAINHNCVRGQVVSGGETHQEPTSFRGNHYVECFIVKDGICVAKDRQSVIII

SEQ ID NO: 2182 - protein, 160 aa, Mycobacterium conceptionense
MQLADHFNVLLKDTVNLSQFKLDLLNQRVEAIYKALKADVEIGALITGKTPQGSWAHRTIINPVGDNEFDADFMLDMSQNPDWADNPKTYIDEVYAALHRHSTYGTMPHSRKCRCARLVYANSMHVDIVPHLNLADGREVIVNRDDNEWELTNPQVSPIG

SEQ ID NO: 2183 - protein, 337 aa, Mycobacterium sp.
MQLADHFNVLLKDTVNLSQFKLDRLNQRVEAIYKALKADVEIGALITGKTPQGSWAHRTIINPVGDNEFDADFMLDMSQNPDWADNPKTYIDEVYAALHRHSTYGTMPHSRKCRCARLVYANSMHVDIVPHLNLADGREVIVNRDDNEWELTNPQGFTDWMKKQDSIASGNLRKVIRLMKYLRDHKNSFTGTRSVLLTTMLGEQVTDLRKLLDPSYYSNVPTTLLHVVQDLDTWLQANPIKPSIADPSGSGVTFDHRWGPDPESAQATYSYFRDRIHVHAADIEAAYEEKDKDRSVQLWQNIFGDGFKAPATTTASAKFPAATSAADSTVGRSGRAG

SEQ ID NO: 2184 - protein, 337 aa, Mycobacterium abscessus
MQLADHFNVLLKDMVNLSQFKLDLLNERVEAIYKALKGDDEIGALITGKTPQGSWAHRTIINPVGNNEFDADFMLDMSENPEWADSPKTYIAEVYAALHRHSTYGTMPHSRKCRCVRLVYANSMHVDIVPHLNLADGREVIVNRDDNQWELTNPQGFTDWMKKQDTIANGNLRKVIRLMKYLRDHKNSFTGTRSVLLTTMLGEQVTELRKLLDPGYYNNVPTTLLHVVQDLDTWLQANPIKPSIADPSGSGVTFDHRWGPDPESAKATYSYFRDRIHVHAAEIKAAYEEKDKDRSVQLWQNIFGDGFKAPVTASASAKFPAAASAAVSTVGRPGRAG

SEQ ID NO: 2185 - protein, 337 aa, Mycobacterium kansasii
MQLADHFNVLLKDTVNLSQFKLDLLSDRVDAIYKALKADAQIGALITGKRPQGSWVHRTIIDPVGTNEFDADFMLDMSENPDWADSPKTYIDEVYAALHRHSTYGTMPHSRKCRCVRLVYANSMHVDIVPHLNLADGREVIVNRDDNQWELTNPQGLTDWMKNKDSLANGNLRKVIRLMKYLRDHKNSFTGTRSVLLTTMLGEQVTELRKLLDPGYYSNVPTTLLHLVQNLDTWLQANPIKPSIADPSGSGVTFDHRWGPDPESAQATYSYFRARIHVHAGEIKAAYKEKDKDHSIQLWQNIFGDGFKAPATASASAKFPAATSAVASTVGRSGRAG

SEQ ID NO: 2186 - protein, 331 aa, Actinobacteria bacterium
MKLTDYFNVLLKDTVNLGQVKLDSLDSRVEAVYKALKADEQIGHLIFGKTPQGSWAHKTIINPVGSNEFDADFMLDMSENADWSDDPKKYIEEVYAALHRHSTYGNMPHSRKCRCVRVVYANAMHLDIVPHLNLADGREVIVNRDDNAWEQTDPQGFTDWMKDKDALAKGNLRKVIRLMKYLRDHKNSFTGTRSILLTTLLGEQVTELRTLLDPGYYSDVPTTLLHLVKDLDAWLQARPTKPSIPDPSGSGVTFDHRWEQSTYSYFRDRIHVHAAEIEEAYEEENKERSIELWQGIFGDGFKAPATSSNSAKFPAAAPAAASTVGRSGRAG

SEQ ID NO: 2187 - protein, 331 aa, Actinotalea ferrariae
MKLTDYFNVLLKDTVNLGQVKLDSLDSRVEAVYKALKADEQIGHLILGKTPQGSWAHKTIINPVGSNEFDADFMLDMSENADWSDDPKKYIEEVYAALHRHSTYGNMPHSRKCRCVRVVYANSMHLDIVPHLNLADGREVIVNRDDNAWEQTDPQGFTDWMKDKDALAKGNLRKVIRLMKYLRDHKNSFTGTRSILLTTLLGEQVTELRTLLDPGYYSDVPTTLLHLVKDLDAWLQARPTKPSIPDPSGSGVTFDHRWEQSTYSYFRDRIHVHAAEIEEAYEEENKERSIELWQGIFGDGFKAPATSSNSAKFPAAAPAAASTVGRSGRAG

SEQ ID NO: 2188 - protein, 330 aa, Kytococcus sedentarius
MKLTDYFNVLLKDTVNLGQVKLDSLDSRVEAVYKALKADEQIGHLILGKTPQGSWAHKTIINPVGSNEFDADFMLDMSENTDWSDDPKKYIEEVYAALHRHSTYGNMPHSRKCRCVRVVYANSMHLDIVPHLNLADGREVIVNRDDNDWELTDPQGFTDWMKNKDALAKGNLRKVIRLMKYLRDHKNSFTGTRSILLTTLLGEQVTELRTLLNPGYYSDVPTTLLHLVKDLDAWLQARPTKPSIPDPSGSGVTFDHRWEQSTYSYFRDRIHVHAAEIEEAYKEENKERSIELWQGIFGDGFKAPATSSSAKFPAAAPAAASTVGRSGRAG

SEQ ID NO: 2189 - protein, 331 aa, Gordonia soli
MKLTDYFNVLLKDTVNLGQVKLDSLDSRVEAVYKALKADEQIGHLILGKTPQGSWAHKTIVNPVGSNEFDADFMLDMSENADWSDDPKKYIEEVYAALHRHSTYGNMPHSRKCRCVRLVYANSMHLDIVPHLNLADGREVIVNRDDNGWELTDPQGFTDWMKSKDALAKGNLRKVIRLMKYLRDHKNSFTGTRSILLTTLLGEQVTELRTLLDPGYYSDVPTTLLHLVKDLDAWLQARPTKPSIPDPSRSGVTFDHRWEQSTYSYFRDRIHVHAAEIEEAYEEEDKERSIELWQGIFGDGFKAPATSSSSAKFPAAAPAAASTVGRSGRAG

SEQ ID NO: 2190 - protein, 331 aa, Unknown
  Description of Unknown: Micrococcales sequence
MKLTDYFNVLLKDTVNLGQVKLDSLDSRVEAVYKALKADEQIGHLILGKTPQGSWAHKTIINPVGSNEFDADFMLDMSENADWADDPKKYIEEVYAALHRHSTYGNMPHSRKCRCVRVVYANSMHLDIVPHLNLADGREVIVNRDDNDWEQTDPQGFTDWMRDKDALAKGNLRKVIRLMKYLRDHKNSFTGTRSILLTTLLGEQVTELRTLLDPGYYSDVPTTLLHLVKDLDAWLQARPIKPSIPDPSGSGVTFDHRWEQSTYSYFRDRIHVHAAEIEEAYEEENKERSIELWQGIFGDGFKAPATSSSSAKFPAAAPAAASTVGRSGRAG

SEQ ID NO: 2191 - protein, 331 aa, Brevibacterium casei
MKLTDYFNVLLKDTVNLGQVKLDSLDSRVEAVYKALKADEQIGHLILGKTPQGSWAHKTIINPVGSNEFDADFMLDMSENADWADDPKKYIEEVYAALHRHSTYGNMPHSRKCRCVRVVYANSMHLDIVPHLNLADGREVIVNRDDNDWEQTDPQGFTDWMRDKDALAKGNLRKVIRLMKYLRDHKNSFTGTRSILLTTLLGEQVTELRTLLDPGYYSDVPTTLLHLVKDLDAWLQARPIKPSIPDPSGSGVTFDHRWEQSSYSYFRDRIHVHAAEIEEAYEEENKERSIELWQGIFGDGFKAPATSSSSAKFPAAAPAAASTVGRSGRAG

SEQ ID NO: 2192 - protein, 331 aa, Microbacterium sp.
MKLTDYFNVLLKDTVNLGQVKLDSLDSRVEAVYKALKADEQIGHLILGKTPQGSWAHKTIINPVGSNEFDADFMLDMSENADWADDPKKYIEEVYAALHRHSTYGNMPHSRKCRCVRVVYANSMHLDIVPHLNLADGREVIVNRDDNDWEQTDPQGFTDWMRDKDALAKGNLRKVIRLMKYLRDHKNSFTGTRSILLTTLLGEQVTELRTLLDPGYYSDVPTTLLHLVKDLDAWLQARPIKPSIPDPSGSGVAFDHRWEQSSYSYFRDRIHVHAAEIEEAYEEENKERSIELWQGIFGDGFKAPATSSSSAKFPAAAPAAASTVGRSGRAG

SEQ ID NO: 2193 - protein, 331 aa, Arthrobacter subterraneus
MKLTDYFNVLLKDTVNLSQVKLDSLDSRVEAVYQALKADEQIGRLILGKTPQGSWAHKTIINPVGSNEFDADFMLDMSENADWSDDPKKYIEEVYAALHRHSTYGNMPHSRKCRCVRLVYANSMHLDIVPHLNLADGREVIVNRDDNDWEQTDPQGFTDWMKDKDTLAKGNLRKVIRLMKYLRDHKNSFTGTRSILLTTLLGEQVTELRTLLDPGYYSDVPTTLLHLVKDLDAWLQARPIKPSIPDPSGSGVTFDHRWEQSTYSYFRDRIHVHAAEIEEAYEEENKERSIELWQGIFGDGFKAPATSSNSAKFPAAAPAAASTVGRSGRAG

SEQ ID NO: 2194 - protein, 331 aa, Intrasporangium chromatireducens
MKLTDYFNVLLTDTVNLGQVKLDSLDSRVETVYKALKADEQIGHLILGKTPQGSWAHKTIINPVGDKEFDADFMLDMSENPDWADDPRKYIEEVYAALHRHSTYRDMPHSRKCRCVRLVYANSMHLDIVPHLTLADGREVIVNRDNNDWELTDPQGFTDWMRNKDALAKGNLRKVIRLMKYLRDHKNSFTGTRSILLTTMLGEQVTELRTLLDPNYYGDVPTTLLHLVQDLDTWLQARPTKPSIPDPSGSGVTFDHRWEQSTYSYFRDRIHVHAAEIEEAYEEKNKERSIELWQGIFGDGFKAPATSSSSAKFPAAAPAAASTVGRSGRAG

SEQ ID NO: 2195 - protein, 331 aa, Dietzia cinnamea
MKHADYFNVLLKDTVNLGQVKLDSLDSRVEAVYNALKADEQIGPLVLGKTPQGSWAHKTIINPVGSNEFDADFMLDMRENPDWSDDPKRYIEEVYAALHRHRTYGDMPHSRKCRCVRLAYANSMHLDIVPHLNLADGREVIVNRDDNDWELTNPQGFTNWMKSKDALAKGNLRKVIRLMKYLRDHKNSFTGTRSILLTTLLGEQVTELRTLLDPGYYSDVPTTLLHLVKDLDDWLQARPTKPSISDPSGSGVTFDHRWEQSTYSYFRDRINRHAAEIEEAYQEKNKERSVELWQGIFGDGFKAPATSSSSVKFPAIAPAAASTVGRSGRAG

SEQ ID NO: 2196 - protein, 330 aa, Propionibacterium freudenreichii
MKLTDYFNVLLKDTVNLGQVKLDLLDSRVESVYKALKADEQIGPLILGKTPQGSWAHRTIINPVGDNEFDADFMLDISENPDWADDPKKYIEEVYAALHRHSTYGNMPHSRKCRCVRLVYANSMHLDIVPHLNLADGREVIVNRDDNDWELTSPQCFTDWMKTKDTLANGNLRKVIRLMKYLRDHKNSFTGTRSILLTTLLGERVTELRTLLDPGYYSDVPTTLLHVVNDLDSWLQARPIKPSIPDPSGSGVTFDHRWEQSTYSYFRDRIHAHAAEIEKAYNEENKDRSVELWQGIFGDAFKAPATSSSSTKFPAAPVPATTVGRSGRAG

SEQ ID NO: 2197 - protein, 337 aa, Nocardiopsis ganjiahuensis
MELTNYFNVLLKDTVNLGQVKLDLLDSRVEAVYKALNADEQIRSLILGKTPQGSWAHRTIINPVGSNEFDADFMLDMGENPDWSDDPKKYIEEVYAALHRQSTYGNMPHSRKCRCVRLVYANSMHLDIVPHLNLADGREVIVNRDDNDWELTDPQGFTDWMKNKDALAKGNLRKVIRLMKYLRDHKNSFTGTRSILLTTMLGEQVTELRTLLDPSYYSDVPTALLHIVKDLDVWLQANPSTPPVADPSGSGVYFGHRWGSDPEKAQATYSYFRDRIHVHAAQIEEAYEEENKERSIELWQGIFGDGFKAPATSSSSAKFPAAAPAAASTVGRSGRAG

SEQ ID NO: 2198 - protein, 337 aa, Dietzia cinnamea
MKLTDYFNVLLKDTVNLGQVKLDLLDSRVETVYKALKADEQIGHLILGKTPQGSWAHKTIINPVGDNEFDADFMLDMSENPDWSDDPKKYIEEVYAALHRHSTYGNMPHSRKCRCVRLVYANSMHLDIVPHLNLADGREVIVNRDDNDWELTDPQGFTDWMKNKDALAKGNLRKVIRLMKYLRDHKNSFTGTRSILLTTLLGEQVTELRTLLDPSYYSDVPTALLHIVKDLDVWLQANPSTPPVADPSGSGVYFGHRWGSDPEKAQATYSYFRDRIHVHAAEIEEAYEEENKDRSIELWQGIFGDGFKAPATSSSSAKFPAAAPAAASTVGRSGRAG

SEQ ID NO: 2199 - protein, 337 aa, Tersicoccus phoenicis
MKLTDYFNVLLKDTVNLGQVKLDSLDSRVEAVYKVLKADEQIGHLILGKTPQGSWAHKTIINPVGDNEFDADFMLDMSENADWSDDPKKYIEEIYAALHRHSIYGNMPHSRKCRCVRLVYANSMHLDIVPHLNLADGREVIVNRDDNDWELTDPQGFTDWMKDKDALAKGNLRKVIRLMKYLRDHKNSFTGTRSILLTTLLGEQVTELRTLLDPSYYSDVPTALLHIVKDLDVWLQENPSTPPVADPSGSGVYFGHRWGSDPEKAQATYSYFRDRIHIHAAEIEEAYAEENKERSIELWQGIFGDGFKATATSSSSAKFPAAAPAAASTVGRSGRAG

SEQ ID NO: 2200 - protein, 337 aa, Nocardia niwae
MKLTDHFNALLKDTVNLGQTKLDLLDSRVEAVYKALKADEQIGSLILGKTPQGSWAHKTIINPVGNNEFDADFMLDMSENPDWADNPKKYIEEVYAALHRHSIYGNMPHSRKCRCVRLVYANSMHLDIVPHLNLADGREVIVNRDNNDWELTDPQGFTDWMKQKDALANGNLRKVIRLMKYLRDHKSSFTGTRSILLTTLLGEQITEVRTLLDPSYYSDVPTTLLHVVKDLDAWLQLNPSTPPVADPSGSGVFFGHRWGPDPETAQATYSYFCARIRAHAAEIEEAYEEKNKERSVGLWQGIFGDGFKAPSPSSGSAKFPAAAPAAASSVGRSGRAG

SEQ ID NO: 2201 - protein, 331 aa, Arthrobacter sp.
MQLAGHFNVLLKDTVNLGQVKLDLLDQRVNAIYKALKNDAVVGSLVSGKSPQGSWAHRTIIEPVGTNEFDADFMLNMKENPDWADNPGAYLDQVYAAIHRHSIYGNMPHTRKCRCVRVGYANSMHVDIVPHLKLSDGREVIVNRDANNWEQTHPQGFTDWMRSKDAIANGNLRKVIRLMKYLRDHKNSFTGTRSILLTTLLGSQVSEVRDLLDPGYYADVPTTLLHVVNDLDDWLQARPDKPSIADPSGSGASFDHRWTQSTYSYFRDRIHAHAAEIEAAYLEVDKEKSVKLWQGIFGEGFKAPATFTSSAKFPTGATAAASSVSRSGRAG

SEQ ID NO: 2202 - protein, 333 aa, Streptomyces griseoaurantiacus
MQLTTCFNTLLTDAVNLSRPKLDMLDDRVDSVYRALKSDEEIGHLVLDEIPQGSWAQRTIINPVGDKEFDADFLLLMEENPDWHGSPKTYIDKVYAALDRHSRYRQMPHSRKCRCVRLEYKNLMHVDIVPYVQLSDGRDVIVNRDDNCWEATDPEGFTAWMRNQDDITGGNLRRVIRLLKYLRDHKNSFTGTRSIILTTLLGNQVSETKTLIDPGYYANVPTTLLHLVQDLNTYLQANPNKPSIADPSGSGVTFDHRWTQDTYAYFRERIRVHTDEIKAAYHHADKETSIELWQGLFGTGFKEPDAQQSSAKFPAAAASVAAVTTTGRSGRAG

SEQ ID NO: 2203 - protein, 333 aa, Streptomyces violaceusniger
MQLTTCFNTLLTDTVNLSRFKLELLDERAGKVYRALKDDEEIGHLVLDKIPQGSWAQRTIIDPVGDNEFDADFLLLLEENPDWHDSPKTYIDKVYAALHRHRLYGEMPHSRKCRCVRLVYKNSMHVDIVPYVQLSDGRSVIVNRDDNCWEATDPEGFTTWMRQQDGITGGNLRKVIRLMKYLRDHKNSFTGTRSIILTTLLGNQVSETKKLLDPGYYANVPTTLLHLVQDLNTYLQANPTKPSIADPSGSGVTFDHRWTQATYTYFRERIRVHAAEIEDAYHEPDKETSLGLWQDLFGSGFKEPETQQSSAKFPAAASSVAAVTTTGRSGRAG

SEQ ID NO: 2204 - protein, 331 aa, Streptomyces scabrisporus
MQLADHFNELLGNTVNLGQVKLNLLETRVESIYRALKADPVIGQLILDKIPQGSWAHRTIIDPVRGAEFDADVMLLMAENSGWSPKTYIEEVYAALHRHSVYKDMPHSRKCRCVRLVYSNSMHVDLVPSVRLADGREVIVNRDEDRWEYTDSEGFTTWMRTQDQAAQGNLRRVIRLMKFLRDHKGSFTGTRSVILTTLLGNQVSTYKKLSDPGYYRDVPTTLLHIVEDLDIYLQAYPVKPSVADPSGSGLTFDHRWEQSTYSYFRDRIHTHASEIHDAYHAADKDTSVRLWQNLFGPGFKAPVVAASSAKFPATAASAGAAATVARPGRAG

SEQ ID NO: 2205 - protein, 330 aa, Microbacterium sp.
MQLADHFDVLLKDTVNLSQFKLETLETRVDAIYAAIAADATIGAMILGKTPQGSWAHRTIIQPQKGKEFDADFMLDMEENPDWSTSPKTYIDEVYYALKRHPKYGQMPLARKCRCVRVSYANDMHVDIVPHVILSGWREVIVNRDENIWEDTNPQGFTDWMKKQDQIAGGNLRRVIRLIKFLRDHKNSFTGTRSILLTTLLGERVSELSKMSDPSCYSNLPTALRTIVTDLDEWLQARPNRPSIADPSGSGVTFDHRWSDETYSYFRDRIHVHAAEIEDAYAEPDKDRSVQKWQALFGDGFKAPAGSGPAKFAPAAPTKETTTGRSGRAG

SEQ ID NO: 2206 - protein, 333 aa, Streptomyces clavuligerus
MQHSTGFDAFLRDTVNLSQAKLDLLANCVEAIYRALKADPELGPLVLAKKRQGSWAQRTIINPVGESEFDADFMLQLDEVAEWADNPKTYIEMVYAALHRHSVYGGMEHHRKCRCVQLSYAKSMHVDIVPYLRLKDGREVIVNRDDNVWEETNPAGFTAWMQKKDGIADGNLRKVIRLMKYLRNHRESFTGTRSIILTTLLGELVSETKAVSEPGCYSNVPTALLTIIKDLDTWLQDHPFKPSIPDPSGSGVTFDHRWNQDTYAYFRDRIHTHARQIREAYDEPDYDRSVRLWRSLFGNAFPDVPRPTASIASAAKFASPLLVTSTSRTGRAG

SEQ ID NO: 2207 - protein, 334 aa, Streptomyces sp.
MQCRKNFDTFLKNTVNLSQAKLTLLDVRVEAIYKALKADPELGPLIRGRKRQGSWAQRTIINPVGDSEFDADFMLHLAENAEWANSPKTYIDKVYAALHHHSVYGGMPHTRKCRCVQLSYANSMHVDIVPYLQLADGREVIVNRDANTWERTNPAGFTDWMQKKDSIANNNLRKVIRLMKYLRNHRGSFTGTRSIILTTLLGERVAEIKALTNPGCYSDVPTTLLTIVKDLDRWLQERPYKPSIPDPSGSGVTFDHRWDQTTYSYFRDRIHTHAREIREAYDEPDYDRSVRLWRKLFGDAFPDQPRVTASLTPTAAKFATPLLVTTTSRTGRAG

SEQ ID NO: 2208 - protein, 334 aa, Streptomyces sp.
MECRKNFDTFLKNTVNLSQAKLTLLDVRVEAIYQALKADPELGPLIRGKKPQGSWAQRTIINPVGDSEFDADFMLHLTENTDWADSPKTYIDKVYAALHRHSIYGAMPHTRKCRCMQLSYANSMHVDIVPYLQLADGREVIVNRDANTWEQTNPAGFTAWMQKKDGIANNNLRKVIRLMKYLRNHRGSFTGTRSIILTTLLGERVEEIKPLTDPGCYSDVPTTLLTIVEDLDRWLQARPYKPSIADPSGSGVTFDHRWDQVTYSYFRARIHTHAREIREAYDEPDYDRSVRLWRKLFGDAFPDQPRATASLTPTAAKFATPLLITTTSRTGRAG

SEQ ID NO: 2209 - protein, 334 aa, Streptomyces rimosus
MQCRKNFDTFLKNTVNLSQAKLTLLDDRVEAIYKALKADPELGPLIRGKKPQGSWAQRTIINPVGDSEFDADFMLDLTENAGWADSPKTYIDKVYAAIHRHSIYGSMPHTRKCRCVQLSYANFMHVDIVPYLQLANGREVIVNRDANTWEQTNPAGFTAWMQKKDGLANNNLRKVIRLMKYLRNHRGSFTGTRSIILTTLLGERVEEIKALTHPGCYSDVPITLLTIVEDLDRWLQERSYKPSIPDPSGSGVTFDHRWDQTTYSYFRVRIHTHAREIREAYDEPDYDRSVRLWRKLFGDAFPDQPRAAASLTSTAAKFASPLLVTTTSRTGRAG

SEQ ID NO: 2210 - protein, 334 aa, Streptomyces glaucescens
MQCRKNFDTFLKNTVNLSQAKLALLDVRVEAIYKALKADPELGSFIRGKKPQGSWAQRTIINPVGDSEFDADFMLHLTENTEWADSPKTYIDKVYAALHRHSIYGAMPHTRKCRCVQLSYANSMHVDIVPYLQLADGREVIVNRDANTWEQTNPAGFTAWMQKKDGIANNNLRKVIRLMKYLRNHRGSFTGTRSIILTTLLGERVEEIKKLMDPGCYSDVPTTLLAIVEDLDRWLQERPYKPSIVDPSGSGVTFDHRWDQTTYSYFRARIHAHAREIREAYDEPDYDRSVRLWRKLFGDAFPGQPRATASLTPTVAKFATPLLITTTSRTGRAG

SEQ ID NO: 2211 - protein, 334 aa, Streptomyces viridosporus
MQCRKNFDTFLKNTVNLSQAKLTLLDVRVEAIYKALKADSELGSLVRGKKPQGSWAQRTIINPVGDSEFDADFMLHLTEHTEWTDSPKTYIDKVYAALHRHSIYGAMPHTRKCRCVQLSYANSMHVDIVPYLQLADGREVIVNRDANTWEQTNPAGFTAWMQMKDGIANNNLRKVIRLMKYLRNHRGSFTGTRSIILTTLLGERVEEIKKLMDPGCYSDVPTTLLTIVEDLDRWLQERPYKPSIADPSGSGVTFDHRWDQTTYSYFRARIHAHAREIREAYDEPDYDRSVRLWRKLFGDAFPDQPRAAASLTPTGAKFATPLLITTTSRTGRAG

SEQ ID NO: 2212 - protein, 334 aa, Streptomyces sp.
MQCRKNFDAFLKNTVNLSQAKLTLLDVRVEAIYKALKADSELGSLIRGKKPQGSWAQRTIINPVGDSEFDADFMLHLTENTEWADSPKTYIDKVYAALHRHSIYGAMPHTRKCRCVQLSYANSMHVDIVPYLQLADGREVIVNRDANTWEQTNPAGFTAWMQKKDGIANNNLRKVIRLMKYLRNHRGSFTGTRSIILTTLLGERVEEIKKLMDPGCYSDVPTTLLTIVEDLDRWLQERPYKPSIADPSGSGVTFDHRWDQTTYSYFRARIHAHAREIREAYDEPDYDHSVRLWRKLFGDAFPGQPRAAASLTPTVAKFATPLLITTTSRTGRAG

SEQ ID NO: 2213 - protein, 332 aa, Kitasatospora sp.
MQHVSSFRTFLRETVNLSKAKLDILDSRVESVYQALQDDAELGPLILGKEPQGSWAHHTIINPVGDKEFDADFMLHLTEVPEWADSPKTYIDKVYGALHRHSVYGKMDPTRKCRCVQLKYANSMHVDIVPHLFLADGREVIVNRDDNCWEETNPEGFTAWMREKDNIAEGNLRKVVRLMKFLRDHKGSFKGTRSIILTTLLGERVSQATALAHPGCYGNVPTALLTIVEDLDLWLQARPDKPSIADPSGSGATFDHRWEQATYSYFRARIHTHAQEIRAAYDEQDPDRSVRLWRNLFGDSFPSLPGTSSSSTASKFAAATLLTTAARPGRAG

SEQ ID NO: 2214 - protein, 332 aa, Streptomyces viridifaciens
MQHVNSFRALLRDTVNLSQTKLDLLDSRVEVIYQALRKDPELGPLVLGKRPQGSWAQRTIINPVGDKEFDADFMLDLAEVPEWADSPETYIDKVYAALHRNGTYNDMPHTRKCRCVQLRYANSMHVDIVPHLFLADGREVIVNRDDNCWEETNPDGFTAWMREKDGITDGNLRKVIRLMKFLRDHKNSFTGTRSIILTTLLGERVSQATALARPGCYGNVPTALLTIVNDLDTWLQARPYKPSIADPSGSGATFDHRWDQTTYGYFRARIHAHAQEIREAYDEQDHDRSVRLWRNLFGDSFPSLPGTSSSSLAPKFAAASLLTTATRTGRAG

SEQ ID NO: 2215 - protein, 335 aa, Streptomyces tsukubensis
MQHVNCFTSFLRDVVNLSQAKLDLLSYRVEAIYQALKNDPELGPLILGKKPQGSWAQRTIINPVGDKEFDADFMLHLQEVLDWASNPATYIDKIYAALHRNSTYKGMPHTRKCRCVQLTYANSMHVDIVPYLCLADGREVIVNRDENRFEPTNPVGFTAWMKEKDDIAGGNLRKVIRLMKYLRDHRNSFTGTRSIILTTLLGERVTQATALLETGCYANVPTALLTIVEDLDEWLQGRPYKPSIPDPSQSGLTFDHRWNQATYAYFRDRIHTHAREIRAAYEETDPTTSLRLWRDLFGDRFPEPPEASSSSATPAAGPKFPVPPLITPTRTGRAG

SEQ ID NO: 2216 - protein, 334 aa, Streptomyces sp.
MQHVDSFRTFLRDTVNLSQRRLDLLATRVETIYQALKNDPDLGPLVLGKKPQGSWAQRTIINPQGDKEFDADFMLHLAEVPDWSDSPKTYIDQVYSALHHHRIYRDMPYTRKCRCVQLSYANSMHVDIVPYLHLADGREVIVNRDDDRWEQTNPTGFTTWMQQQDKIANGNLRKVIRLMKFLRDHKNSFTGTRSIILTTLLGNRVSQFQAMIRPDSYANVPTALLTIVEDLDTWLQARPFKPSISDPSGSGVTFDHRWDQETYSYFRARIHTHARQIREAYDETDPDRSVRLWRDLFGDAFPAPQRSTAPVAARFAAPALLTPATTVSRTGRAG

SEQ ID NO: 2217 - protein, 342 aa, Frankia sp.
MKHTDYFNSFLKNTVNLSQPKLDLLAARVDAIYTALSADPELGPRLIKKIPQGSWAQETIISPQNGKPFDADFLLQMKEEAVWSDNVREYSNAVWEVIHHHSRYGGMPHGRKCRCVYIEYADHEMHVDVVPYVILADGRQVIINRDLNQFETTNPDGFTAWMKERDKIADGNLRKVIRLLKFLRDHKNSFTGTKSILITTLLGEQVAAWKKIGDPGYYQDLPTALLHLVSDLDVWLQARLTKPSIVDPSNPLVTFDHRWDQTTYSYFRARIHVHAAEIREAYLETDEEKSVKKWQELFGDKFQAPKTSSASSKFGTAGVAGRITDGIKPPGISSSGRSGRAG

SEQ ID NO: 2218 - protein, 342 aa, Frankia sp.
MKHTDYFNNFLKNTVNLSQFNLDVLAGRVDAIYTALEADPELGPRLVKKIPQGSWAQKTIISPQNGKPFDADFLLQMNEVPDWSDNVQEYSNAVWKVIHHHWRYGAMPHSRKCRCVYVEYADNEMHVDIVPYVILADGRQVIVNRDLNQFETTNPDGFTTWMKDKDKIADGNLRKVIRLLKFLRDHKNSFTGTKSILITTLLGTQVAAWKKIGDPGYYQDLPTALLNLVSDLDVWLQVHHTKPSIADPSNPVVTFDHRWDETTYSYFRTRIHAHAAEIREAYHETDEEKSVKKWQDLFGDKFQAAQTSSASSKFGTAGAAGRITGGAEPPGISSSGRSGRAG

SEQ ID NO: 2219 - protein, 342 aa, Blastococcus endophyticus
MKHTDYFDNFLKNTVNLSQFNLDKLADRVDAIYDALKADPDLGPRIIKKIPQGSWAQETIISPQNGKPFDADFMLQMREEDDWSDDVAQYINAVYKVIDNHSTYGDMPHNRKCRCVYVEYANNKMHVDIVPYLTLADGRQVIINRDDNEFETTNPTGFTQWMKDKDKIADRNLRKVIRLLKFLRDHKNSFTGTRSILITTLLGEQVADWKKIADPGYYSDLPTALLHMVSDLDAWLQERPTKPSIADPSNPLVTFDHRWSQETYSYFRDRINVHAAEIQDACDETDEETSIKKWQDLFGDGFQPPATSAESTKFGDAGAAGGASGTTEPPGTSSSGRSGRAG

SEQ ID NO: 2220 - protein, 342 aa, Micromonospora rhizosphaerae
MKHTDYFSNFLKNTVNLSQFNLDLLADRVDAIYAALKADPDLGPRIVKKIPQGSWAQETIISPQNGKPFDADFLLQMKEETDWSEDVQEYINAVYHVIHHHSRYGNMPHNRKCRCVYVEYANNQMHVDIVPYVILGEGEQVIINRDDEQFETTNPSGFTQWMKDKDKIANRNLRKVIRLLKFLRDHKNSFTGTKSILITTLLGEQVSEWKKISDPGYYSDLPTALLHMVSDLDQWLQQNWIKPSIADPSNPSVTFDHRWSQETYSYFRDRIHAHAAEIHDAYHETDEEKSVKKWQGLFGDEFQAPEISSSSTKFGDAGAAGGVVGGNEPPGASSSGRSGRAG

SEQ ID NO: 2221 - protein, 342 aa, Frankia coriariae
MRHTDYFDSFMKNTVNLSQYNLDLLASRVDAIYAALKADPDLGPRLVKKIPQGSWAQETIISPQNGKPFDADFLVQMTEEADWSDDVQQYINAVYKVIHHHSIYGDMPHSRKCRCVYVEYANNRMHVDIVPYVILTDGRQVIINRDDNAFETTDPSGFTQWMKDKDKIANRKLRKVIRLLKFLRDHKNSFTGTKSILLTTLLGMQVEEWKKILDPGYYSDLPTALLHMVGDLDAWLQARPTKPSIADPSNQVVTFDHRWSEETYAYFRDRIHVHAAEIRDAYEETDEEESVKKWQALFGDKFQAPEASSSSRKFGAAGAAAGFTGGTNLPRISSSGRSGRAG

SEQ ID NO: 2222 - protein, 342 aa, Frankia sp.
  MOD_RES (56)..(56): Any amino acid
MRHTDYFDSFMKNTVNLSQYNLDLLASRVDAIYAALKADPDLGPRLVKKIPQGSWXQETIISPQNGKPFDADFLVQMTEEADWSDDVQQYINAVYKVIHHHSIYGDMPHSRKCRCVYVEYANNRMHVDIVPYVILTDGRQVIINRDDNAFETTDPSGFTQWMKDKDKIANRKLRKVIRLLKFLRDHKNSFTGTKSILLTTLLGMQVEEWKKILDPGYYSDLPTALLHMVGDLDAWLQARPTKPSIADPSNQVVTFDHRWSEETYAYFRDRIHVHAAEIRDAYEETDEEESVKKWQALFGDKFQAPEASSSSRKFGAAGAAAGFTGGTNLPRISSSGRSGRAG

SEQ ID NO: 2223 - protein, 342 aa, Frankia sp.
MRHTDYFDSFMKNTVNLSQYNLDLLASRVDAIYAALKADPDLGPRLVKKIPQGSWAQETIINPQNGKPFDADFLVQMTEEADWSDDVQQYINAVYKVIHHHSIYGDMPHSRKCRCVYVEYANNRMHVDIVPYVILTDGRQVIINRDDNAFETTDPSGFTQWMKDKDKIANRKLRKVIRLLKFLRDHKDSFTGTKSILLTTLLGMQVEEWKKILDPGYYSDLPTALLHMVGDLDAWLQARPTKPSIADPSNQVVTFDHRWSEETYAYFRDRIHVHAAEIRDAYEETDEEESVKKWQALFGDKFQAPEASSSSRKFGAAGAAAGFTGGTNLPRISSSGRSGRAG

SEQ ID NO: 2224 - protein, 338 aa, Kibdelosporangium sp.
MRHTNYFNNFLKNTVNLSQPRLDTLEGRVDSIYAALKADPDLGSRIVKKIPQGSWAQRTIISPQNGKPFDADFLLQMKEESDWAYVLKKYAAAVYGALDDHPMYGKMPHGRKCRCVYVEYAENAMHVDIVPFVVRADGSQNIINRDDNCWERTDPAGFTEWMRDRDKITNGHLRKVIRLLKFLRDHKNSFTGTKSILITTLLGEQVSWWKKFTTPGYYSDLPTSLLHLVSDLDDWLQANENKPSIMDPSGSGVTFDHRWSPETYSYFCDRIHVHAAEIADAYHETNEARSITKWQALFGDKFQPAETAASNTKFTAAGAASAGGTYPIASSSRSGRAG

SEQ ID NO: 2225 - protein, 336 aa, Salinispora arenicola
MRHTDYFKNLLDKTVNLSKFKLELLTERVDSIYGVLKDDEHLGPLIKKKIPQGSWPQRTIINPQNGKPFDADFMVQMVEDPDWADDLKKYGDAIYKVIHNMSPYKDMPHGRKCRCVYVTYAKNAMHVDIVPFVVRADGTQWIINRDANMWERTDTDGFTSWMKEKDAIAGNHLREVIRIMKFLRDHKNSFTGTKSILLTTVLGMQVEAWRKVLEPGYYADLPTALLHIVSDLNKWLQANPTKPLIMAPSGSGTSFDHRWSQATYAYFRDRIHTHAAEIKAAYDEADFDESVKKWQSLFGDGFTAPSSSTSSGKYSTVGTGAGTAGAATVNLSGRAG

SEQ ID NO: 2226 - protein, 336 aa, Salinispora arenicola
MRHTDYFKNLLDKTVNLSKFKLELLTERVDSIYGVLKDDEHLGPLIKKKIPQGSWPQRTIINPQNGKPFDADFMVQMVEDPDWADDLKKYGDAIYKVIHNMSPYKDMPHGRKCRCVYVTYANNAMHVDIVPFVVRADGTQWIINRDANMWERTDTDGFTSWMKEKDAIAGNHLREVIRIMKFLRDHKNSFTGTKSILLTTVLGMQVEAWRKVLEPGYYADLPTALLHIVSDLNKWLQANPTKPVIMDPSGSGTSFDHRWSQATYAYFRDRIHTHAAEIKAAYDEADFDESVKKWQSLFGDGFTAPSSSTSSGKYSTVGTGAGTAGAATVNLSGRAG

SEQ ID NO: 2227 - protein, 336 aa, Salinispora arenicola
MRHTDYFKNFLDKTVNLPKFKLELLTERVDSIYGVLKDDEHLGPLIKKKIPQGSWPQRTIINPQNGKPFDADFVVQMVEDPDWADDLKKYGDAIYKVIHNMSPYKDMPHGRKCRCVYVTYANNAMHVDIVPFVVRADGTQWIINRDANMWERTDTDGFTSWMKEKDAIAGNHLREVIRIMKFLRDHKNSFTGTKSILLTTVLGMQVEAWRKVLEPGYYADLPTALLHIVSDLNKWLQANPTKPVIMDPSGSGTSFDHRWSQATYAYFRDRIHTHAAEIKAAYDEADFDESVKKWQSLFGDGFTAPSSSTSSGKYSTVGTGAGMAGAATVNLSGRAG

SEQ ID NO: 2228 - protein, 336 aa, Salinispora arenicola
MKHTDYFKNFLENTVNLSKFKLELLSERVESIYDVLKGDEELGPLIKKKIPQGSWPQKTIINPQNGKPFDADFMVQMVEDPDWADDLKKYGDAIYKVLHNTSPYKDMPHGRKCRCVYVVYANNAMHVDVVPFVVRADGKQWIINRDANEWERTDTDGFTTWMKTKDAIAGRHLREVIRIMKFLRDHKNSFTGTKSILLTTLLGEQVEDWRKILDAGYYADLPTALLHIVSDLDVWLQARPTKPVIMDPSGSGTSFDHRWTQETYAYFRDRIHAHAAEIKDAYDETDFDESVKKWQNLFGDGFKAPESSTSSGKYSTVGTGAGASGAASVNLSGRAG

SEQ ID NO: 2229 - protein, 336 aa, Mycobacterium vulneris
MKHTDYFKNFLANTVNMSKFNLELLSQRVDTVYGVLKADDDLGPLVKKKIPQGSWPQKTIIRPQNGKAFDGDFMVQMVENPAWEVDKKKYADAIYRVLHNTSPYKDMPHGRKCRCVYLTYANNAMHLDIVPFVIRADGTQWIINRDDNEWERTDTDGFTAWMKRQDEIAGKHLREVIRIIKFLRDHRNSFTGTRSILLTTLLGEQVKEWRTILDAGYYGDLPTALLHIVSELDDWLQARPTKPTIMDPAGTGTSFDHRWSAETYAYFRDRIHAHAAEIKAAYDETDFDKSVKKWQALFGDGFSAPKTVGAVGKYRALGTGAGSAGASTVSLPGRAG

SEQ ID NO: 2230 - protein, 336 aa, Salinispora tropica
MRHEDYFKNFLENTVNLSRFKLELLSERVDALYGALKGDDDLGPMIKKKIPQGSWPQKTIINPQNDKAFDADFMVQMTENPEWEEDKKRYGNEIYNVLHKTSPYKDMPHGRKCRCVYVQYANNAMHVDIVPFVLRADGTQWIINRDDNKWERTDPDGFTDWMKKKNTIASKHLREVIRIMKFLRDHKNSFTGTKSILLTTLLGERVEDWRKIYDAGYYSDLPTALLHIVSDLDTWLQDRPYKPVIMDPSGSGTSFDHRWTQETYAYFRDRIHVHAAEIKAAYDETDFDESVKKWQDLFGDGFKAPKSSTSSGKYSSVGTGAGAAGTASVSLSGRAG

SEQ ID NO: 2231 - protein, 341 aa, Arthrobacter sp.
MKHTDYFKNFLDQTVNLPESKVDLLSTRVDAIYNCLKADPDLKPLIKKKVPQGSWPQRTIIKPVNGNAFDADFMVQMVEEPDWADNLKKYGDAIYNVLHNTSPYKNMPHGRKCRCVYVNYAENAMHVDVVPFVLRADGSQWIINRDDNTWERTDSAGFTDWMKNKDDIANKRLREVIRIMKHLRDHKNSWTGTKSILLTTLLGERVEEWRKVFDSGYYSDLPTALLHIVSDLDVYLQANAVKPVIMDPSGSGTSFDHRWSQETYSHFRRRINVHAAEIKDAYEEGDFDESVKKWQALFGDGFKAPAGSKSSASAGTGKFSAVSSLAAAASVSTVKHAGRAG

SEQ ID NO: 2232 - protein, 338 aa, Rhodococcus fascians
MKHTDYFKNFLENTVNLPQPKVDLLSARVESIYNCLKANPEAKALIKKKIPQGSWPQRTIIKPVNGNAFDGDFMIQMVEEPDWADNLKKYGDTIYNVLHKTSPYKDMPHGRKCRCVYVNYAEDAMHVDIIPFVLRADGTQWIINRDDNTWERTDTDGFTSWMKRQDGIANKRLREVIRIMKFLRDHKNSWTGTRSILLTTLLGERVEEWHKIVDSGYYSDLPTALLHIVSDLDAYLQQYPLKPIITDPSGSGTSFDHRWTQETYSHFRNRINVHAAEIKNAYEETDFDESVKKWQALFGDGFKAPAGSQSSAAGKFSTVASTATASSLSTVKHSGRAG

SEQ ID NO: 2233 - protein, 338 aa, Rhodococcus sp.
MKHTDYFKNFLENTVNLPQPKVDLLSARVESIYNCLKANPEAKALIKKKIPQGSWPQRTIIKPVNGNAFDGDFMIQMVEEPDWADNLKKYGDTIYNVLHNTSPYKDMPHGRKCRCVYVNYAENAMHVDIVPFVLHADGTQWIINRDDNTWERTDTDGFTSWMKKQDGIANKRLREVIRIMKFLRDHKNSWTGTRSILLTTLLGERVEEWHKIVDSGYYSDLPTALLHIVSDLDAYLQQYPLKPIITDPSGSGTSFDHRWTQETYSHFRNRINVHAAEIKNAYEETDFDESVKKWQALFGDGFKAPAGSQSSAAGKFSTVASTATASSLSTVKHSGRAG

SEQ ID NO: 2234 - protein, 341 aa, Brevibacterium linens
MKHNDHFKNFLENTVNLPDSKVNLLRTRVDAIYNCLKNDPDLKPRIKKKVPQGSWPQRTIIKPVNGKAFDGDFMIQMIEEPDWAYDLKKYGDAIYNVLHATSPYKNMPHGRKCRCVYVNYAENAMHVDVVPFVLRDDGTQWIINRDDNKWERTDTDGFTDWMKKKDGIANKRLREVIRIMKFLRDHKNSWTGTKSILLTTLLGERVEEWRKVLDSGYYSDLPTALLHIVSDLDDYLQANPYKPVIMDPSGSGTSFDHRWSQETYSHFRKRINVHAAEIKDAYDETDFDESVKKWQALFGDGFKAPASSESSGPSGAGKFSAVSSATAAASVSTVKHSGRAG

SEQ ID NO: 2235 - protein, 341 aa, Propionibacteriaceae bacterium
MKHTDYFKNFLENTVNLPDSKVNLLSARVDAIYNCLKNDPDLKPRIKKKVPQGSWPQRTIIKPVNGKAFDGDFMIQMIEEPDWAYDLKKYGDAIYNVLHATSPYKNMPHGRKCRCVYVNYAENAMHVDVVPFVLRDDGTQWIINRDDNKWERTDTDGFTDWMKKKDGIANKRLREVIRIMKFLRDHKNSWTGTKSILLTTLLGERVEEWRKVLDSGYYSDLPTTLLHIVSDLDDYLQANPYKPVIMDPSGSGTSFDHRWSQETYSHFRKRINVHAAEIKDAYDETDFDESVKKWQALFGDGFKAPASSGSSGSSGAGKFSAVSSAAAAASVSTVKHSGRAG

SEQ ID NO: 2236 - protein, 341 aa, Glutamicibacter halophytocola
MKHINYFRNFLENTVNLPQSKLDLLSSRVDSIYNCLKADPDVGQVVKKKIPQGSWPQRTIIKPVNGNAFDGDFMIQMTEDPDWAYDLKKYGDAIYRVLHTASPYKNMPHGRKCRCVYVNYAENAMHVDIVPFVVRSDGTQWIINRDNNIWERTDPDGFTEWMKKKDGIASKHLREVIRIMKYLRDHKGSWTGTKSILLTTLLGERVEEWRKVFDTGYYSDLPTALLHIVSDLDEYLQAHPYKPVIMDPSGSGTSFDHRWTQETYAHLRKRIHVHAAEIRDAYHETDLDESVKKWQALFGDGFKPPTSSEDSKSEGIGKFSTVSAVTAATAVSTIKHSGRAG

SEQ ID NO: 2237 - protein, 327 aa, Arthrobacter sp.
MQLEDYFGEFLRKTVNLSQFKLDTLDDRVGKIYRALQNDGLLGERVQGMSKQGSWAHKTIIDPVGDNEFDADFMLYLEDDTSWTPRDYLANVKAALGRSSTYRNMTVERKNRCVRVVYASSCHIDIVPAVSRYEAEYVAYYKDDAWEMTDPQGFTSWMKEKDDIAGGNLRRVIRLIKFLRDHRGSFTGTRSVILTTLLGERVSALKKFSDPGYYKNVPTALVNIIGDLDEFLQANPTKPIIMDPSGSGASFDHRWTQETYAYFRDRIHSHAAEMRAAYDSSDKSDSVSKWQAIFGEEFIAPTSNQSSSPFGSPATALASTGLSGRAG

SEQ ID NO: 2238 - protein, 327 aa, Arthrobacter sp.; identical to SEQ ID NO: 2237

SEQ ID NO: 2239 - protein, 327 aa, Microbacterium yannicii
MQLEDHFGVLLRDTVNLSPFRLNTLDDRVAKIYSALQNDTELGPRVLGMSKQGSWAHRTIINPVGDNEFDADFMLYLKDDTDWSAKDYLTNVKSALMRSSVYGKMPVNRKNRCVRVVYANSCHIDIVPAIERGGLEYVANYEDDNWERTDPKGFTTWMKEKDTITGGNLRRVIRLMKFLRDHRGSFKGTRSVILTTLLGEQVSAFRTFGDSGYYKNVPTTLLHVVSDLDEYLRANPTKPVIMDPSGSGASFDHRWSQKTYANFRDRIHTYAADMDAAYHATDKDDSVSRWQALFGDGFKAPTTSESSTPFGEPKSAPASTSLSGRAG

SEQ ID NO: 2240 - protein, 336 aa, Arthrobacter castelli
MEQVTYFTTFLTGKVNLPPHKLDFLDERVERIFNALKKAELGVRVLGMKKQGSWAQRTIINPKEDEEFDADFMVELEEQEGWSPTDYQTPVFDALNDYCVAQGMTTMPEAKNRCVRVTYANYMHVDVVPYVDRAAGDECIVNTDTNEWEDTDPGGLTRWMRDKDEITNGNMRRVLRILKYLRDHRDYYEDTKSIILTTIVGGVISLDTTRIHPGCYDNIPKTLHRITADLADWVRDMAKRPGIEDPSRAEATFTHRWPQWEYDNFRRDIQYVADLVDDAINCSTSWTDSANKWRNLLGDEFGPADVGHDNKFPAAGAGAGVAGGVETTTGRSGRAG

SEQ ID NO: 2241 - protein, 338 aa, Auraticoccus monumenti
MEHVTHFKNLLKDSVNLPDGKLMTLGDRVDKIYAAIKSADLETSVLSKKRQGSWAQRTIINPPKDVEFDADFMLELEEVTGWSPADYNDAVYQALGNDPVYGQMDKPVEAKNRCIRVSYANDMHVDVVPYVIRADGGEHIINAETDEWEPNNSDGFTAWMKKKDDLTDGNMRRVIRLLKYLREHRGWYEDTVSIILTTVVGTTIKPENLLADSGCYANVPVSFGRIVSDLAQWARDNETRPDVEADQGTTFTHRWTESKYQQFRTDIQDLDTKVAAALAATDEEESLELWRDLFGTGFKAADSSSNASSKFPKIGTGAAVGAGGDGSETSTSRSGKAG

SEQ ID NO: 2242 - protein, 323 aa, Plantibacter elymi
MKLEGHFNALLKDTVNLSLPRLEKMESRAESIYGALQDDSTVGPMVVKKTRQGSWAQGTIINPPAGKDFDADFTLQLELQEGWEPQDYLRAVRRALKDSTIYGEMTLERKNRCVRVVYANAFHVDVVPAVVQGAAEYIANYETNSWELTNPDGFTVWMQEKDATAQSNLRRVIRLMKYVRHHRGFTGVRSIILTTLLGEQVEASRKFADPGYYQDLPTAFTHLICDLDDYIWPQIEQPSVADPSGTGLTFDHRWLPGTYSNFRSRLHSIAETTRAAFASSNRDESEELWREIFGDRFTDGSKKTDPRPFAPTVTPGYVPGRAG

SEQ ID NO: 2243 - protein, 328 aa, Actinobacteria bacterium
MQFADDFNSFLKDVVNLPQGRLDQLGGRVDVLYGAIKKDSTYGALVTGKIPQGSWAHRTIIKPKDGLEYDADFLLCVDENDDWAGDKAQYIEKLYWALGGAGYQGKCTRKTRCVRVQYANDSHIDIVPYVDTSIGQRIVNKSTGEWEDTNPEGFTDWMKKRDDWTSKNFRKVVRLMKYIRDNHGGFQGTRSIILTTLLGQRVNQVTSIIDPSAYGDVPKALEKIVSDLDDWLWPLTSMPTVEDPSSPGTSFNHRWSEESFQHFQRRVHTISSEITDALKEEDRDESARKWRIVLGDKFKSTSGESKSSSPFISTAAAGASLGRSGRAG

SEQ ID NO: 2244 - protein, 330 aa, Nocardiopsis dassonvillei
MQLTKYFNTLLRDTVNLPKGRLDELAGRVESIYTVLKNDDVLSELVTGKTPQGSWAHRTIIKPEPGKEYDADVLIHMDENPGWADNRGRYIGELYSALGRGGYEDRHRMTRCVRVQYANDCHVDLVPYVQTASGQRIVNRKTGEWEDTNPEGFTAWMAERDRITHGNFRKVVRLMKYLRDHRKSFTGTRSIILMTLLGNRVDTWAEIQSPDAYKTVPKTLVTLVEALDAWMQAQYTMPDVEDPSSPGTLFNHRWSPESYEYFKKRINAHAKEMRNALDDTDPAASAEQWQALFGDGFKTDAAKTESASPFLLGGGAASLGASSGRSGRAG

SEQ ID NO: 2245 - protein, 446 aa, Streptomyces sp.
MKLNGHFTTLLKDTVNLNQTRLDQLDSRVTAIMNFLTGDPDLGSLILGTTRQGSWAHRTIIKPVAGKKDEFDADFLLNLTVVEAWATTPSEYLNALYAALKRSSTYKSMVVKKNRCVRINYAGDCHVDIVPHLVLSDSRQVIVNSEVEEFEETNPEGYTAWMKEKDSLTGGNLRKVIRLVKYLRDSKDTFSVPSVILTALLGERVQVYDTGNRYSGVPTSLVHLIEDLAAWLALNPLMPVIADPSCLQTSFNHRWDQDRYTNFAKHIQSYATRMRTALDEQDKDRSVKLWQALFGDGFRAPATTTAASLTKAEQPASVEARAPSEEFIEEMGVRLVGGRRARIEARVANPIGSGSADLRRTGFAPVGRDIYFTVTTDAPQPYEIWWKVRNHGPDAENAHGLRGQITPTRGARIHERTKYRGRHYVEVWIVKDGKVVASDHHDVVIR

SEQ ID NO: 2246 - protein, 308 aa, Streptomyces sp.
MKLNGHFNTLLKGTVNLNQTRLDQLDTRVTAILNFLTSDSVIGPLILGTTRQGSWAHRTIIKPVAGKNDEFDADFLLNLTVVEAWETTPSEYLKALFAALKRSNTYKSMVVKKNRCVRINYAGDCHVDIVPHLVLPDGRQVIVNSEVEEFEETNPEGYTAWMKEKDSLTGGNLRKVIRLVKYLRDSKDTFSIPSVILTALLGERVQVYDTSNRYSGVPTTLVHLIEDLAAWLSLNPLMPVIADPSCPQTSFNHRWDQDRYANFAKHIQSYATRMRTALDEQDKDKSVKLWQELFGDGFRTPATTAAAS

SEQ ID NO: 2247 - protein, 318 aa, Streptomyces xinghaiensis
MKLNGHFDTLLKGTVNLNQTRLDQLDTRVTAILNFLASDSVIGPLILGTTRQGSWAHRTIIKPVAGKNDEFDADFLLNLTVVEAWETTPSEYLNTLFAALKRSNTYKSMVVKKNRCVRINYAGDCHVDIVPHLILPDGRQVIVNSEVEEFEETNPEGYTAWMKEKDSLTGGNLRKVIRLVKYLRDSKDTFRIPSVILTALLGERVQVYDTGNRYSGVPTTLVDLIEDLAAWLALNPLMPVIVDPSCPQTSFNHRWDQDRYANFAKHIQSYATRMRRALDEQDKDKSVKLWQQLFGDGFRSPATTAAASLAKAGQPTSA

SEQ ID NO: 2248 - protein, 287 aa, Salinispora tropica
MKLHDHFAGLLQTAVNINPDRLRQLDSHVVALSEQLREDSALSPMILGFVPQGSWAHRTIIKPQPGQEFDADLLVRMRKQRSWSTDPQRYLTAVYEALGKSGRYRDRVVMKTRCVRVSYAGECHVDLVPYIHEDMYSWFVERHIVNRKENRFEEVNPTGFSKWMLGRDRVAHGNLRKTLRLLKYLRDYKGTFEVPSVILTVLVGGQVSSLLSFWDDRYRDLPTAFNALVRATDGWLQARPSLPRLPDPSAVTTNVRGVGRHAVRLVGRAVSLRSGCGGGRTCSCSAA

SEQ ID NO: 2249 - protein, 299 aa, Streptomyces griseus
MKLLTYFSAFLADTVNLNQTRLDQLNDRVNSITSTLKSDSQIGDLYRTHIPQGSWAHRTIIKPFNNHEFDADFLLHMDEVEDWKPKDYLREVRAAFKRSTTYKSKVTKKNRCCRIVYAGDCHVDVVPYITLADGREVIVNYAENEFEDTNPQGFTDWMKEKDSLANGQLRRVIRLLKYVRDFKQTFSVPSVILTTLLGERIQAWHEAMRYSDTPTALKTILADLSAWLDLYPLMPPLADPSCPETTFNHRWNQDQYENFRKKIKLYSSWVTEAYDEEDKALSLAAWQRVFGNSFQQPSS

SEQ ID NO: 2250 - protein, 273 aa, Streptomyces sp.
MKLLAYFSAFLADTVNLNQTRLDQLNDRVNAITSTLKSDSQIGDLYKTHIPQGSWAHRTIIKPFNNHEFDADFLLHMDEVEDWKPKDYFREVRAAFKRSTTYKSKVTKKNRCCRIVYAGDCHVDVVPYITLSDGREVIVNYAENEFEDTNPQGFTDWMKEKDSLANGQLRRVIRLLKYIRDFKQTFSVPSVILTTLLGERIQAWHEATRYSDTPTALKTILADLSAWLDLYPLMPPLTDPSCPETTFNHRWNQGQYENFRKKINLYSSWVTEA

SEQ ID NO: 2251 - protein, 443 aa, Cellulosimicrobium cellulans
MKLTGYFKAFLENTVNLNQARLDQLDQRVAAIVKVLEDDTELGERVQEHIPQGSWAHKTILKPLNNHEFDADILLRLDEVPEWTEQQYLREVRAALKRSTTYKDMVRKKNRCVRVGYANDCHVDVVPHVHLADGRQVIVNYAEEKFEDTNPEGFTAWMKERDTLAHGNLRKVLRLLKYLRDYKQTFSVPSVILTTILGERVTAWEADERYVDVPTALKNMLADLDSWLQLHPTMPLLEDPSCPGTSFNHRWDQKQYENFRNKVTQYSTWVTEAYDETDKNKSITAWQRVFGSDFKAPVATAATASAAPAVTEAAVLLPRAPKEEYIEDRYPPASTGYTVRVTATVLKKDGFRAGPLRGFRSIGKQRTLKFDAATDVPRPFDLYWKIRNTGSEAGQNLRGELIRDGGYLTRTETTQYKGRHYVEAYVVKNGKVVARDRHDVIID

SEQ ID NO: 2252 - protein, 442 aa, Friedmanniella flava
MNLTGYFKAFLDNTVDLNQTRLDQLDSRVASIVNVLENDSELGEHVREHIRQGSWAHRTIIKPLNNHEFDADILLRLDEEQEWDEQQYLDEVWAALRRSSMYRHMVKKKNRCVRVVYAGDCHVDVVPHVHLADGRQVIVNYEEAVFEETNPEGFTAWMKERDTLAHRNLRKVLRLLKYLRDYKQTFSVPSIILTLLVAERVTAWDADERYKDVPTALKNLLDDLDTWLQMYPTMPTLEDPSCPGTTFNHRWDQAQYENFRTKIARYSGWVTEAYDETDKQKSITAWKRVFGDAFKAPAALSAALSSARTDEAPVLLPRAPKEQYIEERGYEMVLSHKAQITAMVLKKDGFRSGPLRRLGSVGKHRRVRFSVTTDVPGPVDVFWKVRNVGPEAAHQLRGEISKDDGSLSRTEPTMYRGRHYVEVYIVKNDRVLAMDRHDVPIS

SEQ ID NO: 2253 - protein, 453 aa, Plantactinospora sp.
MKLHAYFAGLLTDTVNLSQERLDLLHSRVSSIVNCIKADEQLKDLYIDHIPQGSWPHRTIITPLPGKEFDADFLLHLQEVPEWTADPGEYIRQVRAAFKRSFVYKDMVRKKNRCVRIGYVNDCHVDVVPHIVLTDGRQVIVNYKDNQFEDTNPGGFTSWMHEKDDLANRYLRVVLRLLKYLRDYKKTFSVPSVILTTLLGERVQAWNVDDLYPDLPTAFVNLLIALDTWLAWHSTMPIITDPSCPGTTFNHRWDDDKYTNFAKWISYYRAKAEAALKEDDKDKSITLWREIFGDAFAKSSTQAAAKEAVALSGAPLATKVFVRLSRAPGEQFIEELGYPLRPTYAARINATVRDLNGFRPGTPLRSVRHTRKRMSIDFRLSTDCPEPYDLWWKVRNTGEEATDADCLRGTIVKDGGLRRRTESTLYRGTHYVEVYLIKDGIVVATDHHDVHIA

SEQ ID NO: 2254 - protein, 440 aa, Brevibacterium aurantiacum
MKLIAYHEAFLKDTVNLNRSRLSQLGNRVSSIVSALEKDDEVGEIFVRHIPQGSWAHNTIIKPLNKHEFDADILVELEEHADWSERDYITAVRDAFKRSATYKPLVRKKNRCVRIGYNNDCHVDVVPYIKLSDGRQVIVNWAEEKFEDTNPDQFTAWMKEHDDFALKNLRKVLRLLKYLRDYKQTFTIPSVILTLLVAERVTSWDADQRYKDVPTALKNMLNDLDQWLDLYPLMPWLEDPSCPGTYFNHRWNEDQYKSFKNRVKKYAAWVNEAYDEPDKATSLTAWQRVFGNGFKAPAVALSAAASESAPPTPVRLERAPNEQFIEEFGFAINLTHAAHIDATALMDGWRKSDLRRLRWLARNCQLDFEVTTDVQEPYDVYWKVRNVGVAEHRLRGEITADDGRRTKQENTLYPGRHYVEAYIVKDGQVRAMDRHGVPIE

SEQ ID NO: 2255 - protein, 450 aa, Arthrobacter sp.
MDINAHFVAFLDTTVNLKQWKLDKLDGHVTAIVSALQKDTEVGPLYKEHIPQGSWAHATIIEPVGAFDQFDADFLLHLEEDEAWSEDPGEYLRKVRAAFKATSTYKDKVTKKNRCVRIEYAGDCHVDVVPHLTLSDGRQVIINYAENTFEETNPGGFSDWMQERDTLTGGNLRKVIRLMKYLRDYKNTFDCVSVILTTLLGGRVQAFNADSRYVDIPTAFVSLLEDLDSWLTEYDEMPLLDDPSCPGTSFNHQWTEEKYQNFRAMITKYAGWAREAINAEEDKALVAWQKLFGPEFTTPVVEAARKAIATSPIRASTRPPAARAPQEEFIEEKGYRFSARHMARIEGRVEELGGFRSRPIRSRKFVRRGMSLVFSLHTDTPGQFEVIWKVRNHGEAATLAGNLRGQLLKSDFNSRIRRETTRYPGRHYIEVYVVKDGVVVASDHHEVVIE

SEQ ID NO: 2256 - protein, 462 aa, Mycobacterium aromaticivorans
MPTDFDAHFTAFLESTVNLKQHRLDQLDARVSAITNAFKKDAQMGSLYKEHLPQGSWAHRTIIDPVTEYDEFDADILLHLENVPEWNDNPKMYLQQVRAAFKRTSQYKDKLKRKNRCVRISYANDCHVDVVPAITLENGNQAIIFYRDNVFEDTNPVGFADWMKERDDISGGQLRRVIRLLKWLRDFKNTFTCPSVILTVMLGGRVQFWDPQTAYSDTPTALVHLLEALHTWLDAYLGSPPLDDPSCPGVSFSHRWDDPTIIANFKSKIADYARWAREAYDLQGVDDAAALTAWQKLFGPEFAADEVKAARNDIVAAKVTRELAARVTVLPPAEIAPDEEFIHDRYPVSAPRYSANIEATIINLPRNNFLRKRRVVAKSRELQFNLRTDTPEPYEVLWKVRNHGPEAARVPGGLRGQIRIGGNKTRNVHNESTLYRGSHYVEAYVVKDDMVVASDHHTVTIE

SEQ ID NO: 2257 - protein, 462 aa, Mycobacterium sp.
MPTDFDAHFHAFLQTTVNLKPYRLDQLDARVAAITNAFKRDGEMGGRYKEHLPQGSWAHRTIINPVTAYDEFDADILLHLENVPEWNDNPKMYLQQVRAAFKRSSQYKDKLERKNRCVRVSYANDCHVDVVPAVTLENGNQAIICYRDNVFEDTNPIGFADWMKERDDISGGQLRRVIRLLKWLRDFKNTFSCPSVILTVMLGGRIQFWDTQSAYSDIPTALVHLLEALDAWLATYAGSPPLDDPSCPGVSFSHRWDDPIIIANFKSKISDYARWAREAYDLQGVDDAAALTAWQKLFGPEFAADEVKATRNDIVAAKVSRDLAARVAVLSPADIAPDEEFVQDRYPVGAPRYSATIEARVMDLPRSTFLRKRRVVAKSRQLQFRLHTDAPEPYKVLWKVRNHGTEAARVPGGLRGQIRVGGNKDRNTHTESTLYRGCHYVEAYVIRDGVVVASDHHTVTIE

SEQ ID NO: 2258 - protein, 462 aa, Mycobacterium sp.
MPTDFDAHFHAFLQTTVNLKPYRPDQLDARVAAITNAFKRDGEMGGRYKEHLPQGSWAHRTIINPVTAYDEFDADILLHLENVPEWNDNPKMYLQQVRAAFKRSSQYKDKLERKNRCVRVSYANDCHVDVVPAVTLENGNQAIICYRDNVFEDTNPIGFADWMKERDDISGGQLRRVIRLLKWLRDFKNTFSCPSVILTVMLGGRIQFWDTQSAYSDIPTALVHLLEALDAWLATYAGSPPLDDPSCPGVSFSHRWDDPIIIANFKSKISDYARWAREAYDLQGVDDAAALTAWQKLFGPEFAADEVKATRNDIVAAKVSRDLAARVAVLSPADIAPDEEFVQDRYPVGAPRYSATIEARVMDLPRSTFLRKRRVVAKSRQLQFRLHTDAPEPYKVLWKVRNHGTEAARVPGGLRGQIRVGGNKDRNTHTESTLYRGCHYVEAYVIRDGVVVASDHHTVTIE

SEQ ID NO: 2259 - protein, 462 aa, Auraticoccus monumenti
MTVDFDAHFHAFLTSTVNLKPYKLTQLDGRVTAITDAFKKDATVGHMYKEHTPQGSWAHETIINPVSSYDEFDADILLHLEQNLDWTEDPKTYLQQVRAAFKRNTTYKDKVVRKNRCVRIQYANDCHVDVVPSITLDDGREVIVYYADNDFEDTNPVGFADWMKERDDVTDGELRRVIRLFKWLRDYKNTFSCPSVILTVMLGTRVQWWNADTEYADIPTALVNLLEALDLWLAGHPTMPLLDDPSCPGLSFNHRWDEDKYSTFKKKVSDYATIAREAYDLQGDDDAAALKTWQKMFGPEFAASAVTEARTALVTENIVASLSGKTLEHASAHNDVAPHEEFITNKYRDVQLRYTAQIDARVPGSRRSALLRRSRVVGVSRSVIFHLKTDAPEPYEVLWKVRNRGVEAERVGQLRGEIRTGGNVTRNQHRESTSYRGIHYVEAYVVRNGVVVASDHHEVKIV

SEQ ID NO: 2260 - protein, 455 aa, Unknown
  Description of Unknown: Rhodococcus sequence
MTIDFDTHFHAFLTNSVNLKPHKLIQLEGRVAAITNAFQNDGTVGHMYKEHTPQGSWAHETIINPVGAFDEFDADILLHLEQNPDWNDNPKAYLQQVRAAFKRNTTYKDKIQRKNRCVRIQYANDCHVDVVPSITLDDGREAIIYYRDNEFEETNPVGFADWMKERDDITDGQLRRVIRLFKWLRDFKNTFSCPSVILTVMLGNRVQWWNSNEEYQDIPTALVNLLEALKLWLDGHLTMPLLDDPSCPGLSFNHRWDEDKYANFKQKVSDYAAISREAYDLQGDDDAAALKAWQKMFGPEFAASEVTEARTALAASMSGKSLTSTIDDIAPHEEFITSKYGHVELRYTAQIDARIPGSRRSELLRRSRVVGRRRSIKFHLKTDAPEPYDVLWKVRNRGVEAERLGKLRGEIRYGGNESRNLHQEYTEYRGTHYVEAYVVRNGMVVASDHHEVKIV

SEQ ID NO: 2261 - protein, 457 aa, Rhodococcus wratislaviensis
MKLTKYFGRFLTETVNINASRLGYLDSRVGSITDALKTSAALDGRVLDTIPQGSWAHKTIIRPSSGLEFDADFLVQVSEDTAWNDNPRRYANAVWSALSGHSVYGSMSKQKTRCVCVTYANDCHIDIVPYVVLASGREVIINRKTNEFEDTNPLGYSGWIQEKDKLTNGNLRKVIRLLKYLRDHQGVFSLKSVLLTTMIGNIAEGWRQYDPNYYKDVPTTLLHLVDDLDRWLQAQWSRPTIVDPSCPQTNFNERWTDPQFVAFRDKIHALAPKIRAAYETESVAESIEAWRKVFGPSFPDSVATATTASAAVSSSPPTLGPVSSDQRAPNEQFIEELFPVRETYSIEIICEVSPPRNINRAQRRALQQRAGHVPKQRDLYFAVSGTNVPAPFDIYWKVRNHGAEAESERALRGEITKDAGQHRKQESTLYAGQHYVECYVVKDGICLARAREPVIIP

SEQ ID NO: 2262 - protein, 457 aa, Rhodococcus wratislaviensis; identical to SEQ ID NO: 2261

SEQ ID NO: 2263 - protein, 457 aa, Nocardia amikacinitolerans
MKLVAYFNKFLNDTVNIDSTRLGYLDQRVDSITEALKTSSALDGRVLDTIPQGSWAHRTIIRPPTGLEFDADFLVHLSEDTDWNDNPRRYANAIWNALSGHSTYGSMAKKKDRCSRVIYANDCHIDIVTYVILSDGREVIVNSKCNEFEDTNPIGFSEWIQEKDSLTKGNLRKVLRLLKHLRDHQDSFNLKSVLLTTLVGNIVDGWRTAGDDYYKDVPTTLLHLVGDLNKWLGYQAGKPYIVDPSCPTTSFDHRWTESEFESFRDKFNEIAIKVHDAYHVSTVKESIEYWREVFGNSFPDSATTSTTASAGTALPRPSTLKSSRDRRAPKEQFIEEMFPVSEIFSLRIDCEVSEPAHINRRERRQLRARAGHVPKQHSLRFYMVETSVPKPFDMYWKVRNYGTEAEARHQLRGEIIKDSGSLTRTESTSYAGHHYVECYIVKDGVCVARANQPVIIN

SEQ ID NO: 2264 - protein, 451 aa, Arthrobacter sp.
MKLTQYFGKMLIDTVNLNASRLGDLDTRVVRVTEALKAAGSLDGRVLDTVPQGSWAHETIIRPAAGFEFDADFLVQLSEDEAWNENPRSYANAVYTALSDHTIYGGMSSKKDRCVRVTYANDCHIDIITYVVMANGRQVIVNRNTNQFEDTNPVGFSEWIQEKDRLTNRNLRKAIRLLKYLRDHQDAFKLKSVLLTTMVGNIVDSWRDLDGDYYKDVPTTLLHLVEDLDLWLQAQWTKPHLADPSCPATSFNHRWTDSQFAAFRDSIHKLAPKIREAFEASTLGDSIAAWRRVFGPAFPESVVTAVPVSASAAVTSSTGRRAPKERFIEEMFPVQLTDSVSVRCDVSPPRELNRVQRRALRAGAGIVPKQRDLHFAVEETTVEGRFDVYWKVRNSGFEAEKQQSLRGEITRDAGQRRKKESTLYAGSHYVECYVIKNGICVARSREPVVII

SEQ ID NO: 2265 - protein, 155 aa, Butyrivibrio sp.
MSSKVTKNNHPMDVDTISLISKRYKTITKAVNEDFWNSSSETSHSRYVGSYGRGTAIGTSDLDVLFELPNEEYDHFTSLNGNGPSRLLQAVKNAILDTYPKTDVKGDGQVVVVKFSDGMKFEILPAFRNLDWFENWDGTYTYPVDCQVKLTHFYT

SEQ ID NO: 2266 - protein, 471 aa, Janthinobacterium sp.
MMGKAASLFNGAGRQSLISRVTPTGEQRDFLQMQWNALAKHLRVTLTEKSGLPVHTWLQGSYKYGTLIRPVHAEDEYDVDVGVYFEWRDSSMGKTAHELRAMVQCEVLAYQATCTDILKVEAPPKERCSRAIYSSRFHIDLPVYHFEPRKGKRRLACLSGEWEESDAKAFHLWFKQAFDADNRELVRRLVRYLKAWVSIVFQNAPAARPSSIFLTVLVAQAFESVRWKYWGVPADDDALIAVVKRMFGRLSESPLVACPIDKRENLNRIPLDAWSAFMIRLRCLRDAVERAEQAMDEINAALAWSEAFSFLMPIPSVASVEFLEEGSISPLLPVPDIDIEIMTPSGRKAARSHRNSIPSVSIGSALHLAIARPSELPDHATVEWLVRYADVGISGAAVLGEREIGVRATTKKMVMQRVGLHQISSVIRVNGRVYATRNVQVLVLNKGEEQSASLPKLEDIRCMIKRKLNLI

SEQ ID NO: 2267 - protein, 129 aa, Parapedobacter composti
MADCNNLFRRYHGEISIGSAKNNKMKDSKEGLRKRIRKWFSENHPDYKPYFYIQGSYKMKNGIRTSEDICDLDDGIYFFREPDVSASTIKEWVRQAVDGYTDTPPENRKKCVRSIFAGDYEIDHPVYLK

SEQ ID NO: 2268 - protein, 180 aa, Nonlabens ulvanivorans
MCNCNKLMLDYESKITVPAAKKKKIQDSKDVLRKRIVDYFKGNHPDYKPKFAIQGSYIMKTTIVTKDEECDLDDGVYFLRDVDVTATTLQKWVKNALDGATTEPVQHRSKCLRVDYKADYHIDFPVYIFPEDDDHPSIAIKDTGFEESDPKEVKDWYAKKKKRKYSIKQNSKGTERMVRS

SEQ ID NO: 2269 - protein, 384 aa, Luteibacter sp.
MRKFHKLLHSDGALYEKLLPTNEQEKALREAKNTIKQALITGIKHAATRELRMEKEVEPRFRTQGSWAYVACVQPARQPPQEMDWDYGVYLPVTMMEDKATPKVAAKAYFDVVEGLLTQLAKREGWTMGKPKDRCVRVHVANWAHVDVALYAAPEDEFAKVNDRLVEAKAYTADHAASVSLERYAEIEVEQSWDDFEGMMLAKRDGEWEHSDAEKIAGWFRFQKETHGDQLQRTWRYMKAWRDQQWAEGGPSSVCLMLVATQHYEKHFGRDDLALIHISKHLPHALAHDITEDGIDPGHNFNRMTADEREDARKRAQIFADELTKARTNVVQPKSAVVTGLRALWGNRVPDREQDLEPESPAQQVRDTPARTVVAPAVTSSYAG

SEQ ID NO: 2270 - protein, 260 aa, Pseudomonas rhodesiae
MLKLNKLFHKGGADANVFEDRIAPTREQRKFLMECKNKVREHFEATHSCSYKNYFSMEHVVEPRFRTQGSWSYNTCVVPAKSPAQEMDWDYGVYLPVTVWEENGPPHQMAKAYFSLVEELLKDLCKAEKWDLITGKKTCIRIQIADWAHIDLPLYAAPEEEFQTITERVSLEKAMLDGMEQLATARAMDESYELQQWKDLDHIAMATRSGEWRESDPEAVANWFRIASKSMANNYGEYLATSRLGGTCIGIAGVQHPSRL

SEQ ID NO: 2271 - protein, 390 aa, Burkholderia gladioli
MLKLHRLLYSSVQTGTFADNIAVSSEQRRFLVSCKNKIRDYLRPAIEKVSTTVLGMDRQVTPRFRTQGSWAYGTCVHPCTLPPQEMDWDFGIYLPVTVWEENGPPIQMAKAYFTLVERLLKELCDDEGWTLDKSKGTCIRVNVSAWAHIDVPLYAASEAEFKKVYEVRVAAAVRKAYAMDSAGFAESVNLGDLVGQSWDEMEGIVLATRSGEWVASDPNDVAKWFLDRIEEHGAQLQRVCRFLKAWRDYRWDNKGPTSVSIMIAVAQNFEPVPARDDLALERAALALAKALLADIREPGIDNGADDFNRLEADERLEASTLAQELADSLKHAREHSVVQASRVITILQAQLGDRLPNQPGWIDVDSSGDDIRRVPAVTVPPPVVGATSAG

SEQ ID NO: 2272 - protein, 390 aa, Burkholderia gladioli; identical to SEQ ID NO: 2271

SEQ ID NO: 2273 - protein, 390 aa, Burkholderia vietnamiensis
MLKLHRLFYSSVQSGTFADNVAVSPEQRRFLVSCKNKIRDHLRPAIEKVSTTVLGMERQVTPRFRTQGSWAYGTCVHPCTLPPQEMDWDFGIYLPVTVWEENGPPIHMAKAYFTLVERLLKELCGDEGWTLDKSKGTCIRVNVSAWAHIDVPLYAASEAEFKKVYEVRVAAAVRKAFAMDSADFAESANLGDLVGQSWDEMEGIVLATRSGEWVASDPNDVAKWFLDRIEEHGVQLQRVCRFLKAWRDYRWDKKGPTSVSIMIAVAQNFEPVPSRDDLALERAALALAKALLTDIREPGIDNGADDFNRLDADERLEASRLAQELADSLKHAREHSVAQATRVIMILQAQLGDRLPNQPGWIDVDSSGDDIRRVPAVTVPPPVVGATSAG

SEQ ID NO: 2274 - protein, 393 aa, Ralstonia pickettii
MLKLNRLLHSSVKNGTFGHNITVSPEQRKFLVSCKNKIREHLRPAIEKVSTTTLGMDRQVTPRFRTQGSWAYETCVHPCTLPPQEIDWDYGVYLPITVWEENGPPIDMAQAYFALVEQLLKDLCKNEGWTLDTSKDTCIRINVAAWAHIDVPLYAASEEEFKKVTEVRLVEAAALRKGFANDSANFAEDAAFGDLVGQTWDEMEGIVLATRSGEWIPSDPNDVAKWFKDRVQEHGPQLLRVCRFLKAWRDYRWAEKGPTSVSIMIAVAQSFTPVSGRDDLALELAAHSLAKALLADIREPGIDNGEDDFNKRLSEKERLEASALAQALANSMREAREQNLVQAERAILILQGQLGNRLPNQPSWVDADSSGEDIRRVPAASVPPPVVPATNAG

SEQ ID NO: 2275 - protein, 392 aa, Ralstonia solanacearum
MLKLNRLLHSPVKNGTFGDNIAVLPGQRKFLVSCKNKIRDHLRPAIEKVSTTTLGMDRQVTPRFRTQGSWAYGTCVHPCTLPPQEIDWDFGVYLPITVWQENGPPVHMAKAYFALVEQLLLGLCKSEGWTLDTSKDTCIRVNVADWAHIDVPLYAASEAEFKKVNEVMLKAADVRRSFAMDSADFAENSMFGDLVGQSWDEMEGIFLATRSGEWRPSDPNDVAKWFKDRLEEHGEQLQRVCRFLKAWRDYRWAEKGPSSVSIMIAVAQNFEPVSGRDDLALEHAAHSLAEALLADIREPGIDNGKDDFNERLNEEERLEASALAQALANSIREAREHNLVQASRAIMILQGQLGDRLPNQPSWVEVDSSGDDIRRVPAAPVPPPVVPATNAG

SEQ ID NO: 2276 - protein, 388 aa, Burkholderia pseudomallei
MLKLNKLFFALGTSETFVDKILPTPDERHSLLKAKNSISAFLREGIRNATVTALGMDRPVTPRFRTQGSWRYDTCVRPAHNPPQEMDWDLGVYLPTTVWEENGPPQAMSKAYFTLVEGLLEKLCANNGWTLDKTKKTCSRVRISPSAHIDVPLYAAAEDKFVKIIEKHATLSKSVALESARADSQMAMDSIDEQTWDELEGVVLANRTGEWIRSDPNDVAKWFENHIHEHGPQLRRVSRYVKAWRDHQWPEGGPSSVAMMVVVARNFEKFDGRDDIALERAAMHLSTELRYDVRENGIDDEVANFNKLGESERDEASRRASLLGQAIRAARGHNIAQKQVAIATLTTYLGPRIPDRPDWIDADSGADDVRRTPAKPVPPPPVGATSAG

SEQ ID NO: 2277 - protein, 388 aa, Burkholderia pseudomallei
MLKLNKLFFALGTSETFVDKILPTPDERHSLLKAKNSISAFLREGIRNATVTALGMDRPVTPRFRTQGSWRYDTCVRPAHNPPQEMDWDLGVYLPTTVWEENGPPEAMSKAYFTLVEGLLEKLCANNGWTLDKTKKTCSRVRISPSAHIDVPLYAAAEDKFVKIIEKHATLSKSVALESARADSQMAMDSIDEQTWDELEGVVLANRTGEWIRSDPNDVAKWFENHIHEHGPQLRRVSRYVKAWRDHQWPEGGPSSVAMMVVVARNFEKFDGRDDIALERAAMHLSTELRYDVRENGIDDEVANFNKLGESERDEASRRASLLGQAIRAARGHNIAQKQVAIATLTTYLGPRIPDRPDWIDADSGADDVRRTPAKPVPPPPVGATSAG

SEQ ID NO: 2278 - protein, 390 aa, Comamonas testosteroni
MLKLNRLLFVTSEDEVFSDQIKPTKEQREVLVSAKNDIRDHLRPRIRAATIAVLGMNKAVTPRFRTQGSWSYKTCVQPVWNPPQEMDWDFGVYLPVTVWVDGGPPRAMAKLYFELVEGLLTDLCKEKGWTLSTEKDTCIRIQLNRWAHIDVPLYAAPEDEFLQIIEKASLTASDGHNARADLVINFDEADFSQQQWEDMVDIMMATRGGEWKASDPEAVSKWFLDRVLEHTEQLRRVCRYLKAWRDLHWRNGDGPTSVCIMVAVAQAFKPHTDRDDIALENAARTLATALRGDVYERAIDGGSEDFNKRLNASQREAAGSKAAILAGQLRTARLKSTHLVGDAIALLQEQLGTRVPYRPDLVRPDSGEESIRLVGAERVARPVVKSTSAG

SEQ ID NO: 2279 - protein, 390 aa, Comamonas testosteroni; identical to SEQ ID NO: 2278

SEQ ID NO: 2280 - protein, 389 aa, Unknown
  Description of Unknown: Acidovorax sequence
MLKLNRLLFATAEEVFINSIEPTKDQRRVLVEAKNEIRDHLRPRIREATIKALGMDKAVTPRFRTQGSWSYQTCVQPAWHPPQEMDWDFGVYLPVSVWEESGPPHAMAQLYFKLVEGLLKDLCKEKGWKLYSGKDTCIRVQINAWAHIDIPLYAAPEAQFAQIVEKRVFDAAAKSDAREALAAEFAEEDFTLQQWEDMVDIMMATRSGEWKPSDPEEVSRWFLDRVEEHTEQLQRVCRYLKAWRDLHWKAGDGPTSVCIMIAVAQAFEPKRGRDDVALERSARALSIALKGNVHEPAIAEGKEDFNKRLDANGRQHASTLAATLASQIQAARMKASHLAGDAIDILRAQLGSRVPYRTDLVEPDSGDDVVRLVGADRVSRPVVNSTSAG

SEQ ID NO: 2281 - protein, 390 aa, Burkholderiales bacterium
MLKLNRLLFATSETDVFIDRLAPTPHQRETLVQAKNDIRDHLRPRIRAATVAVLGMDKAVDPKFRTQGSWSYRTCIQPAWQPPQEMDWDFGVYLPVTVWEDNGPPHKMAKLYFTLVERLLADLCTDKGWELIKGKDTCIRIQINNWAHIDIPLYAAPEEEFATILEKSFSAQLTLDSARGALVENAAFGEIAEQEWADLDHIVMATRSGEWKSSDPEAVSKWFLDRVKEHTDQLRRVCCYLKAWRDLHWKAGDGPTSVCIMVAVAQKFEAIRGRDDLALEAASRTLANALRGDIRAPGIDEGKEDFNKRLNPAQREEASAMASTLAQQIQAARLKPVHTPGDAIDIIQSQLGLRIPMRTDLVEPDSGNDAVRSVPAREVSRPIVRATTAG

SEQ ID NO: 2282 - protein, 396 aa, Unknown
  Description of Unknown: Methylomonas sequence
MLKLNKLFFYADEKDVFNEVIRPSQEQRDYLVSCKNDIRDHLRPRIKEATRKILNMDKSVEPRFRTQGSWSYKTCIQPAYSPHQEMDWDYGVYLPVAVWEQNGPPHAMAKLYFDLVERLLYDLCKSKGWELQTGKSTCIRIQVANWAHIDIPLYAAPEHKFNEIVEKSLALLSIDNRGRSMVHDSAFLSESAEFGEIPEQVWEDLDDIMMATRSGEWKASDPEAVSRWFNDRVEEHGEQLRRVCCYLKAWRDYHWKDGGGPTSVSIMIAIAQAFKPNRGRDDLVLESSAEHLSNVILGEIREFGIDEGAEDFNNRLSNVEKTLAAQRAKQFVQAIRMARSYEWHMKHQAITELQNKLGERIPYKHDWVEVDNGADEVRTTPPQRVSQPVVRRTKAG

SEQ ID NO: 2283 - protein, 392 aa, Dechloromonas agitata
MLKLNKLFYATDEQDVFSDRIEPAPGQKKFLIDCKNEIRDHLRPRIREATTAILGMDAAVSPRFRTQGSWSYNTCVQPASLPPQEIDWDFGVYLPVHVWEENGPPHEMAKAYFVLVEQLLEDLCRKNGWKLISGKATCIRVQVAFWAHIDIPLYAAPEHKFVQVMEKAALSARSGTVAMDSMWMSESVDFSEMPEQVWEDLDDIVMATRSGEWKFSDPEAVSRWFKDKVLEHTEQLRRVCRYLKAWRDHHWRDGGGPTSVSIMIAVAQTFEPQRGRDDLALEKAARILAAAIPKELREPGIDGGSEDFNSRLSPEEKAIASRKAEALAEALQQARIRAVHQKSEAITHVQAHLGERIPNRPDLVEADSGAESIRSVPARQVVPPVVPATSAG

SEQ ID NO: 2284 - protein, 388 aa, Ramlibacter tataouinensis
MLKLNKLLYYTAPDLVFSDEIAPTDDQRKDLAEAKNAIRDHLREGIAQASVTVLEMPRRIEPRFRTQGSWSYNTCVQPYAMPPQEMDWDFGVYLPVELWEAGGPPHKMAKAYFELVERLLQSLCKAKGWKLVPGKDTCIRVQIAPWAHIDVPLYAAPAAKFVRIRERALAKSATTASVHDSARLLESIDFGEYAEQAWEELDEIVMACRSGQWIKSDPEIVARWFNDKVLLHTEQLRRVCRYAKAWRDKWWTKGGPSSVCLMIAIAQKFEPKSGRDDLALEQAMRTLAGALAGPVRESVIGAEDFNRLDAAERAAATQRASETAEAMQKARMRREDDKQAAVQQLRGELGERVPMRTDLVDADTVAAQVLAVAPAKVAAPVVRATSAG

SEQ ID NO: 2285 - protein, 390 aa, Polaromonas sp.
MLKLNKLLYLSTDRQVFSDEIEPTPDQRDELAQAKNDIRDHLRSGIAAATVSLLGMPRQVEPRFRTQGSWSYKTCVQPPYMPPQEMDWDFGVYLPVEVWEEKGPPHAMAKAYFLLVEGLLKKLCEEKKWALLPGKATCIRVKIASWGHIDVPLYAAPAEQFAQIRERAMNKSWSSSVHDSAALSESVEFGELPQQLWEDLDCVMLATRSGEWIPSDPEHVSRWFNDRVEQHSEQLRRICRYAKAWRDHRWPNGGGPTSVAIMIAIAQKFIPQPGRDDIAFENSMRLFSEAIKTDIREAGIDQGKEAFNRLSPQEREDVSSKAALCAAAIEQARNRADYQKQLAIADMRDHLGDRIPTDEELVDTETAVAAILAVAPKLVVPPVVRATSAG

SEQ ID NO: 2286 - protein, 389 aa, Pseudomonas fluorescens
MLKLNKLFHKGGADANVFEDRIAPTREQRKFLMECKNKVREHLKPRIRAATKTILGMEHVVEPRFRTQGSWSYNTCVVPAKSPVQEMDWDYGVYLPVTVWEENGPPHQMAKAYFSLVEELLKDLCKAEKWDLITGKKTCIRIQIADWAHIDLPLYAAPEEEFETITERVSLEKAMLDGMEHIANARAMDESYQSQQWKDLDHIAMATRSGEWRESDPEAVANWFRDRVEEHGEQLRRVCRYLKAWRDEHWDNGGPTSVSIMIAVAQNFVAQSGRDDLVTEAASKHLGVVFKGEIREAGIDDKKEDFNRLEGPDRAIAARRFAELGTAIYESRMMREHQKGQAVTQMRAQFGSRMPWDATLIEVGGEADAIRNTAPEKVAPPVVLSSSAG

SEQ ID NO: 2287 - protein, 389 aa, Pseudomonas rhodesiae
MLKLNKLFHKGGADANVFEDRIAPTREQRKFLMECKNKVREHLKPRIRAATKTILGMEHVVEPRFRTQGSWSYNTCVVPAKSPAQEMDWDYGVYLPVTVWEENGPPHQMAKAYFSLVEELLKDLCKAEKWDLITGKKTCIRIQIADWAHIDLPLYAAPEEEFQTITERVSLEKAMLDGMEQLATARAMDESYELQQWKDLDHIAMATRSGEWRESDPEAVANWFRDRIEEHGEQLRRVSRYLKAWRDVHWDSGGPTSVSIMIAVAQNFVAQPGRDDLVTEAAAKHLGVVFRGEIREPGIDDEKEDFNRLEGSDRAIAARRFAELGSAIYESRMMREHQKGEAVIQMRAQFGSRMPWDTTLIEVGGEADAIRNTAPEKVAPPVVLSSSAG

SEQ ID NO: 2288 - protein, 389 aa, Pseudomonas coronafaciens
MLKLNKLFHKGGADANVFEDRIAPTREQRKFLMECKNKIREHLKPRIRAATKTTLGMERVVEPRFRTQGSWSYSTCIVPAKTPIQEMDWDYGVYLPVTVWEENGPPHQMAKAYFSLVEELLKDLCNAEKWDLITGKKTCIRVQVADWAHIDLPLYAAPEDEFENITERLSLEKAMLDGLEQFATARAKDESYEPQEWKDLDHIAMATRSGEWRDSDPEAVANWFRDRIEEHGEQLRRVCRYLKAWRDVHWDTGGPTSVSIMIAVAQNFVAQPGRDDLVTEAAAKHLGVVFRGEIREAGIDDEKEDFNRLEGSDRATAARRFAELGTAIHECRMMREHQKGQAVAQMKAQFGSRMPWDTSLIEVGSDLDSIRNDIPEKVVPPVVLSSSAG

SEQ ID NO: 2289 - protein, 395 aa, Pseudomonas argentinensis
MLKFSKLFHKGGGDSDVYEDRIIPATEQRKFLISCKNKVREHLRARIRRATKEELGMERVVEPRFRTQGSWAYNTCVIPERTPPQEMDWDFGVYLPVTVWEENGPPHAMAKAYFDLVEYALEDLCAQENWQLLSGKDTCIRIQVAKWAHLDIPLYAAPEDEFEKVRERIDLAEARAVLMRKSEGLMDAVAFDFAMNQIQEQQWEDLDHVVMATRSGEWKASDPEVVANWFRDRVEEHGEQLRRVCRYLKAWRDFHWESGGPTSVSIMIAAAQKFERRPGRDDIAVEEAARYLSQAFLGNIHEEGIDNGQEDFNRLNEEGRRMASARFRTLATTMQDSRLLHEYQKSDVIRRLRGQFGKRIPDDINLVELDANADTIRNTAPLRVAPPVVPSTKAG

SEQ ID NO: 2290 - protein, 390 aa, Variovorax sp.
MLKLNKLFYKSDVNSDVFGDRIEPAPEDRKYLSACITKVKNHLTPRIRRATKEKLGMERVVEPRFRTQGSWLYGTCVEPSSTPPQEMDWDYGIYLPVTVWQENGPPHEMAKAYFELVEGLLVDLCKQEGWTLLAGKNTCIRIKVAAWAHIDIPLYAAPEEEFGKIRDRIALEEAHLRKTFDSIAADSYDFAEAQQQQWEDLDHIVMATREGEWKASDPEVVAKWFRDRVSEHSEQLRRVCRYLKAWRDFHWQEGGPTSVSIMIAVAQRFQPKAGRDDLALEDAAKRLTNVFLSSIRERGIDDGKEDFNRLEPADRATASRRFGQLANDLEDSRLLGVQHKEQAIFQMKQQFGLRMPVDSSLVEADSAADTIRTTTPIRVVPPVVPSTSAG

SEQ ID NO: 2291 - protein, 380 aa, Janthinobacterium sp.
MLKLHKLFAEPISHAFGHQLRPTAEQREYLVSCKNKIRDHLRRGIEAATVSHLGMNRRVTPRFRTQGSWSYDTCVQPAQYPPQEMDWDFGVYLPVTVWEDNGPPHAMAKLYFSLVEQLLLILCDQEKWVLTPGKDTCIRVKVASWAHIDLPLYAAPDDQFVQIIDKAAVLNARGIALDSAEFLQEQLWEEMDTIMLATRKGEWKPSDPEAITRWFKDRLAEHGDQLAHVCRYMKAWRDFHWEDAGPSSVCLMIAISQKFQRQPGRDDLAIEKAAEHLATAIRFDIREVAIDDRLEDFNRLDPMGRGFAAQKATELQNSLFQARTWSIGLKSNAIASLRRVFGQRIPDDQNLIEQDTSADAIRNTEARQVTRPVVVATQAG

SEQ ID NO: 2292 - protein, 388 aa, Collimonas sp.
MLKLHKLFAEKISHAFGHQLKPTDEQRAHLVSCKNKIRDHLRKGIEAATVSQLGMDRRVTPRFRTQGSWSYGTCVQPAQHPPQEMDWDFGVYLPVTVWEDNGPPHVMAKLYFQLVEQLLQGLCAQEKWGLISGKDTCIRVKIATWAHIDLPLYAAPESQFVQIVEKALALTAQGITMDSIDLSESFAGGELQRQAWEDMDSIMLATRSGEWKESDPEAVTRWLKDRIAEHDDQLARVWRYLKAWRDFHWKDGGPSSVCLMIAIAQNFQRQPGRDDLAIEKAAEHLATALRFEIREAAIDGRSEDFNRLDPIAREVAAQKAMELQNSIFQARTWHFGFKSNAISALRQAFGQRIPDDQNLIEQDTGADAIRNTDASQVKRPVVVATQAG

SEQ ID NO: 2293 - protein, 397 aa, Rhodanobacter sp.
MEHIMLKLNKLFLNDGDTRAFSEQIEPTDAQRNHLTDCKDKIRDHLLEGITRLSIEVLGTERSVSPRFRTQGSWSYRTCIQRAHPHQEMDWDFGVYLPVSVFEDQTPRIAANAYFLLVQSLLESLCEREGWRLNHDRQSCIRVQVGRGAHIDVPLYAAPEAEFESIRERAVALAKATSSAHDAQYLRESVAFGELVEPAWEDLQGIHLARRDGTWKKSDPEAVARWYNDRVLALAPFGLQMRRVCRYLKAWRDLWWPEGGPTSVALMIVTAQHFEGSNYRRDDLALEQAAKHLAESVMKPLKEPAIEQGEEDFFGELDDTARGTVATRAQELAAGIAFARSLAYHRRHDAVEKLQNLLGLRIPSLFEWVEIEGSEADVRTTPASRVPPPLIKPTQAG

SEQ ID NO: 2294 - protein, 393 aa, Xanthomonadales bacterium
MLKLNKLFLNDGDTRAFSEQIEPTDAQRNHLTDCKDKIRDHLLEGITRLSIEVLGTERSVSPRFRTQGSWSYRTCIQRAHPHQEMDWDFGVYLPVSVFEDQTPRIAANAYFLLVQSLLESLCEREGWRLNHDRQSCIRVQVGRGAHIDVPLYAAPEAEFESIRERAVALAKATSSAHDAQYLRESVAFGELVEPAWEDLQGIHLARRDGTWKKSDPEAVARWYNDRVLALAPFGLQMRRVCRYLKAWRDLWWPEGGPTSVALMIVTAQHFEGSNYRRDDLALEQAAKHLAESVMKPLKEPAIEQGEEDFFGELDDTARGTVATRAQELAAGIAFARSLAYHRRHDAVEKLQNLLGLRIPSLFEWVEIEGSEADVRTTPASRVPPPLIKPTQAG

SEQ ID NO: 2295 - protein, 399 aa, Pseudomonas aeruginosa
MLNLTKIFYSSSPEAEHLHDALIPENEQRAFLRSCRAKIKDYLKPAIAEATVSVLGMQKRVQPRFRTQGSWAYNTCIQPAHPFDQEMDLDYGVYLPVDVWQENGPPEAMAKLYFDLVESLLQILCAQEGWGLVTGDDAKDTCIRIDVAPWAHIDIPLYAAPADDFEKVIEKTAMLTAHARAMNSQNRSIALDSIEILFAEAQTWGDLDQIMMASRGGKWIASDPETVAKWFRDQITRFAESGEQFLRVCRYVKAWRDFNWKNGGPTSVSLMIAIAQGFEGKKGRDDIALEHATTIVAQAVREGIYEFGIDGGKEDFNRLKQDERIEAGLAADRLVSSLRSSRSSASYQGSSVLQTLRAVFGGRIPFCPELIQEEAPASIVRSTAPAIVATPYVPNTSAG

SEQ ID NO: 2296 - protein, 402 aa, Pseudomonas brassicacearum
MLNLTKIFYSSIADSEHLHGALLPNDEQRAFLRDCRTKIKDYLKPAIAAATVHVLGMQKQVKPRFRTQGSWAYSTCVQPAHTLDQEMDLDYGVYLPVDVWQENGPPAEMAKAYFDLVESLLQILCLQEGWTLVTGDDAKDTCIRIDVASWAHIDIPLYAAPAADFENVVEKTAMLKAEARSVNSVSFGMICESMESMDSVFSNAQTWDDLDQIMMASRAGKWIASDPESVAKWFRDQITRFGELGEQFLRVCRYVKAWRDFNWKSGGPTSVSLMIAIAQGFEGKRGRDDIALEQVAAVVAQAVRGDIYEHGIDESAEDFNRLKHDKRIEAGRAADRLVTSLRSSRSTPSHQGSNALHSLRAVLGDRIPFSPGLIQEEAPANIVRSAVPAIVATPYVPNTSAG

SEQ ID NO: 2297 - protein, 402 aa, Pseudomonas sp.
MLNLTKIFYSSIAGTEHLHGALLPNDEQRAFLRYCRTKIKDYLKPAIAAATVHVLGMQKQVKPRFRTQGSWAYSTCIQPAHTLDQEMDLDYGVYLPVDVWQENGPPAEMAKAYFDLVESLLQILCLQEGWTLVTGDDAKDTCIRIDVASWAHIDIPLYAAPAADFEKVVEKTAMLKAEARAVNSASFGMMWESMESMDSVYANAQTWDDLDQIMMASRTGKWIASDPESVAKWFRDQIVRFGELGEQFLRVCRYVKAWRDFNWKNGGPTSVSLMIAIAQGFEGKKGRDDIALEQAAAVVAQAVRGDIYEHGIDESAEDFNRLKHDKRIEAGSAADRLVTSLRSSRSTSSHQGSNALHSLRAVLGDRIPFSPELIQEEAPANIVRSATPAIVATPYVPNTSAG

SEQ ID NO: 2298 - protein, 402 aa, Pseudomonas aeruginosa
MLNLTRIFYSSSADAEHLHGALLPDDEQRAFLRSCRTKIKDYLKPAIANATVHVLGMQKQVQPRFRTQGSWAYSTCIQPAHTLDQEMDLDYGVYLPVDVWLENGPPAEMAKAYFDLVESLLQILCLQEGWTLVTGDDAKDTCIRIDVASWAHIDIPLYAAPAADFEKVVEKTAMLKAEARAVNSVRVGMMWESMESMDSVYANAQTWDDLDQIMMASRTGKWIASDPESVAKWFRDQITRFGELGEQFLRVCRYVKAWRDFNWKNGGPTSVSLMIAIAQGFEGKRGRDDIALEQAAAVVAQAVRGDIYEHGIDESAEDFNRLKHDKRIEAGRAADRLVTSLRSSRNAPSHQGSSALHSLRAVLGDRIPFSPELIQEEAPANIVRSASPAIVATPYVPNTSAG

SEQ ID NO: 2299 - protein, 399 aa, Pseudomonas oryzae
MLNLTKLFYASYADTEHLHGALMPEEEQKAFLRSCRTKIKDYLKPAIAEATVSVLGMRKQVQPRFRTQGSWAYNTCIQPAHKFDQEMDLDYGVYLPVDVWQENGPPAEMAKAYFDLVESLLQILCVQEKWTLVTGDDAKDTCIRIDVASWAHIDIPLYAAPADDFEKVVEKTAMLKAQAGAMNSLNYRMGLDSAELLYAKAQTWDDLDQIMMASRTGKWIASDPETVAKWFRDQIARFGELGEQFLRVCRYVKAWRDFNWKTGGPTSVSLMIAIAQGFEGKKGRDDIALEQAATVVAQAVRDDIYEHGIDNGTEDFNILTQDKRIEAGLAADRLVSNLRSSRSAASHQGLSVLNTLRTVLGERIPFSPELIQEESPANIVRNSAPTIVAAPYVPNTSAG

SEQ ID NO: 2300 - protein, 398 aa, Unknown
  Description of Unknown: Pseudomonas sequence
MLNLTKLFFSSADDIVFSDNIAPTDEQRDFLTQCRTKIREYLKPAIADATVAVLGMEKRVEPRFRTQGSWAYKTCIQPAHPDKQETDLDYGVYLPVDVWQENGPPAAMAKKYFDLVETLLQVLCVQEGWKLIMGADAKDTCIRIDVASWAHIDIPLYAAPIEEFNKVVERTVVLNNERRATVMDSVSSNEAYEILAKAKAQTWDDLDTIMLASRSGRWRASDPEDVAKWIRDQVARFGDLGNQLLRVCRYAKAWRDFHWKSGGPTSISLMIAIAQNFEGKRGRDDIAFENAANALSIALNTEIREPGIDDGAEDFNRLKLDEREHASSKAEDLALALKRARGCQEYQKHQALQITSGQLGNRVPATTSLIDVESATEIVRSTAPAVVPAPRVPNTSAG

SEQ ID NO: 2301 - protein, 398 aa, Pseudomonas congelans
MLNLTKLFFSSAEDAVFSDNIAPTEEQRDFLTQCRTKIREYLKPAIANATVVVLGMEKRVEPRFRTQGSWSYKTCIQPAQPELQEIDLDYGVYLPVDVWQDNGPPAAMAKKYFDLVETLLQVLCAQEGWKLVTGTAAKETCIRIDACSWAHIDIPLYAAPIDEFKKVIERTVALSTERRAMVLDGVSSNEAFLEVAKAKAQTWDDLDTIMLASRSGLWRASDPEDVAKWIRDQVARFGDLGNQYLRVCRYAKAWRDFHWKSGGPTSISLMIAIAQNFEGKLGRDDIAFENAATALSTALNTEIREPGIDDDAEDFNRLKQDEREHASSKAEDLALALKRARGCQEYQKHQALQITSGQLGNRVPATTSLIDVESGTEIVRSTAPAVVPAPRVPNTSAG

SEQ ID NO: 2302 - protein, 379 aa, Arenimonas malthae
MLKWNKLLLNDGDLEAFDERIEPSARQHDYLDACRIKIREHLREGIRKASVSVLGLDHAVAPRFRMQGSCAYRTCIQRAHTHQEMDLDYGVYLPVSAFEDRRPRVAAKAYFELVESLLRRLCQTEGWTLDDSKDTCVRLKVSTWAHIDVPLYAAPEHIFTTIVERAAVAKAEYADFDAGSDLTESFWVEMDEIHLAQRDGTWKPSDPAAVTRWWRTLVEEHGPQLRRICRYVKAWRDFWWPNGGPSSVALMIAIARDFSARPRRDDLALEDAAANMAEALSGELRERGIDFGREDFLKGLSAEEKRIAVERANQLAKRLRLVRSYGPNLRTDAVADVRQQLGDRIPNRPDWLESDGSADVRAAAATIVAAPVVKATESG

SEQ ID NO: 2303 - protein, 387 aa, Rhodanobacter denitrificans
MLSLHKLFLNAGAPDSFDEVIAPTDSQRRTLMAAKNAIREHLRADIRAATTTVLGMDRMVTPRFRTQGSWAYKTCVQAAHRPPQEMDWDFGVYLPVTVWDEHAPPARMAKLYFELVERSLGQLCEREGWRLERGNTRCVRIRIADWAHIDVPLYAAPEAKFHQVMEKAVALNSAHHAYLHLRESAALDEAPEPFWELLDEIHVATRDGRWLPSDPEAVAKWFDDQVLVHGEQLRRVCCYLKAWRDYHWRDGGGPSSVLIMIVVTQAFDATPRRDDLAVERAAMTLARALGDGVYERGIDGGEEDFNRMSSGERLIAVQRAESLARQMSLSRHFGPGLRQTAVDNVRAQFGPRIADNCELVAADDGTDVRRVPAAQVVPPVVGATKAG

SEQ ID NO: 2304 - protein, 387 aa, Rhodanobacter denitrificans; identical to SEQ ID NO: 2303

SEQ ID NO: 2305 - protein, 332 aa, Rhodanobacter sp.
MDRMVTPRFRTQGSWAYKTCVQAAHRPPQEMDWDFGVYLPVTVWDEHAPPARMAKLYFELVERSLGQLCEREGWRLERGNTRCVRIRIADWAHIDVPLYAAPEAKFHQVMEKAVALNSAHHAYLHLRESAALDEAPEPFWELLDEIHVATRDGRWLPSDPEAVAKWFDDQVLVHGEQLRRVCCYLKAWRDYHWRDGGGPSSVLIMIVVTQAFDATPRRDDLAVERAAMTLARALGDGVYERGIDGGEEDFNRMSSGERLIAVQRAESLARQMSLSRHFGPGLRQTAVDNVRAQFGPRIADNCELVAADDGTDVRRVPAAQVVPPVVGATKAG

SEQ ID NO: 2306 - protein, 395 aa, Stenotrophomonas ginsengisoli
MLSLHKLFKNDGNPTSLDEVITPSAAQKRALMDAKNDIRDHLRKTIREATVSVLGMPHMVTPRFRTQGSWAYKTCIKGAHLPPQEMDWDFGVYLPVTAWEDTSPPRAMARLYFEFVERSLADLCEQKGWVLDNSNKRCARVKISDWGHVDLPLYAAPEDKFRDVAEKSVLDSSMKRTNHLRENASLEEFSEKGEMPNDFWVLMDEIHVAKRDGTWQKSDPEQVANWFDDRVTEHTDQLRRVCRYLKAWRDYNWESGGPTSVLIMIIVSKSFLAIRGRDDLALENAAADLAKRLADDVREVGIDLGVEDFNRLSPADRIVASQKAKELQQAIYNSRHYGPGLVGKAIANMQAHFGDRISNDASLVVVDNAAEVRSTAAARVAAPAVGATKAGWRSK

SEQ ID NO: 2307 - protein, 395 aa, Stenotrophomonas maltophilia
MLSLHKLFKNDGNPTSLDEVITPSAAQKRALMDAKNDIRDHLRKTIREATVSVLGMPHMVTPRFRTQGSWAYKTCIKGAHLPPQEMDWDFGVYLPVTAWEDTSPPRAMARLYFEFVERSLADLCEQKGWVQDKSNKRCARVKISDWGHVDLPLYAAPEDKFRNVAEKSAMDSSMKRTNHLRENASLEEFSEKGEMPNDFWVLMDEIHVAKRDGTWQKSDPEQVANWFDDRVTEHTDQLRRVCRYLKAWRDYNWESGGPTSVLIMIIVSKSFQAIRGRDDLALENAAADLAKRLAEDVREVGIDLGVEDFNRLSPADRIVASQKARELQQAIYTSRHYGPGLVGKAIANMQTYFGTRISNDASLVVVDNAAEVRSTDAARVAAPAVGATKAGWRAK

SEQ ID NO: 2308 - protein, 392 aa, Stenotrophomonas maltophilia
MLNLHSLFLNGENPIAFDKAISPTEEQRKLLVQAKNKIRDHLREGIRRASTALLGMEKQVEPRFRTQGSWSYKTCIQGAHLPPQEMDWDFGVYLPVAVWDESAPPRAMAKLYFSFVEDSLEALCLQEGWVLDKSNARCVRVKISTWAHIDLPLYAAPEEKFQKVRDRIAFDHASSKNHLRESVSASLEEFSDSGEMPGDFWAEMEDIHLAKRNGEWTKSDPEQVSRWFDDQVTKHGDQLRRVCRYLKAWRDHHWEMGGPSSVLLMIMATKRFERSYGRDDIALEKAAEAIEDLVRGEVREVGIDFAAENFNRLDAASRNLASERAGDLRSSIRRARGLGAAMKHDAIARMREQFGGRVPNDIALVTVDGAAEVRSTQAREVVPPVVGATHAG

SEQ ID NO: 2309 - protein, 392 aa, Stenotrophomonas maltophilia
MLNLHSLFLNGENPIAFDKAISPTEEQRKLLVQAKNKIRDHLREGIRRASTALLGMEKQVEPRFRTQGSWSYKTCIQGAHLPPQEMDWDFGVYLPVAVWDESAPPRAMAKLYFSFVEDSLEALCLQEGWVLDKSNARCVRVKISTWAHIDLPLYAAPEEKFQKVRDRIAFDHASSKNHLRESVSASLEEFSDSGEMPGDFWAEMEDIHLAKRNGEWTKSDPEQVSRWFDDQVTKHGDQLRRVCRYLKAWRDHHWEMGGPSSVLLMIMATKRFERSYGRDDIALEKAAEAIEDLVRGEVREVGIDLAAENFNRLDAASRNLASERAGDLRSSIRRARGLGAAMKHDAIARMREQFGGRVPNDIALVTVDGAAEVRSTQAREVVPPVVGATHAG

SEQ ID NO: 2310 - protein, 389 aa, Xanthomonadales bacterium
MLKLHKLFLNGGHVLSLDVVIEPTTSQWQTLVDAKNAIRDHLRASLRAASTQLLGMDRKIGPRFRSQGSCVYRTLIQPAHPTQEMDWDFGVYLPVEIMDARPKTAAKTYFDIVEAALDELCRKRRWTLDRSKKSCVRVKIAPWAHIDVPLYAVPASEFHTIQERARATAELYAGARDSKMLSESADFAEMPEPFWQMIEGVHLATRAGEWIKTDPEEVARWYNDRVEQHGEQLRRICRYVKGWRDYYWPDCDGPSSISLMILVARNFVPRLRRDDLALEDAARAVYEGIGQDIYEPGIDGGDVDFNRLDVARRKIAKAQAKDLLDQLWNSRHYASLNLARDVIRNIRGQFGSRIADDTSFIEVDDSADQVRRSSAAAVPPPLVGSNQSG

SEQ ID NO: 2311 - protein, 278 aa, Luteimonas mephitis
MFLNAGHALSFDEVIEPTKTQWQTLVHAKNDIRDHLRASLRAASTQLLGMDRQIGPRFRSQGSCVYRTLIQPAHSGQEMDWDFGVYLPVEIMDARPKTAAKTYFNIVEAALDELCRKRGWSLDRSKTSCVRVKIAAWAHIDVPLYAVPASEFHTIQERARASGQLYATRDSVRLSESVDFAEMPEPFWQMIEGVHLATRNGEWLKTDPEEVARWYNDRVEQHGEQLRRVCRYVKGWRDYYWPNCDGPSSVSLMILVARNFVPRLRRDDLALEDAARAI

SEQ ID NO: 2312 - protein, 390 aa, Luteimonas mephitis
MIMLKLHKLFLNAGHALSFDEVIEPTKTQWQTLVHAKNDIRDHLRASLRAASTQLLGMDRQIGPRFRSQGSCVYRTLIQPAHSGQEMDWDFGVYLPVEIMDARPKTAAKTYFNIVEAALDELCRKRGWSLDRSKTSCVRVKIAAWAHIDVPLYAVPASEFHTIQERARASGQLYATRDSVRLSESVDFAEMPEPFWQMIEGVHLATRNGEWLKTDPEEVARWYNDRVEQHGEQLRRVCRYVKGWRDYYWPNCDGPSSVSLMILVARNFVPRLRRDDLALEDAARAIYESIGHDIYEPGIDGGNTDFNRLDATQRKVAKAHAKDLLDQVWNSRHYASLNLAPDAIRNMRGEFGSRIANDTSFIEVDDSADQVRRSSAAAVAPPLVGSNQSG

SEQ ID NO: 2313 - protein, 449 aa, Enhydrobacter aerosaccus
MTDISTNNLHRVFKNDNNGFFHKLLPNMEQLDAFKHCKDKVQEKLESDLKVIYGVKPKFRLQGSWAYGTCNVPALSTQEMDFDYGCYLPNACFVDDEKTEGEKILQHVEQSLKVVCDEQGWSLDTSNASCLRITGFLSQAHFDVPLYAVPDDMFADLQDVQIRTQKSETIANESIGLDSAILSLDFSEKNGDTRPDSLSVFFGESQFSNEITFTTLSNEARHGRYELGLDSINEKNSVSKTVKKFNNQKIQNIRLIKRDEDWKPSDCEKVREWFVGTCDKYPNEGQQLRAIVRYVKSWRDFLGPHFKKAPSSIALMVLVTQSYEHLQQRDDKALNAVVKDLPNALTKSINCKDIVGHESEDFNSLDAQEREFAKSLASQFSKVLDDCLSKHTTAFDCLADLETQLGCRIPMQPELVTINIKNESKSSFIESQPLATVSAPAIITTQIGG

SEQ ID NO: 2314 - protein, 449 aa, Moraxella atlantae
MTDISTNNLHRVFKNNNDGFFHKLIPSMEQLDAFKYCKDKVQEKLESDLKEIYGVKPKFRLQGSWAYGTCNVPALATQEMDFDYGCYLPNVCFVDDEKTEGEKILRYVEKSLQVVCDEQDWTLDTSNASCLRITGFLPQAHFDVPLYAVPDDMFADLQDVQIRTQKSETIANESMGLDSAILSFDFSEKNGDTRPDSLSAYFGESQFSNEIAFTTLSNEARQGRYELGLDSINEKNSIPKTVKKANNQKIQNIRLIKRDEDWKTSDCEKVREWFVGTCDKYPNEGQQLRAIVRYVKSWRDFLTPQFKKAPSSIALMVLTTQSYEHLQQRDDKALNEVIKNLPNGLVKSIKCKDIVGHESEDFNNLNEEERERAKSLATQFSQVLDECLFKHTSAIDCLEDLKTQFGYRIPRQPELVAINVKNETKSIFIESQPLASVATPAIIKTQFGG

SEQ ID NO: 2315 - protein, 448 aa, Unknown
  Description of Unknown: Psychrobacter sequence
MSDNLKTNNLHSVFKNDTDGFFKKLLPKGEQFQVFKDCKDQIKAVIEIQVEKVYGVRPKFRLQGSWAYGVCNAPALPEQEMDFDYGCYLPESCFLEGQSAEVANKLFETVEECLDILCNDNGWELDKEHKNCIRIRGFMPQGQPKAHFDIPLYALPNEMFDDLTDASVKQDSSTVSKEEASYDSIQESRSFDFSEDVDPNNLSLFFNESTFSGTTLSANLSYSPSYDSMITEDSSKANAKNIKKRSKIKNVSLIQRDEDEWLVSDCEKVREWFLAECEKYPNTGQQLRAVIRYLKSWRDYNQYQKAPSSVSLMIIATEHYQHLQQRDDRALFEILLNLEHALKNDIKCKYIEGHSTEDFNRANNEQREENAELASELCSGFDRVLHKSQNENTCLNILESLFGERIPSNRPDLVTINVDTKASVATVVDNAPVQVAAESASIKPQIGG

SEQ ID NO: 2316 - protein, 438 aa, Psychrobacter cibarius
MNNEIPTNNFHRVLRNEPEGFFTQLLPTKDQLDIFKNCKDLVQGALEVKLEEKYGTKPKFRLQGSWAYGTCNVPNREGQEIDFDYGCYLPENCFSGDQENDAEVLVGHVKQCLSQLCFDQNWQLDDTNPSCLRIRGFMADAHFDIPLYAVPNDMFNDLKDVPISSRKNSDIIESNESFDGLSNRNYERYLNFSEDTQPQDLSTFFGESNFIRSSNTTNFSESLETNQFDGIQKNESTQSSIKDISLIRNDGEWKVSNCERVREWFLKECSRLPGEGQQLRSIVRYIKAWRDYDFNPEHRKAPTSLALMILTVDTYEYTQQRDDKALIQVVSMLPDRFLRDVTCTDIKDHETEVFNDYRDHTYEYRAEDSRLAKQFYESLEYCSTKATVAKQCLTLLKTSLGDKITNNEDLVSISVIEPSSKPVQVAASAAIIPPQIGG

SEQ ID NO: 2317 - protein, 445 aa, Psychrobacter sp.
MNNSDIPVNNFHRVLRNEPEGFFTQLLPTRTQLDTFKECKDLIQEALEVILKEVYDVKPKFRLQGSWAYGTCNVPNRIGQEMDFDYGCYLPERCFPDEQKNEAEKLINHVKQCLSQLCFDQNWELDDKNPSCLRIRGFMVDAHFDIPLYAVPNDMFNDLKDVPISSRKNSDVVEANESYDDLSSRNYRNALNFSEDTQPQALSEFFGESSFNRSSGITTFGESVESRQFDGVQKNESAQPPIKDISLIRNDGEWKQSNCERVREWFLGVCKGQAGEGQQLRSIIRYIKAWRDYNFDPNERKQPISLALMILTVDSYEHCQQRDDKALAKVVSELPNRFLKDITCPNIKDHEEEVFNDYNGDKNKYRRQDSELAQEFSDTLNYCLTEATEARKCLYALKVCLGDKIPSNEDLVSIHNEISQGAINAKNKPVQVATAPAIIPSQTGG

SEQ ID NO: 2318 - protein, 416 aa, Acinetobacter baumannii
MQNTATANLHLIYQDDKDGYATKLLPPPSLIDKLKECQIKVRKKLEQVLEQEYGTKPKFRVQGSFAYGTCNIPAQPSKGQELDLDYGAYLPARVFTLNDTGIPNSAEEAKTYIQIVYDALVDLSKENSGWTIEQKPSCIRISGVAPLAHMDIPLYAVPNDMFEDIQNQHQLVMDSIQKTYKSLQERFESSSFSMESYDSALNNEIYENESLIDLESIEMIHMAKEDGSWFPSDCEKVREWFRRQCSKYPNSGRQLRFIARYLKGWRDQQWEEKGPTSIVLMIATVKNYQYIQGRDDLALAHVTANLDNILANNIYVEDMEDHENEDFNRANPHQRIENAQAAKRLHQDVTQAIKQGIIAPSTSIALLTRSFGYRIPEDPTLIRFEQQSPQDIVESVFQQPVTTRENSVKLKPQSSG

SEQ ID NO: 2319 - protein, 416 aa, Acinetobacter sp.
MVNQRSANLHLVYQDTTDGYATKLLPPPNLVDRLKACQIKVRKKMEQALIEEYGIKPKFRVQGSFAYGTCNLPAQPQKGQELDLDYGAYLPVSVFTLNENETPNSSDEAKRYIQTAYDALKDLSQENNGWKVEQKPSCIRISGVAQFAHMDVPLYAVPNEMFNHLESQHQLVTDSMQKAQGSLQERFESYKASMESYDTALFEEISENESPIDLESIDMIHMAKDDGSWFPSDCEKVRNWFKKQCQKYPNAGRQLRYIARYLKGWRDQQWEEKGPTSIVLMIAAVKSYTYVPGRDDLALSIVTSNLDTILANNIFVEDMEDHETEDFNRANASQRLENAQAARILHKNIMQALQQGVISPSTSLAYLTASFGNRIPTDTSLVRNDNQNSEDSISNILQTPSIRRDSSVKLKSQSSG

SEQ ID NO: 2320 - protein, 416 aa, Acinetobacter pittii
MVNQRSANLHLVYQDTTDGYATKLLPPPNLVDRLKACQIKVRKKLEQALIEEYGIKPKFRVQGSFAYGTCNLPAQPQKGQELDLDYGAYLPVSVFTLNENETPNSSDEAKRYIQTAYDALKDLSQENNGWKVEQKPSCIRISGVAQFAHMDVPLYAVPNEMFNHLESQHQLVTDSMQKAQGSLQERFESYKASMESYDTALFEEISENESPIDLESIDMIHMAKDDGSWFPSDCEKVRNWFKKQCQKYPNAGRQLRYIARYLKGWRDQQWEEKGPTSIVLMIAAVKSYTYVPGRDDLALSIVTSNLDTILANNIFVEDMEDHETEDFNRANASQRLENAQAARILHKNIMQALQQGVISPSTSLAYLTASFGNRIPTDTSLVRNDNQNSEDSISNILQTPSIRRDSSVKLKSQSSG

SEQ ID NO: 2321 - protein, 395 aa, Cellvibrio mixtus
MTQLQNFHRVFRNETKGYWVKVLPTRQQVDALVEAQRAVREQLSEDLSAHYDVSPKYRVQGSWAYGTCNQPAQVGQEMDLDYGVYLPAKVFSQQKSSQEAKQYFETAKKSLEKVCSKNGWTIITDNPNCLRFKGFMPNAHMDIPLYAVPDDMFDELEQNHGLLLEKSLRTDEHYAMDALTANLFDSVSFSESKLIDLSSIEMIHMAKSDGEWKASDCEKVRKWFQDECMKYPNGGLQLRSVVRYLKGWRDHHWKSGGPTSILLMIIATKCYQYIAGRDDQALIYVAQKLPSMLESDIFEPNIDGHQDENFNKSTPAQRKENAGKAKDLLSRLLSAAQSSTSQLTIDCLIVDFGQRIPNAPELVNKEISEDPYKTIKEIPASRVVAPAVIESQSGG

SEQ ID NO: 2322 - protein, 403 aa, Neisseria bacilliformis
MSHYTNNLHRIFVDREIGFKKEITPTELDLDFFNNVKKVVKSHLKTKIKEFLEQQGLASITPKFRIQGSWAYGTCNLPAKQGQEMDFDYGVYLPVRAFDGFNPDAGASEQAKNYFEQVELMMGDLCEQHDWLLDTSAPSSCIRIKIRNNAHMDIPLYAVPDDMFDSLEERNELQVSLGSATAIHESLNYSKWVFEDFNIRSFAEESLMDKNIRMIHMARRDGTWQESDCELIRKWFADKLKSLENNGQQLRAICRYLKAWRDWQFADKSFQPSSILLMIIACKYYQYYQHRDDLALLSVLEKLPNALSGNVYENIEEHESEDFNRMKEGERVEAMQYADALYQNFMASLNNFDKTKALKFITNEWGNRIPQDEDLIETSRQAIFDTPPLVQPNITPQAPLRQG

SEQ ID NO: 2323 - protein, 403 aa, Neisseria bacilliformis; identical to SEQ ID NO: 2322

SEQ ID NO: 2324 - protein, 403 aa, Haemophilus influenzae
MSHYTNNLHRIFVDREIGFKKKITPTELDLDFFNNVKKVVKSHLKTKIKEFLEQQGLASITPKFRIQGSWAYGTCNLPAKQGQEMDFDYGVYLPVRAFDGFNPDAGASEQAKNYFEQVELMMGDLCEQHDWLLDTSAPSSCIRIKIRSNAHMDIPLYAVPDDMFDSLEERNELQVSLGSATAIHESLNYSEWVFEDFNIRSFDEESLMDKNIQIIHMARRDGTWQESDCELIRKWFADKLKSLENNGQQLRAICRYLKAWRDWQFADKSFQPSSILLMIIACKHYQYYQYRDDLALLSVLENLPNALNGNVYENIEEHESEDFNRMKEGERVEASQYADVLYRNFVASLNNFDKTKALKFITNEWGNRIPQDEDLIETSRQAIFDTPPLVQPNITPQAPLRQG

SEQ ID NO: 2325 - protein, 404 aa, Histophilus somni
MNHYTNNLHRVFVDQKIGFKKKITPTEQDLNFFNQVKKDVKSHLKTKIKEFLEQQGIANIAPKFRIQGSWAYGTCNLPAKQGQEMDFDYGVYLPVRAFEGFNPDAGASEQAKNYFEQVESIISDLCRQHDDWQLDTSAPSPCIRIKIRRDAHMDIPLYAVPDDMFDSLEERNELLVSLDSTTAINESLNYSEWAFEDFNIRSFAEASLMDKNIQMIHMARRDGTWQESDCELIRKWFVDKLKSLENNGQQLRAICRYLKAWRDWQFADKSFQPSSILLMIIACKHYQYYQYRDDLALLSVLEKLPNALNDNVYENIEEHESEDFNRMKGDERVEAGQYADKLYRNFMASLNNFDKTKALKFIINEWGSRIPEDEDLIETSRQAVFDTPPLEQSNITPQVPLRQG

SEQ ID NO: 2326 - protein, 404 aa, Rodentibacter heylii
MNHYTNNLHRVFVDQKIGFKKKITPTEQDLNFFNQVKKDVKSHLKTKIKEFLEQQGIANIAPKFRIQGSWAYGTCNLPAKQGQEMDFDYGVYLPVRAFEGFNPDAGASEQAKNYFEQVESIISDLCRQHDDWQLDTSAPSPCIRIKIRRDAHMDIPLYAVPDDMFDSLEERNELLVSLSSTTAINESLNYSEWAFEDFNIRSFAEASLMDKNIQMIHMARRDGTWQESDCELIRKWFVDKLKSLENNGQQLRAICRYLKAWRDWQFADKSFQPSSILLMIIACKHYQYYQYRDDLALLSVLEKLPNALNDNVYENIEEHESEDFNRMKGDERVEAGQYADKLYRNFMASLNNFDKTKALKFIINEWGSRIPEDEDLIETSRQAVFDTPPLEQSNITPQVPLRQG

SEQ ID NO: 2327 - protein, 403 aa, Kingella denitrificans
MSDYTNNLHRVFVDQKIGFKKKITPTEQDLNFFNQVKKDVKSHLKTKIKEFLEQQGIANIAPKFRIQGSWAYGTCNLPAKQDQEMDFDYGVYLPVRAFEGFNPDAGASEQAQNYFEQVELMVEDLCHQHKWQLDTSAPSSCIRIKIRSNAHMDIPLYAVPDDMFDSLEERNELQVSLGTTTAIDKSLNYSEWALEDFNIRSFAEESLMDKNIRMIHMARRDGTWQKSDCELIRKWFADKLKSLENNGQQLRAICRYLKAWRDWQFADKSFQPSSILLMIIACKYYQYHQHRDDLALLSVLEKLPNALNDNVYENIEEHESEDFNRMEEYERVEASQYADALYQSFMASLNNLDKTKVLNFITNEWGDRIPQDENLIETSPQSIFDTPPLAQSNITQQVPLRQG

SEQ ID NO: 2328 - protein, 403 aa, Avibacterium paragallinarum
MNNYVNNLHRVFVDREIGFKKKITPTEQDLNFFNQVKKDVKSHLKTKIKEFLEQQGIANIAPKFRIQGSWAYGTCNLPAKQGQEMDFDYGVYLPVRAFEGFNPDASASEQAQNYFEQVELMMEDLCHQHKWQLDTSAPSSCIRIKIRSNAHMDIPLYAVPDDMFDSLEERNELQLSLDSATAIHNSLNYSEWIFEDFDIKSFAEESLIDQNIQMIHMARRDGTWQESDCELIRKWFTDKLKSLENNGQQLRAICRYLKAWRDWQFADKSFQPSSILLMIIACKYYQYYPSRDDLALLSVLEELPNALNSDVYENIEEHESEDFNRMKERERVEASRYADKLYQNFMASLNNSDKTKALTFITNELGDRIPQDKDLIETSRQSVFDTQPLVQSKITPQVPLRQG

SEQ ID NO: 2329 - protein, 407 aa, Neisseria canis
MPENYNNLHRIFTARHIGFKFRIHPTDADFKVLNEAKTKVRACLKSKMKEYLESQGIQNIVPKFRVQGSWAYGTCNLPARPDQEMDVDYGIYLPVSAFTSFNSKSESTQAKDYFAQAEKFLEELCQSEEWELDTSKSTCIRIKIKPNAHMDVPLYAVPDNMFDSLVERNTLMLAAEAAKYDSASNRVMLNEWYTQDYQLSSIDFAEDSFESLENKNITTIHMAKRDGSWQSSDCEIIREWFSNKLEMQPDNGKQLRSICRYLKAWRDWIFESGAPSSILLMIIACKHYSYNESRDDLALADVLEKLPETLAKDVYESIKEHELEDFNRMNPEEREYARKRADDLYNNFLSSLLSTDKEEIINYMEGQWGDRIPRDTGLIEISRKEDVFDTTPLVQSIITSQTPLRQG

SEQ ID NO: 2330 - protein, 394 aa, Acinetobacter baumannii
MGSNLHRTFRARDDGFITQIKPTNDQRDYLNACRQKVRATLKQGMANFIVENGGDPNLVKPKFRLQGSWAYGTCNQPAYPTQEMDVDYGVYLPNSLLAQGRSDKVAKSYYLAVETLLQPLADSEGWKLCKDKNTCCRLILKGNAHMDVPLYIVPDPMFDSLVERNNMILDEAKATIAKDEYVFKGYHYATESFESEAKIIELHYITKIHMALRDGNWKDSDCELIRKWYADFLADQEDNGRQLRYIARYLKAWRDQEYKDGGGPSSILLMIIANQNYQYVKDRDDLALLHVLRHLPKALLGPVKEPSIPEHTDEDFNRIPKEERQEAHDLAKDLLSAVSVAIDIESPKTSIGFLRSQFGKRIPDNESYVVIENANQELPYQATSPAIIEPTRGG

SEQ ID NO: 2331 - protein, 332 aa, Acinetobacter baumannii
MGSNLHRTFRARDDGFITQIKPTNDQRDYLNACRQKVRATLKQGMANFIVENGGDPNLVKPKFRLQGSWAYGTCNQPAYPTQEMDVDYGVYLPNSLLAQGRSDKVAKSYYLAVETLLQPLADSEGWKLCKDKNTCCRLILKGNAHMDVPLYIVPDPMFDSLVERNNMILDEAKATIAKDEYVFKGYHYATESFESEAKIIELHYITKIHMALRDGNWKDSDCELIRKWYADFLADQEDNGRQLRYIARYLKAWRDQEYKDGGGPSSILLMIIANQNYQYVKDRDDLALLHVLRHLPKALLGPVKEPSIPEHTDEDFNRIPKEERQEAHDLAK

SEQ ID NO: 2332 - protein, 394 aa, Acinetobacter nosocomialis
MGSNLHRTFRAKLDGFINEIKPTSEQRDYLNECRQKVRAVLKHGMANFIAENGGDPNTIKPKFRLQGSWAYGTCNQPAYPSQEMDVDYGVYLPNSLLAQGRSDIVAKSYFVVVEALLEPLASREGWTLCKTKNTCCRLILAGNAHMDVPLYIVPDLMFESLVERNNMILDEAKATIAKDEYIFKGYHYSTESFESEAKIIQLDYITKILMALRDGNWKESDCELIRKWYADHLAEQEDNGRQLRYIARYLKAWRDQEYEEGGGPSSILLMIIANQNYQYFEDRDDLALLHVVKKLPEILLGPVKEDSIPEHTDEDFNRIPVDERSEAHDLASELLDVVTAAIEVESAKTSINFLRSKFGKRIPDNESYVIIENTNQELPLQTVSPATIQPTRGG

SEQ ID NO: 2333 - protein, 423 aa, Unknown
  Description of Unknown: Acinetobacter sequence
MTNNIVLNAHRGYRAKEDGFLRTLIPTEDTIKELNECRKKIRACLKTGLRSFIDDYNSEGPNPKFRIQGSWAYGLCNLPAHKGQELDLDYGVYLSAEIFDECTEYSKETLKSYFLKVEDLLKDLAIEQNWTLDTEDNINCIRLLVNSFTHLDVPVYIVPKDMFDSLEEYSELQVGIRKSSVRAGLEDYNLSDSLAMDSDLLYENFKFESRGLLYEEKFKDHIDLENIKRITMAQRDGGYRESDCEQVRQWFLNFLSEQEDNGSQLRFICRYLKAWRDYHWEKGGGPSSILLMVIACQNYKFVESRDDLALLNILHALPNRLKESVFENGIPDHENEDFNRIKPENRLYCSKKATQFLNLIKDGLSTTEKKYCLSYHIDAFGIRYPNNEDYVIASKLPFSEEDTFKQNLTSSQTAKVLPSVTSG

SEQ ID NO: 2334 - protein, 423 aa, Acinetobacter sp.
MTNNIVLNDHRGYRAKEDGFLRTLIPTEDTIKELNECRKKIRACLKTGLRSFIDDYNSEGPNPKFRIQGSWAYGLCNLPAHKGQELDLDYGVYLSAEIFDECTEYSKETLKSYFLKVEDLLKDLAIEQNWTLDTEDNINCIRLLVNSFTHLDVPVYIVPKDMFDSLEEYSELQVGIRKSSVRAGLEDYNLSDSLAMDSDLLYENFKFESRGLLYEEKFKDHIDLENIKRITMAQRDGGYRESDCEQVRQWFLNFLSEQEDNGSQLRFICRYLKAWRDYHWEKGGGPSSILLMVIACQNYKFVESRDDLALLNILHALPNRLKESVFENGIPDHENEDFNRIKPENRLYCSKKATQFLNLIKDGLSTTEKKYCLSYHIDAFGIRYPNNEDYVIASKLPFSEEDTFKQNLTSSQTAKVLPSVTSG

SEQ ID NO: 2335 - protein, 421 aa, Acinetobacter calcoaceticus
MTNSTIFNAHRGYRALEDGFLRALIPSQDTIKELNECRKKIRSCLKSGLRDFIEDYNPEGPNPKFRIQGSWAYGLCNLPAHRGQELDLDYGVYLSAEVFNECDEYSKETLKSYFSTVENLLDELASEEGWQLDSTDNMNCIRLLVNSYTHLDVPVYIVPKDMFDSLEEYSELQVGLRKKQIGLEDFNLYDSITMDSASISESFEFESHGLLYEEKFKDHIELENIKRITMAQRDGSFRESDCEQVRQWFLNFIAKQEDEGNQLRFICRYLKAWRDYHWIQGGGPSSILLMVIACQNYEFIEKRDDLTLLNILSILPEALKNPVYESSIPDHENEDFNRIKQEKRQYCSNKATEFLNLINDSLNAKEKKYCLKFHIEAFGHRYPYNEDYIEISKVPTTEQDIFRQSLSSSQTAKVLPSVTSG

SEQ ID NO: 2336 - protein, 420 aa, Klebsiella pneumoniae
MDGLISKLKLSKTESDKLKALRQIVRERTRDVFQEARQVAIDVRKQALTLESVRLKLEKTNVRYLSPEERADLARLIFEMEDEARDDFIKFQPRFWTQGSFQYDTLNRPFHPGQEMDIDDGTYMPMTVFESEPSIGHTLLLLLVDASLKSLEAENDGWVFEEKNTCGRIKIYREKTHIDVPMYAIPKEQFQKKQTAADSAHLIKSDSVFESLALNRGGREAYAVESDKVNLALREGIRRWSVSDPKIVEDWFNESCKRIGGHLRSVCRFMKAWRDAQWEVGGPSSISLMTAVVNILDRESHNGSDLTGTMKLIARLLPEEFNRGVESPDDTDEKPLFPAESNHNVHQRAIVETMESLYGILLAAEQSESREEALRKINEAFGKRVTNALLITSSAAAPAFLNAPSKEPASKPINKTMVSG

SEQ ID NO: 2337 - protein, 432 aa, Unknown
  Description of Unknown: Klebsiella sequence
MPWDFNNYYSHNMDGLISKLKLSKTESDKLKALRQIVRERTRDVFQEARQVAIDVRKQALTLESVRLKLEKTNVRYLSPEERADLARLIFEMEDEARDDFIKFQPRFWTQGSFQYDTLNRPFHPGQEMDIDDGTYMPMTVFESEPSIGHTLLLLLVDASLKSLEAENDGWVFEEKNTCGRIKIYREKTHIDVPMYAIPKEQFQKKQTAADSAHLIKSDSVFESLALNRGGREAYAVESDKVNLALREGIRRWSVSDPKIVEDWFNESCKRIGGHLRSVCRFMKAWRDAQWEVGGPSSISLMTAVVNILDRESHNGSDLTGTMKLIARLLPEEFNRGVESPDDTDEKPLFPAESNHNVHQRAIVETMESLYGILLAAEQSESREEALRKINEAFGKRVTNALLITSSAAAPAFLNAPSKEPASKPINKTMVSG

SEQ ID NO: 2338 - protein, 432 aa, Klebsiella pneumoniae
  MOD_RES (125)..(125): Any amino acid
MPWDFNNYYSHNMDGLISKLKLSKTESDKLKALRQIVRERTRDVFQEARQVAIDVRKQALTLESVRLKLEKTNVRYLSPEERADLARLIFEMEDEARDDFIKFQPRFWTQGSFQYDTLNRPFHPXQEMDIDDGTYMPMTVFESEPSIGHTLLLLLVDASLKSLEAENDGWVFEEKNTCGRIKIYREKTHIDVPMYAIPKEQFQKKQTAADSAHLIKSDSVFESLALNRGGREAYAVESDKVNLALREGIRRWSVSDPKIVEDWFNESCKRIGGHLRSVCRFMKAWRDAQWEVGGPSSISLMTAVVNILDRESHNGSDLTGTMKLIARLLPEEFNRGVESPDDTDEKPLFPAESNHNVHQRAIVETMESLYGILLAAEQSESREEALRKINEAFGKRVTNALLITSSAAAPAFLNAPSKEPASKPINKTMVSG

SEQ ID NO: 2339 - protein, 432 aa, Klebsiella sp.
MPWDFNNYYSHNMDGLISKLKLSKTESDKLKALRQIVRERTRDVFQEARQVAIDVRKQALTLESVRLKLEKTNVRYLSPEERADLARLIFEMEDEARDDFIKFQPRFWTQGSFQYDTLNRPFHPGQEMDIDDGTYMPMTVFESEPSIGHTLLLLLVDTSLKSLEAENDGWVFEEKNTCGRIKIYREKTHIDVPMYAIPKEQFQKKQTAADSAHLIKSDSVFESLALNRGGREAYAVESDKVNLALREGIRRWSVSDPKIVEDWFNESCKRIGGHLRSVCRFMKAWRDAQWEVGGPSSISLMTAVVNILDRESHNGSDLTGTMKLIARLLPEEFNRGVESPDDTDEKPLFPAESNHNVHQRAIVETMESLYGILLAAEQSESREEALRKINEAFGKRVTNALLITSSAAAPAFLNAPSKEPASKPINKTMVSG

SEQ ID NO: 2340 - protein, 432 aa, Enterobacter cloacae
MPWDFNNYYSHNMDGLISKLKLSKTESDKLKALRQIVRERTRDVFQEARQVAIDVRRQALTLESVRLKLEKTNVRYLSPEERADLARLIFEMEDEARDDFIKFQPRFWTQGSFQYDTLNRPFHPGQEMDIDDGTYMPMTVFESEPSIGHTLLLLLVDTSLKSLEAENDGWVFEEKNTCGRIKIYREKTHIDVPMYAIPKEQFQKKQTAADSAHLIKSDSVFESFALNRGGREAYAVESDKVNLALREGVRRWSVSDPKIVEDWFNESCKRIGGHLRSVCRLMKAWRDAQWEVGGPSSISLMTAVVNILDRESHNGSDLTGTMKLIARLLPEEFNRGVESPDDTDEKPLFPAESNHNVHHRAIVETMEGLYGILLAAEQSESREEALRKINEAFGKRVTNALLITSSAAAPAFLNAPSKEPSSKPINKTMVSG

SEQ ID NO: 2341 - protein, 432 aa, Klebsiella pneumoniae
MPWDFNNYYSHNMDGLISKLKLSKTESDKLKALRQIVRERTRDVFQKARQVAIDVRRQALTLESVRLKLEKTNVRYLSPEERADLARLIFEMEDEARDDFIKFQPRFWTQGSFQYDTLNRPFHPGQEMDIDDGTYMPMTVFESEPSIGHTLLLLLVDTSLKSLEAENDGWVFEEKNTCGRIKIYREKTHIDVPMYAIPKEQFQKKQTAADSAHLIKSDSVFESFALNRGGREAYAVESDKVNLALREGVRRWSVSDPKIVEDWFNESCKRIGGHLRSVCRFMKAWRDAQWEVGGPSSISLMTAVVNILDRESHNGSDLTGTMKLIARLLPEEFNRGVESPDDTDEKPLFPAESNHNVHHRAIVETMEGLYGILLAAEQSESREEALRKINEAFGKRVTNALLITSSAAAPAFLNAPSKEPSSKPINKTMVSG

SEQ ID NO: 2342 - protein, 432 aa, Klebsiella pneumoniae
MPWDFNNYYSHNMDGLISKLKLSKTESDKLKALRQIVRERTRDVFQEARQVAIDVRRQALTLESVRLKLEKTNVRYLSPEERADLARLIFEMEDEARDDFIKFQPRFWTQGSFQYDTLNRPFHPGQEMDIDDGTYMPMTVFESEPSIGHTLLLLLVDTSLKSLEAENDGWVFEEKNTCGRIKIYREKTHIDVPMYAIPKEQFQKKQTAADSAHLIKSDSVFESFALNRGGREAYAVESDKVNLALRKGVRRWSVSDPKIVEDWFNESCKRIGGHLRSVCRFMKAWRDAQWEVGGPSSISLMTAVVNILDRESHNGSDLTGTMKLIARLLPEEFNRGVESPDDTDEKPLFPAESNHNVHHRAIVETMEGLYGILLAAEQSESREEALRKINEAFGKRVTNALLITSSAAAPAFLNAPSKEPSSKPINKTMVSG

SEQ ID NO: 2343 - protein, 432 aa, Serratia odorifera
MPWDFNNYYSHNMDGLISKLKLSQTESDKLKALRQIVRERTRDVFQEARQVAIDVRRQALTLESVRLKLEKTNVRYLSPEERADLARLIFEMEDEARDDFIKFQPRFWTQGSFQYDTLNRPFHPGQEMDIDDGTYMPMTVFESEPSIGHTLLLLLVDTSLKSLEAENDGWVFEEKNTCGRIKIYREKTHIDVPMYAIPKEQFQKKQTAADSAHLIKSDSVFESFALNRGGREAYAVESDKVNLALREGIRRWSVSDPKIVEDWFNESCKRIGGHLRSVCRFMKAWRDAQWEVGGPSSISLMTAVVNILDRESHNGSDLTGTMKLIARLLPEEFNRGVESPDDTDEKPLFPAESNHNVHHRAIVETMEGLYGILLAAEQSVSREEALRKINEAFGKRVTNALLITSSAAAPAFLNAPSKEPSSKPINKTMVSG

SEQ ID NO: 2344 - protein, 432 aa, Yersinia enterocolitica
MRWDFNNYYSHNLDGLISKLKLSKAESDKLKALRQIVRERTRDVFQEAREVATDVRRQALTLENVRLKLEKTNVRYLSPADRADLARLIFDMEDEARDDFIKFQPRFWTQGSFQYDTLNRPLHPGQEMDIDDGTYMPMTVFESEPSIGHMLLLLLVDTSLKSLEAENDGWVFEEKNTCGRIKIHREKTHIDVPMYAIPKEQFQKKQTAADSAHLIKSDSIFESIALNRDGREAYAVESDKVNLALREGSKRWSISDPKIVEDWFNDSCKRIGGHLRSVCRFMKAWRDAQWEVGGPSSISLMAAVVNILDREFHNGSDLTETMKLVSRLLPDEFNQGVESPDDTDEKPLFPAEPNHNVHQRAIVETMESLHGILVAAELSESREDALSKINEAFGKRVTDASLITSIAAAPAFLNSPSKEPASKPINKTMVSA

SEQ ID NO: 2345 - protein, 432 aa, Enterobacter cloacae
MHWDFNNYYSHSMDGLISKLKLGKAESDKLIALRQKVRERTRDVFKEAREIATDVRRQALTLENVRLKLEETNVRYLSPADRADLARLIFEMEDEARDDFIKYQPRFSTQGSFQYDTLNRPFHPGQEMDIDDGTYMPMTVFESKPSIGHTLLLLLVDTSLKSLEAENAGWTFEEKKNCGRIKIPNEKTHIDVPMYAIPKEKFQEKQTAAESAHLIKSDSMFESLALNRAGLESYVVESDKVNLAIREGTRRWSISDPKIVEDWFNESCDRIGGHLRYICRFMKAWRDAQWDVGGPSSISLMAAVVNILDKEAHDGADLTGTMKLVARLLPDEFNHGLESPDDTDAKLLFPAERDQNVHQRTIIETMRRLHGILLAAESSESREDALRKINEAFGKRVTNASLITSIAAAPAFLNSPSKEPAPKPINKTMVSG

SEQ ID NO: 2346 - protein, 432 aa, Unknown
  Description of Unknown: Enterobacter sequence
MHWDFNNYYSHSMDGLISKLKLGKAESDKLIALRQKVRERTRDVFKEAREIATDVRRHALTLENVRLKLEETNVRYLSPADRADLARLIFEMEDEARDDFIKYQPRFSTQGSFQYDTLNRPFHPGQEMDIDDGTYMPMTVFESKPSIGHTLLLLLVDTSLKSLEAENAGWTFEEKKNCGRIKISNEKTHIDVPMYAIPKEKFQEKQTAADSAHLIKSDSMFESLALNRAGLESYVVESDKVNLAIREGTRRWSISDPKIVEDWFNESCDRIGSHLRYICRFMKAWRDAQWDVGGPSSISLMAAVVNILDKEAHDGADLTGTMKLVARLLPDEFNHGLESPDDTDTKLLFPAERDQNVHQRTIIETMRRLHGILLAAESSESREDALRKINEAFGKRVTNASLITSIAAAPAFLNSPSKEPASKPINKTMVSG

SEQ ID NO: 2347 - protein, 432 aa, Rahnella sp.
MHWDFNNYYSHNVDGLISKLKLSKTESNTLRALRQTVRERTRDVFKEAREVATDVRRQALTLENVRLKLEKTNVRYLSPADRADLARLIFEMEDVARDDFIKYQPRFATQGSFQYDTLNRPFHPGQEMDIDDGTYMPMTVFESKPSIGHTLLLLLVDTSLKSLEAENAGWTFEEKNTCGRIKIPHEKTHIDVPMYAIPKDKFQEKQTAADSAHLIKSDSMFESLALNRAGLASYVVESDKVNLAIREGTKRWSISDPKIVEDWFNESCNRIGGHLRYICRFMKAWRDAQWDVGGPSSISLMAAIVNILDRKAHNGADLTGTMKLVASLLPEEFNHGLESPDDTDAKLLFPAERDQNVHQRTIVETMESLHGILLDAESSESREDALRKINEAFGKRVTNASLITSIAAAPAFLNSPTKDPVFKPINKTMVSG

SEQ ID NO: 2348 - protein, 433 aa, Unknown
  Description of Unknown: Enterobacteriaceae sequence
MRWDFNNYYSHSVDGLISKLKLGKTESDKLKALRQKVRERTRDVFKEARQIATDARKQTLTLESVRFKLEQTNVRYLSPSDRETLARLIFEMEDVARDDFIKFQPRFWTQGSFQYDTLNRPFHPGQEMDIDDGTYMPMTVFESEPSIGHTLLLLLVDTSLKSLEAENDGWVYEEKNTCGRIKIPHEKTHIDVPMYAIPKEQFQTKQTAADSAHIIKSADSMFESLSANMDMREAYLVEPDKVNLALRQGARRWSISDPKIVEDWFNDSCKRIGGHLRSICRFMKAWRDAQWEVGGPSSISLMAAVVNILDREAHNGSDLTGTMKLVARLLPNEFCRGLESPDDTDEKLLFPAECDHNVHQRTIVETMRNLEGILLDAESSSSREEALRKINNAFGKRVTNASLITSIAAAPAFQISPSKEQAPVKINTTMVSG

SEQ ID NO: 2349 - protein, 433 aa, Unknown
  Description of Unknown: Enterobacter cloacae complex sequence
MRWDFNNYYSHSVDGLISKLKLGKTESDKLKALRQKVRERTRDVFKEARQIATDVRKQTLTLESVRFKLEQTNVRYLSPSDRETLARLIFEMEDVARDDFIKFQPRFWTQGSFQYDTLNRPFHPGQEMDIDDGTYMPMTVFESEPSIGHTLLLLLVDTSLKSLEAENDGWVYEEKNTCGRIKIPHEKTHIDVPMYAIPKEQFQTKQTAADSAHIIKSADSMFESLSANMDMREAYLVEPDKVNLALRQGARRWSISDPKIVEDWFNDSCQRIGGHLRSICRFMKAWRDAQWEVGGPSSISLMAAVVNILDREAHNGSDLTGTMKLVARLLPNEFCRGLESPDDTDEKLLFPAECDHNVHQRTIVETMRNLEGILLDAESSSSREEALRKINNAFGKRVTNASLITSIAAAPAFQISPSKEQAPVKINTTMVSG

SEQ ID NO: 2350 - protein, 433 aa, Enterobacter cloacae
MRWDFNNYYSHSVDGLISKLKLGKSESDKLKALRQKVRERTRDVFKEARQIATDARKQTLTLESVRFKLEQTNVRYLSPSDRETLARLIFEMEDVARDDFIKFQPRFWTQGSFQYDTLNRPFHPGQEMDIDDGTYMPMTVFESEPSIGHTLLLLLVDTSLKSLEAENDGWVYEEKNTCGRIKIPHEKTHIDVPMYAIPKEQFQTKQTAADSAHIIKSADAMFESLSANMDTREAYLVEPDKVNLALRQGARRWSISDPKIVEDWFNDSCKRIGGHLRSICRFMKAWRDAQWEVGGPSSISLMAAVVNILDREAHNGSDLTGTMKLVAGLLPNEFCSGLESPDDTDEKLLFPAECDHNVHQRTIVETMRNLEGILLDAESSNSREEALRRINDAFGKRVTNASLIISIAAAPAFQISPSKEQAPVKINTTMVSG

SEQ ID NO: 2351 - protein, 432 aa, Lonsdalea populi
MRWDFNNYYSHNVDGLISKLKLGKTESDKLKALRQKVRERTRDVFKEAREVATDVRRQTLTLESVRLKLEQTNVRYLSPSDRADLARLIFEMEDEARDDFIKFQPRFWTQGSFQYDTLNRPFHPGQEMDIDDGTYMPMTVFESEPSIGHTLLLLLVDTSLKSLEAENDGWRFEEKNTCGRIKIPHEKTHIDVPMYAIPKEQFQTKQTAADSAHVIKANSMFESVAMNRDLREAYVVESDKVNLALRDGVKRWSISDPKIVEDWFNDSCKRIGGHLRSICRFMKAWRDAQWEVGGPSSISLMTAVVNILDREDHNGSDLTETMKLVARLLPDEFCSGLESPDDTDDKLLFPAECDHNVHQRTIVETMRSLQGILLDAESSGSREDALHKMNEAFGKRVTNASLITSIAAAPAFHNLPSKEPAPVKINKTMVSG

SEQ ID NO: 2352 - protein, 432 aa, Klebsiella sp.
MSWDFNNYYSHNTDGLISKLKLAKTESDKLKALRQKVRERTRDVFKEAREVATDVRKQTLTLESVRLKLEQTNVRYLSPSDRADLARLIFEMEDEARDDFIKFQPRFWTQGSFQYDTLNRPFHPGQEMDIDDGTYMPMTVFESEPSIGHTLLLLLVDTSLKSLEAENDGWKFEEKNTCGRIKIPREKTHIDVPMYAIPKELFQKKQTAADSAHLIKADSMFESVALNQDSREAYIVESDKVNLALREGARRWSISDPKIVEDWFNDSCKRIGGHLRSICRFMKAWRDAQWEVGGPSSISLMAAVVNILDREEHNGSDLAGTMKLVARLLPDEFCDGLESPDDTDEKLLFPAECDHNVHQRTIVKTMRNLHGILLDAELSVSREDALRKINEAFGKRVSNASLITSIVAAPAFHNSPSKEQAPTKINKTMVSG

SEQ ID NO: 2353 - protein, 433 aa, Yersinia kristensenii
MRWDFNNYYSHNVDGLISKLKLSKSESTKLKELRQIVRERTRDVFKEARAVATDVRTCALTLEGVRLELAQTNVRYLSGADQAEVARLIFEMDDEARDDFIKLQPRFWTQGSFQYDTLNRPFHPGQEMDIDDGTYMPMTVFGAEPRIGHTLLLLLVDTSLKSLEAENDGWWFEEKNTCGRIKIPRERTHIDVPMYAIPKEQFQTKQTAADSAHLIKSADAMFESLSANIDMREAYLVESDKVNLALRDGERRWSISDPKIVEDWFNDSCKRIGGHLRSVCRFMKAWRDAQWNVGGPSSISLMTAVVNILDKEDHNGSDLTGTMKLVAKLLPDEFSNGLKSPDDTDEKLLFPVECDHNVHQRTIVETMRSLHGIFLDAECASSRDDALQKMNEAFGKRVTNASLITSIAAAPAFHDAPSKEPAPTKINKTMVSG

SEQ ID NO: 2354 - protein, 432 aa, Escherichia coli
MHWDLNNYYSNNMDGLISKLKLSKTESTKLKELRQIVRERTRDVFKEARAVAADVKKHTLTLEGVRLKLGQTNVRYLSTADQAEVARLIFEMDDDARNDFINLQPRFWTQGSFQYDTLNKPFQPGQEMDIDDGTYMPMTVFESEPRIGHTLLLLLVDTSLKSLEAENDGWRFEEKNTCGRIKIPHEKTHIDVPMYAIPKNQFQTKQTAADSAHILKSESIFESVALNRDSREAYLVESDKVNLALREGAKRWSISDPKIVEDWFNDSCKRIGGHVRSICRFMKAWRDAQWDVGGPSSISLMTAVVNILNREEHNDSDLAGTMKLVAKLLPDEFNRGLESPDDTDTKLLFPAEWDQNVHQKTIVETMKTLYEILVDAENANTREDALHKMNEAFGKRVTNAQLITSIAAAPAFHVSPSREPEPRKINKTMVSG

SEQ ID NO: 2355 - protein, 432 aa, Escherichia albertii
MYWDLNNYYSNNMDGLISKLKLSKAESMKLKELRQIVRERTRDVFKEARAVAADVKKYTLTLEGVRLKLGQTNVRYLSTADQAEVARLIFEMDDDARDDFINLQPRFWTQGSFQYDTLNKPFQPGQEMDIDDGTYMPMTVFESEPRIGHTLLLLLVDTSLKSLEAENDGWRFEEKNTCGRIKIPHEKTHIDVPMYAIPKDQFQTKQTAADSAHKLKADSIFESVALNRDSREAYLVESGKVNLALREGAKRWSISDPKIVEDWFNDSCKRIGGHVRSICRFMKAWRDAQWDVGGPSSISLMTAVVNILNREEHNDSDLAGTMKLVARLLPDEFNRGLESPDDTDTKLLFPAECDQNVHQKTIVETMKALHEILVDAENANTREDALRKMNEAFGKRVTNAHLITSIAAAPAFHVSPSKESEPKKINKTMVSG

SEQ ID NO: 2356 - protein, 169 aa, Escherichia coli
MHWDLNNYYSNNMDGLISKLKLSKTESTKLKELRQIVRERTRDVFKEARAVAADVKKHTLTLEGVRLKLGQTNVRYLSTADQAEVARLIFEMDDDARNDFINLQPRFWTQGSFQYDTLNKPFQPGQEMDIDDGTYMPMTVFESEPRIGHTLLLLLVVDLPLYFQTPVIT

SEQ ID NO: 2357 - protein, 434 aa, Vibrio mimicus
MTWNFHQYYTNRNDGLMGKLVLTDEEKNNLKALRKIIRLRTRDVFEEAKGIAKAVKKSALTFEIIQEKVSTTQIKHLSDSEQREVAKLIYEMDDDARDEFLGLTPRFWTQGSFQYDTLNRPFQPGQEMDIDDGTYMPMPIFESEPKIGHSLLILLVDASLKSLVAENHGWKFEAKQTCGRIKIEAEKKHIDVPMYAIPKDEFQKKQIALEANRSFVKGAIFESYVADSITDDSETYELDSENVNLALREGDRKWINSDPKIVEDWFNDSCIRIGKHLRKVCRFMKAWRDAQWDVGGPSSISLMAATVNILDSVAHDASDLGETMKIIAKHLPGEFARGVESPDSTDEKPLFPPSYKHGPREMDIMSKLERLPEILSSAESADSKSEALKKINMAFGNRVTNSELIVLAKALPAFAQEPSSASKPEKISRTMVSG

SEQ ID NO: 2358 - protein, 436 aa, Vibrio mimicus
MRMTWNFHQYYTNRNDGLMGKLVLTDEEKNNLKALRKIIRLRTRDVFEEAKGIAKAVKKSALTFEIIQEKVSTTQIKHLSDSEQREVAKLIYEMDDDARDEFLGLTPRFWTQGSFQYDTLNRPFQPGQEMDIDDGTYMPMPIFESEPKIGHSLLILLVDASLKSLVAENHGWKFEAKQTCGRIKIEAEKKHIDVPMYAIPKDEFQKKQIALEANRSFVKGAIFESYVADSITDDSETYELDSENVNLALREGDRKWINSDPKIVEDWFNDSCIRIGKHLRKVCRFMKAWRDAQWDVGGPSSISLMAATVNILDSVAHDASDLGETMKIIAKHLPGEFARGVESPDSTDEKPLFPPSYKHGPREMDIMSKLERLPEILSSAESADSKSEALKKINMAFGNRVTNSELIVLAKALPAFAQEPSSASKPEKISRTMVSG

SEQ ID NO: 2359 - protein, 436 aa, Vibrio cholerae
MRMTWNFHQYYTNRNDGLMGKLVLTDEEKNNLKALRKIIRLRTRDVFEEAKGIAKAVKKSALTFEIIQEKVSTTQIKHLSDSEQREVAKLIYEMDDDARDEFLGLTPRFWTQGSFQYDTLNRPFQPGQEMDIDDGTYMPMPIFESEPKIGHSLLILLVDASLKSLVAENHGWKFEAKQTCGRIKIEAEKTHIDVPMYAIPKDEFQKKQIALEANRSFVKGAIFESYVADSITDDSETYELDSENVNLALREGDRKWINSDPKIVEDWFNDSCIRIGKHLRKVCRFMKAWRDAQWDVGGPSSISLMAATVNILDSVAHDASDLGETMKIIAKHLPGEFARGVESPDSTDEKPLFPPSYKHGPREMDIMSKLERLPEILSSAESADSKSEALKKINMAFGNRVTNSELIVLAKALPAFAQEPSSASKPEKISSTMVSG

SEQ ID NO: 2360 - protein, 436 aa, Vibrio albensis
MRMTWNFHQYYTNRNDGLMGKLVLTDEEKNNLKALRKIIRLRTRDVFEEAKGIAKAVKKSALTFEIIQEKVSTTQIKHLSDNEQREVAKLIYEMDDDARDEFLGLTPRFWTQGSFQYDTLNRPFHPGQEMDIDDGTYMPMPIFESEPKIGHSLLILLVDASLKSLVAENHGWKFEAKQTCGRIKIEAEKTHIDVPMYAIPKDEFQKKQIALEANRSFVKGAIFESYVADSITDDSETYELDSENVNLALREGDRKWINSDPKIVEDWFNDSCIRIGKHLRKVCRFMKAWRDAQWNVGGPSSISLMAATVNILDSVAHDASDLGETMKIIAKHLPGEFARGVESPDSTDEKPLFPPSYKHGPREMDIMSKLERLPEILSSAESADSKSEALKKINMAFGNRVTNSELIVLAKALPAFAQEPSSASKPEKISSTMVSG

SEQ ID NO: 2361 - protein, 436 aa, Vibrio cholerae
MRMTWNFHQYYTNRNDGLMGKLVLTDEEKNNLKALRKIIRLRTRDVFEEAKGIAKAVKKSALTFEIIQEKVSTTQIKHLSDSEQREVAKLIYEMDDDARDEFLGLTPRFWTQGSFQYDTLNRPFQPGQEMDIDDGTYMPMPIFESEPKIGHSLLILLVDASLKSLVAENHGWEFEAKQTCGRIKIEAEKTHIDVPMYAIPKDEFQKKQIALEANRSFVKGAIFESYVADSITDDSETYELDSENVNLALREGDRKWINSDPKIVEDWFNDSCIRIGKHLRKVCRFMKAWRDAQWDVGGPSSISLMAATVNILDSVAHDASDLGETMKIIAKHLPSEFARGVESPDSTDEKPLFPPSYKHGPREMDIMSKLERLPEILSSAESADSKSEALKKINMAFGNRVTNSELIVLAKALPAFAQEPSSASKPEKISSTMVSG

SEQ ID NO: 2362 - protein, 434 aa, Vibrio cholerae
MTWNFHQYYTNRNDGLMGKLVLTDEEKNNLKALRKIIRLRTRDVFEEAKGIAKAVKKSALTFEIIQEKVSTTQIKHLSDSEQREVAKLIYEMDDDARDEFLGLTPRFWTQGSFQYDTLNRPFQPGQEMDIDDGTYMPMPIFESEPKIGHSLLILLVDASLKSLVAENHGWEFEAKQTCGRIKIEAEKTHIDVPMYAIPKDEFQKKQIALEANRSFVKGAIFESYVADSITDDSETYELDSENVNLALREGDRKWINSDPKIVEDWFNDSCIRIGKHLRKVCRFMKAWRDAQWDVGGPSSISLMAATVNILDSVAHDASDLGETMKIIAKHLPSEFARGVESPDSTDEKPLFPPSYKHGPREMDIMSKLERLPEILSSAESADSKSEALKKINMAFGNRVTNSELIVLAKALPAFAQEPSSASKPEKISSTMVSG

SEQ ID NO: 2363 - protein, 434 aa, Vibrio cholerae
MTWNFHQYYTNRNDGLMGKLVLTDEEKNNLKALRKIIRLRTRDVFEEAKGIAKAVKKSALTFEIIQEKVSTTQIKHLSDSEQREVAKLIYEMDDDARDEFLGLTPRFWTQGSFQYDTLNRPFQPGQEMDIDDGTYMPMPIFESEPKIGHSLLILLVDASLKSLVAENHGWKFEAKQTCGRIKIEAEKTHIDVPMYAIPKDEFQKKQIALEANRSFVKGAIFESYVADSITDDSETYELDSENVNLALREGDRKWINSDPKIVEDWFNDSCIRIGKHLRKVCRFMKAWRDAQWDVGGPSSISLMAATVNILDSVAHDASDLGETMKIIAKHLPSEFARGVESPDSTDEKPLFPPSYKHGPREMDIMSKLERLPEILSSAESADSKSEALKKINMAFGNRVTNSELIVLAKALPAFAQEPSSASKPEKISSTMVSG

SEQ ID NO: 2364 - protein, 385 aa, Vibrio cholerae
MRMTWNFHQYYTNRNDGLMGKLVLTDEEKNNLKALRKIIRLRTRDVFEEAKGIAKAVKKSALTFEIIQEKVSTTQIKHLSDSEQREVAKLIYEMDDDARDEFLGLTPRFWTQGSFQYDTLNRPFQPGQEMDIDDGTYMPMPIFESEPKIGHSLLILLVDASLKSLVAENHGWKFEAKQTCGRIKIEAEKTHIDVPMYAIPKDEFQKKQIALEANRSFVKGAIFESYVADSITDDSETYELDSENVNLALREGDRKWINSDPKIVEDWFNDSCIRIGKHLRKVCRFMKAWRDAQWDVGGPSSISLMAATVNILDSVAHDASDLGETMKIIAKHLPSEFARGVESPDSTDEKPLFPPSYKHGPREMDIMSKLERLPEILSSAESADS

SEQ ID NO: 2365 - protein, 258 aa, Vibrio cholerae
MTWNFHQYYTNRNDGLMGKLVLTDEEKNNLKALRKIIRLRTRDVFEEAKGIAKAVKKSALTFEIIQEKVSTTQIKHLSDSEQREVAKLIYEMDDDARDEFLGLTPRFWTQGSFQYDTLNRPFQPGQEMDIDDGTYMPMPIFESEPKIGHSLLILLVDASLKSLVAENHGWKFEAKQTCGRIKIEAEKTHIDVPMYAIPKDEFQKKQIALEANRSFVKGAIFESYVADSITDDSETYELDSENVNLALREGDRKWLVVA

SEQ ID NO: 2366 - protein, 241 aa, Vibrio cholerae
MRKIIRLRTRDVFEEAKGIAKAVKKSALTFEIIQEKVSTTQIKHLSDSEQREVAKLIYEMDDDARDEFLGLTPRFWTQGSFQYDTLNRPFQPGQEMDIDDGTYMPMPIFESEPKIGHSLLILLVDASLKSLVAENHGWKFEAKQTCGRIKIEAEKTHIDVPMYAIPKDEFQKKQIALEANRSFVKGAIFESYVADSITDDSETYELDSENVNLALREGDRKWINSDPKIVEDWFNDSCTYW

SEQ ID NO: 2367 - protein, 349 aa, Vibrio cholerae
MRMTWNFHQYYTNRNDGLMGKLVLTDEEKNNLKALRKIIRLRTRDVFEEAKGIAKAVKKSALTFEIIQEKVSTTQIKHLSDSEQREVAKLIYEMDDDARDEFLGLTPRFWTQGSFQYDTLNRPFQPGQEMDIDDGTYMPMPIFESEPKIGHSLLILLVDASLKSLVAENHGWKFEAKQTCGRIKIEAEKTHIDVPMYAIPKDEFQKKQIALEANRSFVKGAIFESYVADSITDDSETYELDSENVNLALREGDRKWINSDPKIVEDWFNDSCIRIGKHLRKVCRFMKAWRDAQWDVGGPSSISLMAATVNILDSVAHDASDLGETMKIIAKHLPSEFARGVESPDSTDE

SEQ ID NO: 2368 - protein, 434 aa, Vibrio sp.
MTWNFHQYYTNRNDGLMGKLVLTDEEKNNLKALRKIIRLRTRDVFEEAKGIAKAVKKSALTFEIIQEKVSTTQIKHLSDNEQREVAKLIYEMDDDARDEFLGLTPRFWTQGSFQYDTLNRPFQPGQEMDIDDGTYMPMPIFESEPKIGHSLLILLVDASLKSLVAENHGWKFEAKQTCGRIKIEAEKTHIDVPMYAIPKDEFQKKQIALEANRSFVKGAIFESYVADSITDDSETYELDSENVNLALREGDRKWINSDPKIVEDWFNDSCIRIGKHLRKVCRFMKAWRDAQWDVGGPSSISLMAATVNILDSVAHDASDLGETMKIIAKHLPGEFARGVESPDSTDEKPLFPPSYKHGPREMDIMSKLERLPEILSSAESADSKSEALKKINMAFGNRVTNSELIVLAKALPAFAQEPSSASKPEKISSTMVSG

SEQ ID NO: 2369 - protein, 434 aa, Vibrio sp.; identical to SEQ ID NO: 2368

SEQ ID NO: 2370 - protein, 434 aa, Vibrio albensis
MTWNFHQYYTNRNDGLMGKLVLTDEEKNNLKALRKIIRLRTRDVFEEAKGIAKAVKKSALTFEIIQEKVSTTQIKHLSDNEQREVAKLIYEMDDDARDEFLGLTPRFWTQGSFQYDTLNRPFHPGQEMDIDDGTYMPMPIFESEPKIGHSLLILLVDASLKSLVAENHGWKFEAKQTCGRIKIEAEKTHIDVPMYAIPKDEFQKKQIALEANRSFVKGAIFESYVADSITDDSETYELDSENVNLALREGDRKWINSDPKIVEDWFNDSCIRIGKHLRKVCRFMKAWRDAQWNVGGPSSISLMAATVNILDSVAHDASDLGETMKIIAKHLPGEFARGVESPDSTDEKPLFPPSYKHGPREMDIMSKLERLPEILSSAESADSKSEALKKINMAFGNRVTNSELIVLAKALPAFAQEPSSASKPEKISSTMVSG

SEQ ID NO: 2371 - protein, 436 aa, Vibrio sp.
MRMTWNFHQYYTNRNDGLMGKLVLTDEEKNNLKALRKIIRLRTRDVFEEAKGIAKAVKKSALTFEIIQEKVSTTQIKHLSDNEQREVAKLIYEMDDDARDEFLGLTPRFWTQGSFQYDTLNRPFQPGQEMDIDDGTYMPMPIFESEPKIGHSLLILLVDASLKSLVAENHGWKFEAKQTCGRIKIEAEKTHIDVPMYAIPKDEFQKKQIALEANRSFVKGAIFESYVADSITDDSETYELDSENVNLALREGDRKWINSDPKIVEDWFNDSCIRIGKHLRKVCRFMKAWRDAQWDVGGPSSISLMAATVNILDSVAHDASDLGETMKIIAKHLPGEFARGVESPDSTDEKPLFPPSYKHGPREMDIMSKLERLPEILSSAESADSKSEALKKINMAFGNRVTNSELIVLAKALPAFAQEPSSASKPEKISSTMVSG

SEQ ID NO: 2372 - protein, 436 aa, Vibrio albensis; identical to SEQ ID NO: 2360

SEQ ID NO: 2373 - protein, 434 aa, Vibrio sp.
MTWNFHQYYTNRNDGLMGKLVLTDEEKNNLKALRKIIRLRTRDVFEEAKGIAKAVKKSALTFEIIQEKVSTTQIKHLSDNEQREVAKLIYEMDDDARDEFLGLTPRFWTQGSFQYDTLNRPFHPGQEMDIDDGTYMPMPIFESEPKIGHSLLILLVDASLKSLVAENYGWKFEAKQTCGRIKIEAEKTHIDVPMYAIPKDEFQKKQIALEANRSFVKGAIFESYVADSITDDSETYELDSENVNLALREGDRKWINSDPKIVEDWFNDSCIRIGKHLRKVCRFMKAWRDAQWDVGGPSSISLMAATVNILDSVAHDASDLGETMKIIAKHLPGEFARGVESPDSTDEKPLFPPSYKHGPREMDIMSKLERLPEILSSAESADSKSEALKKINMAFGNRVTNSELIVLAKALPAFAQEPSSASKPEKISRTMVSG

SEQ ID NO: 2374 - protein, 434 aa, Vibrio sp.; identical to SEQ ID NO: 2373

SEQ ID NO: 2375 - protein, 436 aa, Vibrio sp.
MRMTWNFHQYYTNRNDGLMGKLVLTDEEKNNLKALRKIIRLRTRDVFEEAKGIAKAVKKSALTFEIIQEKVSTTQIKHLSDNEQREVAKLIYEMDDDARDEFLGLTPRFWTQGSFQYDTLNRPFHPGQEMDIDDGTYMPMPIFESEPKIGHSLLILLVDASLKSLVAENYGWKFEAKQTCGRIKIEAEKTHIDVPMYAIPKDEFQKKQIALEANRSFVKGAIFESYVADSITDDSETYELDSENVNLALREGDRKWINSDPKIVEDWFNDSCIRIGKHLRKVCRFMKAWRDAQWDVGGPSSISLMAATVNILDSVAHDASDLGETMKIIAKHLPGEFARGVESPDSTDEKPLFPPSYKHGPREMDIMSKLERLPEILSSAESADSKSEALKKINMAFGNRVTNSELIVLAKALPAFAQEPSSASKPEKISRTMVSG

SEQ ID NO: 2376 - protein, 419 aa, Vibrio cholerae
MMGKLVLTDEEKNNLKALRKIIRLRTRDVFEEAKGIAKAVKKSALTFEIIQEKVSTTQIKHLSDSEQREVAKLIYEMDDDARDEFLGLTPRFWTQGSFQYDTLNRPFQPGQEMDIDDGTYMPMPIFESEPKIGHSLLILLVDASLKSLVAENHGWKFEAKQTCGRIKIEAEKTHIDVPMYAIPKDEFQKKQIALEANRSFVKGAIFESYVADSITDDSETYELDSENVNLALREGDRKWINSDPKIVEDWFNDSCIRIGKHLRKVCRFMKAWRDAQWDVGGPSSISLMAATVNILDSVAHDASDLGETMKIIAKHLPSEFARGVESPDSTDEKPLFPPSYKHGPREMDIMSKLERLPEILSSAESADSKSEALKKINMAFGNRVTNSELIVLAKALPAFAQEPSSASKPEKISSTMVSG

SEQ ID NO: 2377 - protein, 418 aa, Vibrio cholerae
MGKLVLTDEEKNNLKALRKIIRLRTRDVFEEAKGIAKAVKKSALTFEIIQEKVSTTQIKHLSDSEQREVAKLIYEMDDDARDEFLGLTPRFWTQGSFQYDTLNRPFQPGQEMDIDDGTYMPMPIFESEPKIGHSLLILLVDASLKSLVAENHGWKFEAKQTCGRIKIEAEKTHIDVPMYAIPKDEFQKKQIALEANRSFVKGAIFESYVADSITDDSETYELDSENVNLALREGDRKWINSDPKIVEDWFNDSCIRIGKHLRKVCRFMKAWRDAQWDVGGPSSISLMAATVNILDSVAHDASDLGETMKIIAKHLPSEFARGVESPDSTDEKPLFPPSYKHGPREMDIMSKLERLPEILSSAESADSKSEALKKINMAFGNRVTNSELIVLAKALPAFAQEPSSASKPEKISSTMVSG

SEQ ID NO: 2378 - protein, 404 aa, Vibrio cholerae
MHYATTIRLRTRDVFEEAKGIAKAVKKSALTFEIIQEKVSTTQIKHLSDSEQREVAKLIYEMDDDARDEFLGLTPRFWTQGSFQYDTLNRPFQPGQEMDIDDGTYMPMPIFESEPKIGHSLLILLVDASLKSLVAENHGWKFEAKQTCGRIKIEAEKTHIDVPMYAIPKDEFQKKQIALEANRSFVKGAIFESYVADSITDDSETYELDSENVNLALREGDRKWINSDPKIVEDWFNDSCIRIGKHLRKVCRFMKAWRDAQWDVGGPSSISLMAATVNILDSVAHDASDLGETMKIIAKHLPSEFARGVESPDSTDEKPLFPPSYKHGPREMDIMSKLERLPEILSSAESADSKSEALKKINMAFGNRVTNSELIVLAKALPAFAQEPSSASKPEKISSTMVSG

SEQ ID NO: 2379 - protein, 380 aa, Vibrio cholerae
MKKSALTFEIIQEKVSTTQIKHLSDSEQREVAKLIYEMDDDARDEFLGLTPRFWTQGSFQYDTLNRPFQPGQEMDIDDGTYMPMPIFESEPKIGHSLLILLVDASLKSLVAENHGWKFEAKQTCGRIKIEAEKTHIDVPMYAIPKDEFQKKQIALEANRSFVKGAIFESYVADSITDDSETYELDSENVNLALREGDRKWINSDPKIVEDWFNDSCIRIGKHLRKVCRFMKAWRDAQWDVGGPSSISLMAATVNILDSVAHDASDLGETMKIIAKHLPSEFARGVESPDSTDEKPLFPPSYKHGPREMDIMSKLERLPEILSSAESADSKSEALKKINMAFGNRVTNSELIVLAKALPAFAQEPSSASKPEKISSTMVSG

SEQ ID NO: 2380 - protein, 378 aa, Vibrio cholerae
KSALTFEIIQEKVSTTQIKHLSDSEQREVAKLIYEMDDDARDEFLGLTPRFWTQGSFQYDTLNRPFQPGQEMDIDDGTYMPMPIFESEPKIGHSLLILLVDASLKSLVAENHGWKFEAKQTCGRIKIEAEKTHIDVPMYAIPKDEFQKKQIALEANRSFVKGAIFESYVADSITDDSETYELDSENVNLALREGDRKWINSDPKIVEDWFNDSCIRIGKHLRKVCRFMKAWRDAQWDVGGPSSISLMAATVNILDSVAHDASDLGETMKIIAKHLPSEFARGVESPDSTDEKPLFPPSYKHGPREMDIMSKLERLPEILSSAESADSKSEALKKINMAFGNRVTNSELIVLAKALPAFAQEPSSASKPEKISSTMVSG

SEQ ID NO: 2381 - protein, 434 aa, Vibrio anguillarum
MKMAWNFHQYYTNRNDGLMGKLVLTDEEKNNLKALRKIIRLRTRDVFEEAKGIAKAVKKSVLTFEIIQEKVSKTKIKHLSDSDQREVAKLIHEMDDDARDEFLGLTPRFCTQGSFQYDTLNRPFQPGQEMDIDDGTYMPMPIFESEPKIGHSLLILLVDASLKSLVAENYGWKFEPKQTCGRIKIEAEKTHIDVPMYAIPKDEFMKKQVALNANRSFLESVACESYVYDSDDTDSYEVDSENVNLALREGERKWINSDPKIVEDWFNDSCGRIGKHLRKVCRFMKAWRDAQWDVGGPSSISLMAATVNILDRVSHDSCDLGETMKIVAKNLPGEFARGVESPDDTDEKPLFPPSYKHGRREMDIMSKLERLPEILSSAESAGSKFEALKMINMAFGNRVTNSDLIVLAKALPAFAQEPSSASKPEKISSTMVSG

SEQ ID NO: 2382 - protein, 432 aa, Vibrio harveyi
MAWNFHQYYTNRNDGLMGKLVLTDEEKNNLKALRKIIRLRTRDVFEEAKGIAKAVKKSVLTFEIIQEKVSKTKIKHLSENDQLEVAKLIYEMDEDARDEFLGLTPRFWTQGSFQYDTLNRPFQPGQEMDIDDGTYMPMPIFESEPKIGHSLLILLVDASLKSLVAENHGWKFEPKQTCGRIKIEAEKTHIDVPMYAIPKDEFMKKQVALSANRSFFESVGCESYVCDSDDTDSYEVDSENVNLALREGERKWINSDPKIVEDWFNDSCGRIGKHLRKVCRFMKAWRDAQWDVGGPSSISLMAATVNILDRVSHDSSDLGETMKIVAKNLPGEFARGVDSPDDTDEKPLFPPSYKHGPREMDIMSKLERLPEILSSAESAGSKFEALKMINMAFGNRVTNSDLIVLAKALPAFAQEPSSASKPEKISSTMVSG

SEQ ID NO: 2383 - protein, 432 aa, Vibrio harveyi; identical to SEQ ID NO: 2382

SEQ ID NO: 2384 - protein, 434 aa, Vibrio harveyi
MKMAWNFHQYYTNRNDGLMGKLVLTDEEKNNLKALRKIIRLRTRDVFEEAKGIAKAVKKSVLTFEIIQEKVSKTKIKHLSENDQLEVAKLIYEMDEDARDEFLGLTPRFWTQGSFQYDTLNRPFQPGQEMDIDDGTYMPMPIFESEPKIGHSLLILLVDASLKSLVAENHGWKFEPKQTCGRIKIEAEKTHIDVPMYAIPKDEFMKKQVALSANRSFFESVGCESYVCDSDDTDSYEVDSENVNLALREGERKWINSDPKIVEDWFNDSCGRIGKHLRKVCRFMKAWRDAQWDVGGPSSISLMAATVNILDRVSHDSSDLGETMKIVAKNLPGEFARGVDSPDDTDEKPLFPPSYKHGPREMDIMSKLERLPEILSSAESAGSKFEALKMINMAFGNRVTNSDLIVLAKALPAFAQEPSSASKPEKISSTMVSG

SEQ ID NO: 2385 - protein, 432 aa, Vibrio parahaemolyticus
MAWNFHQYYTNRNDGLMGKLVLTDEEKNNLKALRKIIRLRTRDVFEEAKGIAKAVKKSVLTFEIIQEKVSKTKIKHLSENDQREVAKLIYEMDEDARDEFLGLTPRFWTQGSFQYDTLNRPFQPGQEMDIDDGTYMPMPIFESEPKIGHSLLILLVDASLKSLVAENHGWKFEPKQTCGRIKIEAEKTHIDVPMYAIPKDEFMKKQVALSANRSFLESVGCESYVCDSDDTDSYEVDSENVNLALREGERKWINSDPKIVEDWFNDSCGRIGKHLRKVCRFMKAWRDAQWDVGGPSSISLMAATVNILDRVSHDSSDLGETMKIVAKNLPGEFARGVESPDDTDEKPLFPPSYKHGRREMDIMSKLERLPEILSSAESADSKSEALKKINAAFGNRVTNSDLIVLAKALPAFAQEPSSASKPEKISSTMVSG

SEQ ID NO: 2386 - protein, 430 aa, Vibrio parahaemolyticus
MTWNFHQYYTNRNDGLMGKLVLTDEEKNNLKALRKIIRLRTRDVFEEAKGIAKAVKKSVLTFEIIQEKVSKTKIKHLSESDQREVAKLIHDMDDDARDEFLGLTPRFWTQGSFQYDTLNRPFQPGQEMDIDDGTYMPMPIFESEPKVGHSLLILLVDASLKSLVAENHGWKFEAKQTCGRIKIEAEKTHIDVPMYAIPKDEFVKKQVALKANRSLLDSVICESYDSDDIDSYEVDSENVNLALREGERKWANSDPKIVEDWFNDSCGRIGKHLRKVCRFMKAWRDAQWDVGGPSSISLMAATVNILDRVSHDSSDLGETMKIVAKNLPGEFARGVDSPDDTDEKPLFPPSYKHGRREMDIMSKLERLPDILSSAESADSKSEALKKINMAFGNRVTNSDLIVLAKALPAFAQEPSSASKPEKISSTMVSG

SEQ ID NO: 2387 - protein, 432 aa, Vibrio parahaemolyticus
MAWNFHQYYTNRNDGLMGKLVLTDEEKNNLKALRKIIRLRTRDVFEEAKGIAKAVKQSVLTFEIIQEKVSKTKIKYLSENDQREVAKLIHEMDEDTRDEFLGLTPRFWTQGSFQYDTLNRPFQPGQEMDIDDGTYMPMPIFESEPKIGHTLLVLLVDASLKSLVAENSGWKFEAKQTCGRIKIEGEKTHIDVPMYAIPKDEFMKKQVALKANRSLLENVGCESYFYDSDDTDSYEVDSENVNLALREGERKWVNSDPKIVEDWFNDSCVRIGKHLRKVCRFMKAWRDAQWDVGGPSSISLMAATVNILDRVSHDSSDLGETMKIVAKNLPDEFARGVESPDDTDEKPLFPPSSKHGRREMDIMSKLERLPSILSSAELADSKSEALKKINMAFGSRVTNSDLIVLAKALPAFAQEPSSASKPEKINSTMVSG

SEQ ID NO: 2388 - protein, 432 aa, Salinivibrio sp.
MAWNFHHYYTNRNDGLMGKLVLSDEEKKNLKALRKIIRLRTRDVFEEAKGIAKAVKKSVLTFEIIQEKVSKTKIKHLSESDQREVAKLIHEMDEDARDEFLGLTPRFWTQGSFQYDTLNRPFQLGQEMDIDDGTYMPMTIFESEPKIGHSLLILLVDASLKSLVAENHGWTFEAKQTCGRIKIEAEKTHIDVPMYAILKDEFVKKQVALKANRSLLESASCESYGYDSDDSDSYEVDSENVNLALREGERKWVNSDPKIVEDWFNDSCGRIGKYLRKVCRFMKAWRDVQWDVGGPSSISLMAATVNILDRVSHDSSDLGETMKIVAKNLPDEFARGVESPDDTDEKPLFPPSSKHGRREMDIMSKLERLHSILSSAELADTKSEALKKINMAFGNRVTKSELIVLAEALPAFAQEPSSTSKPEKISSTMVSG

SEQ ID NO: 2389 - protein, 434 aa, Salinivibrio kushneri
MKMAWNFHHYYTNRNDGLMGKLVLSDEEKKNLKALRKIIRLRTRDVFEEAKGIAKAVKKSVLTFEIIQEKVSKTKIKHLSESDQREVAKLIHEMDEDARDEFLGLTPRFWTQGSFQYDTLNRPFQLGQEMDIDDGTYMPMTIFESEPKIGHSLLILLVDASLKSLVAENHGWTFEAKQTCGRIKIEAEKTHIDVPMYAILKDEFVKKQVALKANRSLLESASCESYGYDSDDSDSYEVDSENVNLALREGERKWVNSDPKIVEDWFNDSCGRIGKYLRKVCRFMKAWRDVQWDVGGPSSISLMAATVNILDRVSHDSSDLGETMKIVAKNLPDEFARGVESPDDTDEKPLFPPSSKHGRREMDIMSKLERLHSILSSAELADTKSEALKKINMAFGNRVTKSELIVLAEALPAFAQEPSSTSKPEKISSTMVSG

SEQ ID NO: 2390 - protein, 432 aa, Salinivibrio kushneri
MAWNFHHYYTNRNDGLMGKLVLSDEEKKNLKALRKIIRLRTRDVFEEAKGIAKAVKKSVLTFEIIQEKVSKTKIKHLSESDQREVAKLIHEMDEDARDEFLGLTPRFWTQGSFQYDTLNRPFQLGQEMDIDDGTYMPMTIFESEPKIGHSLLILLVDASLKSLVAENHGWTFEAKQTCGRIKIEAEKTHIDVPMYAIPKDEFVKKQVALKANRSLLESASCESYGYDSDDSDSYEVDSENVNLALREGERKWVNSDPKIVEDWFNDSCGRIGKYLRKVCRFMKAWRDVQWDVGGPSSISLMAATVNMLDRVSHDSSDLGETMKIVAKNLPDEFARGVESPDDTDEKPLFPPSSKHGRREMDIMSKLERLHSILSSAELADTKSEALKKINMAFGNRVTKSELIVLAEALPAFAQEPSSTSKPEKISSTMVSG

SEQ ID NO: 2391 - protein, 435 aa, Vibrio cholerae
MRMTWNFHQYYTNRTDGLIGKLVLTEEEKNNLKALRHIIRLRIRDVFEEAKDIAKAVKKTVLTFDIIQEKVSKTKIKHLSDLDQLKVAKLIHEMDDDARDEFLGLTPRFWTQGSFQYDTLNRPFQSGQEMDIDDGTYMPMPIFESEPKIGHSLLILLVDASLKSLVAENNGWKFEAKQTCGRIKIVAEKTHIDVPMYAIPKDEFMKKQVVLKATNRSLFESASCESYVCDSADIDSYEVDSENVNLALREGERKWVNSDPKIVEDWFNDSCERIGKHLRKVCRFMKAWRDAQWDVGGPSSISLMTATVNILDRVSHDPSDLGETMKIVANNLPDEFARGIDSPDDTDEKPLFPPSYLHGPREIDIMSKLEGLPDILLSAELANSKSEALSKINTAFGSRVTNSDLIVSAKALPAFAQEPSSASKPEKISSTMVSG

SEQ ID NO: 2392 - protein, 431 aa, Moritella marina
MTWNFHHYYTNRKDGLIGKLVLTDIEKNKLKALRQIVRSRIKDIFEEAKSIAKNVNRSIQTLDSIEGKLALTKIKYLSDDEKRKIALLIYNMDDEARNEFMNLTPRFWTQGSFQYDTLNRPFHPGQEMDIDDGTYMPMPIFESEPKIGHTLLILLVDASLKSLEAENSGWTFEAKRTCGRIKIRGENTHIDVPMYAIPKDQFLKKQIALEAINNNLILGSCESESFAVDSESYEIESECVNLALRDGETKWMNSDPKIVEDWFNDSCSRIGKHLRKVSRFMKAWRDAQWEVGGPSSISLMAATVNILNRVSHEDNDLGEIMKLMAKHLPEEFAKGIESPDDTDEKLLFPPSSEHGAREIDIMGRLECLSGILLRAETALSKAEALRIINEAFGHRVTDSDLIVLTKAAPAFTHEPNSAKSATTINSTMVSG

SEQ ID NO: 2393 - protein, 429 aa, Alcanivorax sp.
MAWNFHHYYTNRTEGLIGKLRLNDDDENKLKGLREIVRQRTKHVFEEAKAIAKEVKKCQLSQESVQMMLANTKLRYLSEDDRRQVAMLLYDMDDEARDEFLNLSPRFWTQGSFQYDTLNRPFHPGQEMDIDDGTYMPMPIFESEPKIGHTLLLLLVDSSLKSLEAENDGWIFQVKQTCGRIKIPREKTHIDVPMYAIPKDQFLQKQLALEALSARSDSAMNKSYIDFHDSYEVDSEHVNLALRDGPQKWVNSDPKIVEDWFNRSCNRIGKSLRLVCRFMKAWRDAQWEVGGPSSISLMAATVNILDRVSYDKTDLGETIKVVAQHLPGEFAKGIASPDNTDDKLLFPAQSEHGPREQDIMSRLEELSVILYEAECASSKQSALDTINRAFGRRVTDCNLIVSAPAAPAFKDEPESASSYTKISSTMTSG

SEQ ID NO: 2394 - protein, 433 aa, Dickeya chrysanthemi
MTWNFHHYYTNHTDGLIGALLLKKQEKEKLKALRQKVRIRTKDVFEEATSIAKEVKQCMLTLDNLRSRLSNTTLRYLSDDDQREVAKLIYDMDDEVRDEFLGLTPRFWTQGSFQYNTLNRPFHLGQEMDIDDGTYMPMTMFESKPRIGHKLLLLLVDSSLKSLAAENPGWVFEAKQTCARIKIPAEKTHIDVPMYAIPKDEFLKKQIAMECRASLNKAVCDSLDYAGMEDYRRNYEVDSENVNLALRDGDKGWTNSDPKIVEDWFNDSCRRIGVHLREVCRFMKAWRDAQWDIGGPSSISLMAATVNILDKVPHDKEDIGATMKIVAEHLPYEFAKGVDSPDDTDDKRLFPPRSEHGRREHDIMDKLESLSGILIEAESAESKQKALEKINTAFGNRVTDYTLIVTTQAVPAFKTAAASASSPKKINSTMVSG

SEQ ID NO: 2395 - protein, 429 aa, Kosakonia radicincitans
MTWNFHQYYTNRTEGLIGQLILSDQEKEKLKALRQKVRLRTRDVFEEAKAIAADVKRNGSVVESVKSKLSHTKLRYLSEEDQQKVAKLIFDMDDDAREEFLKLVPRFWTQGSFQYNTLNRPFHQGQEMDIDDGTYLPMPIFENEPKIGHTLLLLLVDSSLKSLEAENSGWYFEEKRTCGRIKIPKEKTHIDVPMYAIPKEQFLKKEIALNKSLESYNYTADSALTESRSAYEVNSENVNLALRDGMPKWFNSDPKIVEDWFNDSCIRIGSHLRKVCRFMKAWRDAQWDVGGPSSISLMAATVNILDKVPCDKNDLGLTMKIVAEHLPSEFTNGILSPDDTDEKPLFPPYAAHGQRENAIMEKLERLSGILAEAENAGSKQDALKIMNTAFGNRVTNSSLIVVSQAAPAFIASPSEASKPTKISNTMVSG

SEQ ID NO: 2396 - protein, 432 aa, Pantoea stewartii
MTWNFHQYYTHPTDGLIGQLILSEQDKDKLKALRRKVRVRTRDIFEEARKIAAEVKNQGLEVESVKSKLSDTKLKYLSEEQQQEVARLICDMDEDARKEFLELVPRFWTQGSFQYNTLNRPFQLGQEMDIDDGTYLPMSIFESKPKIGHTLLLLLVDSSLKSLEAENSGWHFEAKKTCGRIKIPYEKTHIDVPMYAIPKEEFLKKEIALSKGFESFELRKDAADSAINESLSAYEVNSENVNLALREGMPKWLNSDPKVVEDWFNDSCDRIGSQLRKVCRFMKAWRDAQWKVEGPSSISLMAATVSILDKFPCNKNDIGATMKIVAQHLPSVYKNGIISPDDSDDKPLFPPHHEHTEKENAIMEKIIKLHEILVEAEDASSKQDALSIINKAFGNRVTNSSLIVATLAAPAFIKSPSEASKPTKISTTMVSG

SEQ ID NO: 2397 - protein, 428 aa, Aeromonas salmonicida
MTWNFHEYYTNNENGLMGKLVLSANEKKQLINLRQVIRWRTKEVFEEAKNIASSISTLENIEHRLINTKLIYLSKVERNQIAKLIYDMDEDARQEFLDLTPRFWTQGSFQYDTLNRPFHPGQEMDIDDGTYMPMPIFEAEPKIGHSLLLLLVDSSLKSLVAEYDGWIYEAKQTCGRIKIPSNKTHIDVPMYAIPKDQFLQKQTAMAKCRARVGSESIFESYAMDSDDTSYEVDTKHVNLALRDGSKKWLNSDPKIVEDWFNDSCIRIGQHLREVCRFMKAWRDAQWEVGGPSSISLMAATVNVMDRVSHDSKNMGETMKIVAEHLPEEFKNGIESPDSTDEKPLFPPFNEHGSREKDIMEKLNKLHNILLEAEVAESKQNALSKINKAFGQRVSDHNIIISEAAAPVFRETASTASAASKISSTMVSG

SEQ ID NO: 2398 - protein, 389 aa, Aeromonas salmonicida
RTKEVYEEEKNIASSISTLENIEHRLINTKLIYLSKVERNQIAKLIYDMDEDARQEFLDLTPRFWTQGSFQYDTLNRPFHPGQEMDIDDGTYMPMPIFEAEPKIGHSLLLLLVDSSLKSLVAEYDGWIYEAKQTCGRIKIPSNKTHIDVPMYAIPKDQFLQKQTAMAKCRARVGSESIFESYAMDSDDTSYEVDTKHVNLALRDGSKKWLNSDPKIVEDWFNDSCIRIGQHLREVCRFMKAWRDAQWEVGGPSSISLMAATVNVMDRVSHDSKNMGETMKIVAEHLPEEFKNGIESPDSTDEKPLFPPFNEHGSREKDIMEKLNKLHNILLEAEVAESKQNALSKINKAFGQRVSDHNIIISEAAAPVFRETASTASAASKISSTMVSG

SEQ ID NO: 2399 - protein, 332 aa, Aeromonas salmonicida
HRLINTKLIYLSKVERNQIAKLIYDMDEDARQEFLDLTPRFWTQGSFQYDTLNRPFHPGQEMDIDDGTYMPMPIFEAEPKIGHSLLLLLVDSSLKSLVAEYDGWIYEAKQTCGRIKIPSNKTHIDVPMYAIPKDQFLQKQTAMAKCRARVGSESIFESYAMDSDDTSYEVDTKHVNLALRDGSKKWLNSDPKIVEDWFNDSCIRIGQHLREVCRFMKAWRDAQWEVGGPSSISLMAATVNVMDRVSHDSKNMGETMKIVAEHLPEEFKNGIESPDSTDEKPLFPPFNEHGSREKDIMEKLNKLHNILLEAEVAESKQNALSKINKAFGQRVS

SEQ ID NO: 2400 - protein, 432 aa, Aeromonas hydrophila
MAWNFHEYYTNHDSGLIGKLILAENEKNQLKELRQIIRWRTKEVFEEAKVIAEEVKLQTLTLERVQTRLTSTKLMYLSKKEQHKVAQLICDMDDEAREEFLSLTPRFWTQGSFQYDTLNRPFHPGQEMDIDDGTYMPMPIFESEPKIGHSLLLLLVDSSLKSLAAENDGWIYEAKQTCGRIKIPSKKTHIDVPMYAIPKDQFIQKQTAMAKCRAKVATESIFESYAMDSADTSYNVDSEHVNLALRDGSKKWLNSDPKIVEDWFNDSCNRIGQHLRKVCRFMKAWRDAQWEVGGPSSISLMAATVNILDRVSHNPENMGETMKIIAKHLPEEFSNGVESPDSTDDKPLFPPFYEHGDRERDIIEKLSRLHGILLEAEVTESKTHALDTINVAFGKRVEDHTLIIDEKAAPAFKEVASTASAPAIISSTMVSG

SEQ ID NO: 2401 - protein, 433 aa, Unknown
  Description of Unknown: Alteromonas sequence
MTWNFHGYYTNRSEGLISKLTLKSAQSEALKSLRKCVRVRIKEVFEEAKELVRASYNSSLNFEELKAKVQNTKIKYLNSEAQSEVIQLLQGMDEVTRQEFVGLTPRFWTQGSFQYETLNNPHKFPPQEMDIDDGTYLPMTIFENEPRIGHRILLLLVDSSLKSLVAENDGWLFEEKNTCARIKIPSAHTHIDVPMYAIPVQQFLQKQVALEALRKKSFESYDQFADTWISNSAMYEVDSECVNLAMRNGEKRWINSDPKIIEDWFNESCRRIGRHLRKVCRFMKAWRDAQWDKGGPSSIALMAATVNILDRFTHDKSDLGATMRLLAERLPEEFAHGVESPDHTDEKLLFPNSSEHGERELEVINKLYQLKKILVDAEVAESKELALQTMSLAFGDRVTNSDLIVKKQSAAAFAHEPSSSSDAKKISTTMSSG

SEQ ID NO: 2402 - protein, 434 aa, Pseudomonas syringae
MTWNFHRYYSDSTDGLISKLRLAKERIEMLKALRKKVRVRTKEVFAEAKELAKTSNASISLESFTARVASTRLKHLSPAAQVEVAQLIRGMEEDARRAFLSLNPRFWTQGSFQYDTLNNPYATPPQEMDIDDGTYLPMAIFEDRPVIGHRLLLLLVDSSLNSLADENPGWLFEANSKCARIKIPEMNTHFDVPMYAIPEDQFILKEAALAKSMGTESFESAEPFKDSLFFNRADYELDENSVNLAVRGEGQKWIKSDPKIVEDWFNDSCLRIGPHLREICRFMKSWRDVQWVKGGGPSSISLMAATVEILDRIPHDKADLGKTMKIVAHNFSAEFSKGVESPDHTDEKPLFPPHYEHQVREREIMEKLSELEGILDQAEEAQTKELALQSISRAFGRRVTKSELIVTVQSAPAFSEAPSTGSKAASISTTMASG

SEQ ID NO: 2403 - protein, 434 aa, Pseudomonas syringae
MTWNFHRYYSDSTDGLISKLRLAKERIEMLKALRKKVRVRTKEVFAEAKELAKTSNASISLESFTARVASTRLKHLSPAAQVEVAQLIRGMEEDARRAFLSLNPRFWTQGSFQYDTLNNPYATPPQEMDIDDGTYLPMAIFEDRPVIGHRLLLLLVDSSLNSLADENPGWLFEANSKCARIKIPEMNTHIDVPMYAIPEDQFILKEAALAKSMGTESFESAEPFKDSLFFNRADYELDENSVNLAVRGEGQKWIKSDPKIVEDWFNDSCLRIGPHLREICRFMKSWRDVQWVKGGGPSSISLMAATVEILDRIPHDKADLGKTMKIVAHNFSAEFSKGVESPDHTDEKPLFPPHYEHQVREREIMEKLSELEGILDQAEEAQTKELALQSISRAFGRRVTKSELIVTVQSAPAFSEAPSTGSKAASISTTMASG

SEQ ID NO: 2404 - protein, 434 aa, Aeromonas salmonicida
MSWNFHRYYSDSTDGLISKLKLADERIATLKRLRKQVRIRTKVVFEEAKQLAKASNPASSFESMKLQVENSRLKHLSPQDQVEVAVLIKDMDPDARKAFLSLTPRFWTQGSFQYDTLNNPYFTPPQEMDIDDGTYLPMTIFEDQPVIGHRLLLLLVDSSLKSLADENEGWEFEAQSKCARLKIPDMNTHIDVPMYAIPEEQFLLKEAAFSKSQSNVAMDSAIMGTESLACNRADYSLDEGCVNLAIRDGKQRWIKSDPKIVEDWFNDCCRRIGPHLRDVCRFMKSWRDVQWKDGGGPSSISLMAATVSILDRVPHDKNDLGATMKLLARYLPTEFSNGVESPDHTDEKPLFPPCNEHGERERGIMEKLSELAVILDDAEKCLTKPLALSSINRAFGCRVNKSDLIVSAPSAPAFAGEPSRGSQAARISSTMASG

SEQ ID NO: 2405 - protein, 430 aa, Pseudomonas simiae
MTWNFHRYYNDSTDGLIGKLRLAEPRVAKLKGLRELVRNRTRDVFNEAKEVVKTSSANISLESITARVANTRLKYLSPQAQAEAAKLLRDMDDDAREAFLALTPRFWTQGSFQYDTLNFPYASPPQEMDIDDGTYLPMAIFEGRPIIGHQLLLLLVDSSLKSLVHENVGWQFEAKRTCARLKIPAEHTHIDVPMYAIPKDQFLLKEAALAKSRSTVFDSINGSLSLESADYELDEDCVNLALREGDQKWMKSDPKIVEDWFNDSCRRIGPHLRSVCRFMKSWRDVQWEKGGGPSSISLMAATVSILDRIAHDKNDLGATMRMLAKYLPDEFSKGVESPDHTDEKPLFPPRIEHGERELEIMERLSELHGILIDAQQCSSKELALQSINRAFGRRVLKSDLIVSEKSAPAFANEPKRGAQATTISTTMASG

SEQ ID NO: 2406 - protein, 436 aa, Halomonas sp.
MTWNFHRYYNDPSDGLIGKLKLSDSRVTELKQLRAKIRDRTKKVFEEAKELVQTSSLTSSLESFKARLSDTNLKYLSDEDQAEIATLLWHMDEDARNSFRNLKPRFWTQGSFQYDTLNNPYATPPQEMDIDDGTYLPMEVFKGKPVIGHRLLILLVDSSLKSLEKENAGWQFDSSKATCARLKIPAKHTHIDVPMYAIPKDQFLHKEESIAVAKSRGSGMEAMDSISGSIMLNREDYRLDEDCVNLALREGEKKWIKSDPKVIEDWFIESCERIGPDLRKVCRFMKSWRDAQWQEGGGPSSISLMAATVSIFDRVPLQKGDLGAAMMSLAENLPGEFSNGVESPDDTDEKPLFPGHREHGDNEREVIKRLSELQGILVEAQNSSTKVIALDSINRAFGQRVIKSELIVREVSAPAFASEPSRGNEAASISSTMASG

SEQ ID NO: 2407 - protein, 436 aa, Halomonas sp.
MNWNFHRYYNDPSDGLIGKLKLSEQRVTELKQLRAKIRDRTKEVFEEAKALVQTSNLTSSLESFKARISDTNLKHLSDEDQAEIAILLLNMDEDARNSFRNLKPRFWTQGSFQYDTLNNPYATPPQEMDIDDGTYLPMEVFKGKPVIGHRILILLVDSSLKSLEKENAGWQFDSSKATCARLKIPAKHTHIDVPMYAIPKDQFLLKEESIAVAKSRGLGMEAMDSISGSIMLNREDYRLDEDCVNLALREGEKKWIKSDPKTIEDWFVESCERIGPDLRKVCRFMKSWRDAQWQDGGGPSSISLMAATVSIFDKVPLQKGDLGAAMMSLTENLPAEFFNGVKSPDLTVEKPLFPGHREHGEYEREVIKRLSELQEILIEAQKSSTKVLALDSINRAFGQRVIKSELIVSEVSAPAFVAEPSRGAQATSISPTMASG

SEQ ID NO: 2408 - protein, 372 aa, Vibrio ichthyoenteri
KLNKHDVWLRVSNTKLKYLSPEEQVKVAELIYLMDDEARKEFSDLSPRFWTQGSFKYDTLNKPFHPGQEMDIDDGTYLPMPIFESDPKVGHTLLILLVDSALKSLAAERSGWVFETKRTCGRIKIKHEKTHIDVPMYAIPKDQFLKKEKAMKMAMNRSLILGSLEAEDAKPESYEVDTESVNLALRDGEKKWLNSDPKIVEDWFEHSRKRIGNHLPKVCRYLKAWRDVQWQVGGPSSISLMAAIVSILDTTPHNKDDFDATMKVITDNLHKEFGKGIESPDHTANSLLFPPLNQHTKREDDIMAKLEALPNILQRAENAISKQDALSIINTAFGHRVTKEELIVSAPAAPAFSIEPEPSSSAAKISSTMVSG

SEQ ID NO: 2409 - protein, 441 aa, Aliivibrio fischeri
MNWNLHHYYTNRTEGLMGKLLLNKEEDERLLYLRNTVRKRITNVFEEVGAIAKDQAAFNQNRDYLFFRLQKTKVRYLDQLEILEVSRLLSQMDKDTLKELSTLKPRFWTQGSFKYKTLNRPFHAGQEMDIDDGAYLPMTFFESEPKIGHQLLTLLVDASLKSLVDENYGWEFDSKRTCARIKISLEQTHIDVPMYAIPKEQFLQKEAAVLKAVNSRAMCESAGMESFGFTLDSADDREYKKLDSENVNLALRDEKPGSSKWMNSDPKIVEDWFEGECCRIGKHLRKVCRFMKAWRDAQWQVGGPSSISLMAATVEVLQQHSVDAQDMGETMKVVAENLYYEFLKGVESPDDTDERPLFPQESQHTNRERDIVGKLKLLPEQLRQAEMADTKSDALSRLSLVFGERVFDKELIKHKAAAPAFLQEPTKANSSEKISSSMVSG

SEQ ID NO: 2410 - protein, 441 aa, Vibrio alginolyticus
MNWNLHHYYTNRTDGLMGKLLLSIEEDEKLLYLRNTIRKRITNVFEEIGAVAKEQAAFSQKSEYLYSRLQNTKLRYLTHQKITEASSLLSQMDKDTLKELSVLKPRFWTQGSFKYRTLNRPFHPGQEMDIDDGTYLPMTFFESEPKIGHQLLTLLVDASLMSLVEENVGWEFDSKRTCARIKIPQERTHIDVPMYAIPKEQFLEKEAAVLKAFNSRGMYESVGTEAYGFIQDSADDLEYEKLDSENVNLALRDGEFGSPKWMNSDPKVVEDWFEGECRRIGKHLRKVCRYMKAWRDAQWQVGGPSSISLMAATVEVLQQHFVDAQDMGETMKVVADNLYQEFLKGVESPDGTDERPLFPPESQHSNRERDIVGKLRLLPEQLREAERAESKSDALSKLSLVFGERVFDRELIKHKAAAPAFSQEPTKANSSTQISSSMVSG

SEQ ID NO: 2411 - protein, 441 aa, Vibrio alginolyticus
MNWNLHHYYTNRKDGLMGKLLLSKEEDEKLLYLRNTIRKRITNVFEEIGAVAKDQAAFSQKSEYLYSRLQNTKLRYLTNQQITEASSLLSQMDKDTLKELSALKPRFWTQGSFKYRTLNRPFHPGQEMDIDDGTYLPMTFFESEPKIGHQLLTLLVDASLMSLVEENVGWEFDSKRTCARIKIPQERTHIDVPMYAIPKEQFLEKEAAVLKAFNRRGMYESVGTEAYGFIQDSADDLEYEKLDSENVNLALRDGEPGSAKWMNSDPKIVEDWFEGECRRIGKHLRKVCRYMKAWRDAQWQVGGPSSISLMAATVEVLQQHFVDAQDMGETMKVVADNLYQEFLKGVESPDSTDERPLFPPESQHTNRERDIVGKLRLLPEQLREAERAESKSDALSKLSLVFGERVFDPELIKHKAAAPAFSQEPTKANSSTQISSSMVSG

SEQ ID NO: 2412 - protein, 441 aa, Vibrio alginolyticus
MNWNLHHYYTNRKDGLMGKLLLSKEEDEKLLYLRNTIRKRITNVFEEIGAVAKDQAAFSQKSEYLYSRLQNTKLRYLTNQQITEASSLLSQMDKDTLKELSALKPRFWTQGSFKYRTLNRPFHPGQEMDIDDGTYLPMTFFESEPKIGHQLLTLLVDASLMSLVEENVGWEFDSKRTCARIKIPQERTHIDVPMYAIPKEQFLEKEAAVLKAFNRRGMYESVGTEAYGFIQDSADDLEYEKLDSENVNLALRDGEPGSAKWMNSDPKIVEDWFEGECRRIGKHLRKVCRYMKAWRDAQWQVGGPSSISLMAATVEVLQQHFVDAQDMGETMKVVADNLYQEFLKGVESPDGTDERPLFPPESQHTNRERDIVGKLRLLPEQLREAERAESKSDALSKLSLVFGERVFDQELIKHKAAAPAFSQEPTKANSSTQISSSMVSG

SEQ ID NO: 2413 - protein, 441 aa, Vibrio alginolyticus
MNWNLHHYYTNRTDGLMGKLLLSKEDDEKLLYLRNTIRKRITNVFEEIGAVAKDQAAFSQKSEYLYLRLQNTKLRYLTNQQITEASSLLSQMDKDTLKELSALKPRFWTQGSFKYRTLNRPFHPGQEMDIDDGTYLPMTFFESEPKIGHQLLTLLVDASLMSLVEENVGWEFDSKRTCARIKIPQERTHIDVPMYAIPKEQFLEKETAVLKAFNRRGMYESVGTEAYGFIQDSADDLEYEKLDSENVNLALRDGEPGSAKWMNSDPKIVEDWFEGECRRIGKHLRKVCRYMKAWRDAQWQVGGPSSISLMAATVEVLQQHFVDAQDMGETMKVVADNLYQEFLKGVESPDSTDERPLFPPESQHTNRERDIVGKLRLLPEQLREAERAESKSDALSKLSLVFGERVFDPELIKHKAAAPAFSQEPTKANSSTQISSSMVSG

SEQ ID NO: 2414 - protein, 437 aa, Photobacterium kishitanii
MNWNLHHYYTNRTDGLMGKLLLNKEEDERLLSLRNTIRKRITNTFEEIGAIAKDQAAFSQKSEYLYFRLQNTKLSYLTHHNIIEASRLLNQMDKDTLKELSVLKPRFWTQGSFKYKTLNRPFHPGQEMDIDDGTYLPMTFFASEPKIGHKLLTLLVDASLISLVEENVGWEFDSKRTCARIKIPQVRTHIDVPMYAIPKEQFLQKEAAALKALNNRSIYESAGIFTQDSADDLEYEKLDSENVNLALRDGELGSPKWMNSDPKIVEDWFEGECRRIGNHLRKVCRYMKAWRDAQWQVGGPSSISLMAATVEVLQQHSVDAQDMGETMKVVADNLYQEFLKGVESPDDTDERPLFPPESQHTNRERDIVGKLRLLPEQLREAERAESKSDALSKLSLVFGERVFDQELIKHKAAAPAFSQEPTKANSSTQISSSMVSG

SEQ ID NO: 2415 - protein, 436 aa, Unknown
  Description of Unknown: Vibrio sequence
MNWNLHSYYTNRNTGLIGCLQLSDQEETNLKGLRALVRKRITVVFAEATQVAKELVKEFSTEDTLRVKLLNTKVRYLSEQERNEVARLIFGMDEDVMREFVGLKPRFWTQGSFQYNTLNRPFHSGQEMDIDDGTYLPMTIFESEPKIGHQLLTLLVDSALKSLVVENKSWEFESKRTCARIKIPTERTHIDVPMYAIPKDKFLDKQVALEAAAHNRNMYESVQKSVMDSDDTQYQKLDSENVNLALRDDKPGSAKWMNSDPKIVEDWFNEECRRIGKHTRKVCRFMKAWRDAQWDIGGPTSISLMAATVEVLNRVQHDTQDMGSIMKVVADNLYLEFINGVESPDDTDEKPLFPPQSEHTDRERDIVEKLKMLPSILRQAEQSETKALALATLSEAFGSRVSDSSLIKGVHAAPAFREEPSQSRHPSKISSSMISG

SEQ ID NO: 2416 - protein, 435 aa, Unknown
  Description of Unknown: Alteromonadales sequence
MKWSLHTYYMGRDGSLLKKLELTDNENNKLKRLRAHVRKRIREVFDEVIEVAINFRKLESEEDVKGRLKSTRICHLSPAEQQTVARLIYEMEEDVRDGFIKLKPRFGTQGSFQYGTLNKPFWPCQEMDIDDGTYLPMTVFENPKIGHKLLTLLVDTSLKSLVAENPGWKFESKRTCARIKIAEENTHIDVPMYAIPDKGFITKDRSLGLESANNIYESLSHVKKAADSDDVMFERLDSKTVNLALRDEGPGTHKWMNSDPKIVEDWFNDACERIGSHVRPVCRFMKAWRDAQWDVGGPSSISLMAAAVEILSKHSVNSKDMGDIMKVVAKNFALEFKSGVESPDDTDNRPLFPAQMEHEDFHKGIVAKLEQLPASLQNAENASTKQDALSILSNIFGNRVTDENLIKIIAAAPAFNAEPAQSTSPTQISSSMVSG

SEQ ID NO: 2417 - protein, 433 aa, Acinetobacter calcoaceticus
MTWNFHSYYTNRDTGLLGQLILADHEKDGLKALRQVVRERTRDVFDEAKQLVKSSKQHYSALSFRAEFISTHFKYLSAEDQKTLSELIMDLSDDLKVEFMKISPRFWTQGSFMYDTLNRPYKSTQEMDIDDGTYLPMQFFEDKPAIGHQLLLLLVDASLKSLAVERYGWSFEAKETCGRINIPAKSVHIDVPMYAIPYDKFLEKEVLLKEAANTRLSMDIYDSITAADHALYDQLETDCVNLAVRKNDARWIKSDPKDVHLWFQDACQRTGQHLRKVCRILKAWRDACDWQESSGPSSISLMAAVVGILDHTTVEPKDFGLLILTVARKLPNTFRNGVESPDENDDRPLFPPYYEHEPKHKEVMQKLEQLVDSLESAYAAHTKQDALHILNGEYGDRVKDLSLIVSQAAAPAYESTPFKAKEAAIISTSMKSG

SEQ ID NO: 2418 - protein, 433 aa, Acinetobacter calcoaceticus; identical to SEQ ID NO: 2417

SEQ ID NO: 2419 - protein, 433 aa, Acinetobacter baumannii
MTWNFHSYYTNRDTGLIGQLILDDHDKDGLKALRQIVRERTRDVFDEAKQLVKSSKHHYTALSFRAEFVGTNFKYLSPDDQKILSELIMDLSEDLKAEFLKLNPRFWTQGSFMYDTLNRPYKPTQEMDIDDGTYLPMQFFEDKPAIAHQLLLLLVDASLKSLASERHGWSFEAKDTCGRIKIPAKSVHIDVPMYAIPYEKFLEKDVLLRKAAASQIFAEMYDGVAAADHALYDQLETDCVNLAVRKDDAKWIKSDPKDVHLWFQDACQRTGQHLRKVCRILKAWRDAGDWKESNGPSSISLMAAVVDILDRTYVDPKDFGLLMLTVARKLPNTFRNGVESPDENDERPLFPPHYEHEAKHKEVITKLEELVTSLESAYAAYTKQDALNILNGEYGDRVQDLSLIVSQAAAPAYESNPLKAKEAAIISTSMKSG

SEQ ID NO: 2420 - protein, 433 aa, Unknown
  Description of Unknown: Acinetobacter sequence
MTWNFHSYYTNRDTGLIGQLILDDHDKDGLKALRHIVRERTRDVFDEAKQLVKSSKHHYTALSFRAEFVGTNFKYLSPDDQKILSELIMDLSEDLKAEFLKLNPRFWTQGSFMYDTLNRPYKPTQEMDIDDGTYLPMQFFEDKPAIAHQLLLLLVDASLKSLASERHGWSFEAKDTCGRIKIPAKSVHIDVPMYAIPYEKFLEKDVLLRKAAASQIFAEMYDGVAAADHALYDQLETDCVNLAVRKDDAKWIKSDPKDVHLWFQDACQRTGQHLRKVCRILKAWRDAGDWKESNGPSSISLMAAVVDILDRTYVDPKDFGLLMLTVARKLPNTFRNGVESPDENDERPLFPPHYEHEAKHKEVITKLEELVTSLESAYAAYTKQDALNILNGEYGDRVQDLSLIVSQAAAPAYESNPLKAKEAAIISTSMKSG

SEQ ID NO: 2421 - protein, 433 aa, Acinetobacter pittii
MTWNFHSYYTNRDTGLIGQLILSDGEKESLKALRQIVRERTRDVFDEAKQLVNSSKHYYTALSFRAEFVGTNFKYLSPDDQKILSELIMDLSEDLKTEFLKLSPRFWTQGSFMYDTLNRPYKPTQEMDIDDGTYLPMQFFEDKPAIGHQLLLLLVDASLKSLAVERYGWSFEAKDTCGRIKIPAKSVHIDVPMYAIPYEKFLEKEVLLRKAANSQIFAEMYDGISAADHALYDQLETDCVNLAIRKDDAKWIKSDPKDVHLWFQDACQRTGQHLRKVCRILKAWRDAGDWQESNGPSSISLMAAVVDILDRTSVDPKDFGLLMLTVARKLPNTFRNGVESPDENDDRPLFPPYYEHEAKHNEVMTKLEELVSSLEAAYAARTKQDALNILNNEYGDRVQDISLIVSQTAAPAYESTPLKAKEAAIISTSMKSG

SEQ ID NO: 2422 - protein, 433 aa, Acinetobacter sp.
MTWNFHSYYTNRDTGLIGQLLLSDGEKESLKALRQIVRERTRDVFDEAKQLVKSSKLYYTALSFRAEFVGTNFKYLSPDDQKILSELIMDLSEDLKTEFLKLSPRFWTQGSFMYDTLNRPYKLTQEMDIDDGTYLPMQFFEDKPAIGHQLLLLLVDASLKSLAVERHGWSFEAKETCGRIKIPTRSVHIDVPMYAIPYEKFLEKEVLLRKAANSQIFAEMYDGLSTADHALYDQLETDCVNLAVRKDDAKWIKSDPKDVHLWFQDACQRTGQHLRKVCRILKAWRDAGDWKESNGPSSISLMAAVVDILDRTSVDPKNFGLLMLTVARKLPDTFRNGVESPDSNDERPLFPPIYEHEQRHTEVITKLKELVVSLEAAYAAHTKQDALNILNSEYGNRVQDLSLIVSQTAAPAYESTPLKAKQAAIISTSMKSG

SEQ ID NO: 2423 - protein, 432 aa, Acinetobacter sp.
MTWNFHSYYTNRDTGLIGQLFLSDGEKESLKALRQIVRERTRDVFDEAKQLVKSSKQFDTAQSFRAEFMGTNFKYLSVDDQKTLSELIINLSVDLKAEFMKISPRFWTQGSFMYDTLNRPYKPTQEMDIDDGTYLPMQFFEDKPAIGHQLLLLLVDASLKSLAVERHGWSFEAKDTCGRIKIPARSVHIDVPMYAIPYEKFLEKEVLLRKAANSQILAEMYDGLNADHALYDQLETDCVNLAIRKDDAKWIKSDPKDVHLWFQDACQRTGQHLRKVCRILKAWRDAGDWQESNGPSSISLMAAVVDILDRTSVDPKDFGLLMLTVARKLPDTFRNGIESPDPNDERPLFPSIHEHKLKDTEVIKKLKELVASLEAAYAAHTKQDALNILNSEYGNRVQDLSLIVSQTAAPAYESTPLKAKQAAIISTSMKSG

SEQ ID NO: 2424 - protein, 433 aa, Acinetobacter sp.
MTWNFHSYYTNRDTGLIGKLILADHEKDGLKALRQIVRERTRDVFDEARKLVKLSKQFDSAILLRYEFKNTHFNYLSGDDQRKLSELIMELSSDLIAEFMKINPRFWTQGSFMYDTLNRPYKPTQEMDIDDGTYLPMQFFEDKPAIGHQLLLLLVDASLKSLAAEHYGWSFEPKETCGRIKIPAESVHIDVPMYAIPFEKFIEKEELIRKSAASQIFGEMYDSVSAADHALYDQIETDCVNLAVRKDDAKWIKSDPKDVHLWFQDACQRTGQHLRKVCRILKAWRDAGDWQESNGPSSISLMAAVVDILDRTTVDPKDFGLLMLTVARELPDTFRNGVESPDENDERPLFPPYYEHEPKHKEVMQKLEQLVDSLESAYAAPTKQDALDILNGEYGDRVQDLSLIVSQAAAPAYKSAPLKAKEAAIISSSMKSG

SEQ ID NO: 2425 - protein, 434 aa, Psychrobacter arcticus
MTWNFHSYYTNRESGLLGQIILSDGEKESLKALRQIVRVRIRDTFNEAKQLVKLSKNYLSAASLLTEFVDTKFKYLKPEDQKILAELMIGLSDILKAEFMKLNPRFWTQGSFAYDTLNRPYRTPPQEMDIDDGAYLPMMFFEDKPAIGHKLLLLLVDASLYSLAAERSGWSFEPKEMCGRIKISARNVHIDVPMYAIPYEKFLEKEVLLEKAESLRIAIESYDSLSVADHALYDQLDADCVNLAVRIDNQKWIKSDPKDVHLWFQDACQRNGRHLRKICRVIKAWRDATDWQEGNGPSSISLMAAIVDIADRTELDTKDFGSMMLTVAKELPIVFRSGVESPDSNDERPLFPHIDDHEKKHTETISKLEDLASSLEAAYDAQTKQDALNTLNSEYGNRVTNSDLIVSQAAAPAYESGPTQAKSSTTISKSMKSA

SEQ ID NO: 2426 - protein, 429 aa, Acinetobacter bohemicus
MNWNLHHYYSNRTDGLMGQLLLSDKETADLKDLRQRVRERTRDIFAEAKNLVKHSKKDTSFASLREEMSATKFKYLSDSDQVKFAELIMQLDSDAKAEFLKLTPRFWTQGSFTYNTLNKPYFTPPQEMDIDDGTYLPMVFFNEKPIIGHQLLLLLVDTSLKSLVAENPTWTFDAKRTCGRITIPYLNAHVDVPMYAIPEDKFLEKEQVFKAAANTRFSYDSISVVDHKKYKLDSDCVNLAIRANDQKWMKSDPKVVSDWFEENCTRIGKHLRKICRFLKAWRDAQWETGGGPSSISLMAATVSILNKKYVDYQDFGTTMLTVAKELPMVFRNGVESPDDTDERPLFPPFYEQTREQQKIVEQMEVLVENLEKAFFAETKQKALDILNLNFGNRVTDCSLIVAQVAAPAFENEAAKASTVFQINPTMKSG

SEQ ID NO: 2427 - protein, 433 aa, Acinetobacter baumannii
MNWNFHQYYSNRTDGLMGQLLLSDKEKDALKALRDKVRERTRDIFVEAKKLVNQAKKDIGLEFLRVEMSLTNFKYLSQEDQNKFAELIIQLDSNAKAEFLKLTPRFWTQGSFTYNTLNKPYVTPPQEMDIDDGTYLPMVFFNEKPVIGHHLLLLLVDTSLKSLVAENPSWTFEAKRTCGRITIPHMNAHVDVPMYAIPEDKFLEKEQFFKEAANTRLTYDGYDSSVSIADQKKYKLDSDCVNLAIRAHDQKWMKSDPKVVSDWFEENCRRIGPHLRKICRFLKAWRDAQWEGGGGPSSISLMAATVNILNRKYIDNQDFGSTMLTIARELPNTFRNGVESPDDTDERPLFPPYSEHGEREREIIEKMQTLLINLENAFVADTKHEALNLLNLNFGDRVKDYSLIVSQTAAPAFEDEASQASTTFQISSTMISG

SEQ ID NO: 2428 - protein, 433 aa, Acinetobacter baumannii
MNWNFHHYYSNRTDGLMGQLLLSDREKDALKALRDKVRERTRDIFVEAKKLVNQAKKDIGLEFLRVEMSITNFRYLSQEDQNKFAELIIQLDSNAKAEFLKLTPRFWTQGSFTYNTLNKPYVTPPQEMDIDDGTYLPMVFFNEKPVIGHHLLLLLVDTSLKSLVAENPSWTFEAKRTCGRITIPHMNAHVDVPMYAIPEDKFLEKEQFFKEAANTRLTYDGYDSSVSIADQKKYKLDSDCVNLAIRAHDQKWMKSDPKVVSDWFEENCRRIGPHLRKICRFLKAWRDAQWEAGGGPSSISLMAATVNILNRKYIDNQDFGSTMLTIARELPNTFRNGVESPDDTDERPLFPPYSEHGKREREIIEKMQTLLTNLENAFVADSKHEALSLLNLNFGDRVKDYNLIVSQTAAPAFEDEASQASATFQISSTMISG

SEQ ID NO: 2429 - protein, 438 aa, Acinetobacter sp.
MGWNFHQYYSNRTDGLMGQLLLPERQNEALKALRQKVRIRTREIFEEAKGLVKQTSKNISLDSLNHEVSLSSFKHLSKLDQQRFAVLLAGLDANVKSEFLKLSPRFWTQGSFTYDTLNTPYKTPPQEMDIDDGTYLPMVFFDNKPIIGHRLLTMLVDTSLKSLVAENPGWEFEAKRTCGRIKVPHLHTHIDVPMYAIPEKQFLEKEVAFKMMAANSRLALDSIATVDEKKYELDSECVNLAIRDEDEKWMKSDPKVVDDWFRECCSRVGSHLRKVCRFLKAWRDAQWENGGGPSSISLMAATVTILDSTYHNPQNFGETMMVVAENLSATFRAGVESPDESDERPLFPCWYEHTERESLIIQKMDEFKQILKKAYSAPNKQEALFILNSMYGDRVQDSSLIILEQSAPAFAIEPAIATEPFKISSTMKSGINSTMKSG

SEQ ID NO: 2430 - protein, 430 aa, Klebsiella pneumoniae
MSWSFHRYYTNRTDGLISKLKLSDEKSGYLKALRKQIRARTRDVFEEAKKLAEETRTSTVNLREKVAATHFRHLSPEAQKEVEELINALGNEARESFLRLKPRFWTQGSFQYDTLNVPYSTPPQEMDIDDGTYLPMALFDDKPIIGHRLLLLLVDTSLKSLVAENDGWIFEAKRTCARIKIPSENTHIDVPMYAIPEDQFVLKEVAIESFRKMAFDSVDARAEAWMVNRDEYELDSDSVNLALREGEQKWAKSDPKIVEDWFLESCRVNGWHLRKVCRFMKAWRDAQWKEKGPSSISLMAATLNVLNKHTHDSTDLGATMSLIALHLPEEFRKGVESPDHTDDKPLFPPVETHGEWEQDVITKLEELKNYLSEADTAETKELALKALNKAFGDRVTDHDLIDRKVAGPAYHEEPSKALKPVVISQTMSSG

SEQ ID NO: 2431 - protein, 430 aa, Unknown
  Description of Unknown: Enterobacter cloacae complex sequence
MSWSFHRYYTNRTDGLISKLKLSDEKSGYLKALRKQIRARTRDVFEEAKKLAEETRTSTVNLREKVAATHFRHLSPEAQKEVEELINALGNEARESFLRLKPRFWTQGSFQYDTLNVPYSTPPQEMDIDDGTYLPMALFDDKPVIGHRLLLLLVDTSLKSLVAENDGWIFEAKRTCARIKIPSQNTHIDVPMYAIPEDQFVLKEVAVESFRKMIFDSVDARADAWMVNRDEYELDSDSVNLALREGEQKWAKSDPKIVEDWFLESCRVNGWHLRKVCRFMKAWRDAQWNEKGPSSISLMAATLNVLNKYTHDSTDLGATMSLIALHLPEEFRKGVESPDHTDDKPLFPPVEEHGEWEQDVITKLEELNNYLSEADAAETKQLALKALNKAFGDRVTDHDLIDRKVSGPAYHEEPSKALKPVVISQTMSSG

SEQ ID NO: 2432 - protein, 391 aa, Serratia marcescens
MSWSFHRYYTNRTDGLISKLKLSDEKSGYLKALRKQIRARTRDVFEEAKKLAEETRTSTVNLREKVAATHFRHLSPEAQKEFEELINALGNEARESFLRLKPRFWTQGSFQYDTLNVPYSTPPQEMDIDDGTYLPMALFDDKPIIGHRLLLLLVDTSLKSLVAENDGWIFEAKRTCARIKIPSENTHIDVPMYAIPEDQFVLKEVAIESFRKMAFDSVDARAEAWMVNRDEYELDSDSVNLALREGEQKWAKSDPKIVEDWFLESCRVNGWHLRKVCRFMKAWRDAQWKEKGPSSISLMAATLNVLNKFTHDSTDLGATMSLIALHLPEEFRKGVESPDHTDDKPLFPPVEAHGEWEQGVIIKLEELKNYLSEADTAETGNDTNVLISYFH

SEQ ID NO: 2433 - protein, 430 aa, Unknown
  Description of Unknown: Enterobacteriaceae sequence
MSWSFHRYYTNRTDGLISKLKLSDEKSGYLKALRKQIRARTRDVFEEAKKLAEETRTSTVNLREKVAATYFRHLSPEAQKEVEELINALGNEARESFLRLKPRFWTQGSFQYDTLNVPYSTPPQEMDIDDGTYLPMALFDDKPVIGHRLLLLLVDTSLKSLVAEHDGWIFEAKRTCARIKIPSENTHIDVPMYAIPEDQFVLKEVAVESFRKMTFDSVDARADAWMVNRDEYELDSDSVNLALREGEQKWAKSDPKIVEDWFLESCRVNGWHLRKVCRFMKAWRDAQWKEKGPSSISLMAATLNVLNKYTHDSTDLGATMSLIALHLPEEFRKGVESPDHTDDKPLFPPVEAHGEWEQDVITKLEELNNYLSEADAAETKELALKALNKAFGDRVTDHDLIDRKVAGPAYHEEPSKALKPVVISQTMSSG

SEQ ID NO: 2434 - protein, 430 aa, Enterobacter cloacae
MSWSFHRYYTNRTDGLISKLKLSDEKSGYLRALRKQIRARTRDVFEEAKKLAEETRTSTVNLREKVAVTHFRHLSPEAQKEVEELINALGDEARESFLRLKPRFWTQGSFQYDTLNMPYSTPPQEMDIDDGTYLPMALFDDKPVIGHRLLLLLVDTSLKSLVAENDGWTFEAKRTCARIKIPSENTHIDVPMYAIPEDQFVLKEVALESFRKMTFDSVDARADAWMVNRDEYELDSDSVNLALREGEQKWAKSDPKIVEDWFLESCRVNGWHLRKVCRFMKAWRDAQWKEKGPSSISLMAATLNVLNKYTHDSTDLGATMSLIALHLPEEFRNGVESPDHTDDKPLFPPVEAHGEWEQEVITKLEELNNYLSEADAAETKELALKALNKAFGDRVTDHDLIDRKVAGPAYHEEPSKALKPVVISQTMSSG

SEQ ID NO: 2435 - protein, 430 aa, Enterobacter cloacae
MSWSFHRYYTNRTDGLISKLKLSDEKSGYLRALRKQIRARTRDVFEEAKKLAEETRTSTVNLREKVAVTHFRHLSPEAQKEVEELINALGDEARESFLRLKPRFWTQGSFQYDTLNVPYSTPPQEMDIDDGTYLPMALFDDKPVIGHRLLLLLVDTSLKSLVAENDGWTFEAKRTCARIKIPSENTHIDVPMYAIPEDQFVLKEVALESFRKMTFDSVDARADAWMVNRDEYELDSDSVNLALREGEQKWAKSDPKIVEDWFLESCRVNGWHLRKVCRFMKAWRDAQWKEKGPSSISLMAATLNVLNKYTHDSTDLGATMSLIALHLPEEFRNGVESPDHTDDKPLFPPVEAHGEWEQEVITKLEELNNCLSEADAAETKELALKALNKAFGDRVTDHDLIDRKVAGPAYHEEPSKALKPVVISQTMSSG

SEQ ID NO: 2436 - protein, 430 aa, Unknown
  Description of Unknown: Klebsiella sequence
MSWSFHRYYTNRTDGLISKLKLSDEKSGYLKALRKQIRARTRDVFEEAKKLAEETRTSTVNLREKVAATHFRHLSPEAQKEFEELINALGNEARESFLRLKPRFWTQGSFQYDTLNVPYSTPPQEMDIDDGTYLPMALFDDKPIIGHRLLLLLVDTSLKSLVAENDGWIFEAKRTCARIKIPSENTHIDVPMYAIPEDQFVLKEVAIESFRKMAFDSVDARAEAWMVNRDEYELDSDSVNLALREGEQKWAKSDPKIVEDWFLESCRVNGWHLRKVCRFMKAWRDAQWKEKGPSSISLMAATLNVLNKFTHDSTDLGATMSLIALHLPEEFRKGVESPDHTDDKPLFPPVEAHGEWEQGVIIKLEELKNYLSEADTAETKELALKALNKAFGDRVADHDLIDRKVAGPAYHEEPSKALKPVVISQTMSSG

SEQ ID NO: 2437 - protein, 437 aa, Marinomonas sp.
MLWDLHGYYSNRSEGLISKLKLSETQDDGLKNLRRIVRKRITTVFEEIQDLAKKNVASYNSMSVSILKENVSHTSIKHLTPDEQDTVVNLLYNMDSNVTSDFLRLKPRFWTQGSYQYGTLNLPYISPPQEMDIDDGVYLPMALFEEKPVIAHELLLLLVDSSLKSLVAEHNGWEFEAKRTCARIKIPEANTHIDVPMYAIPEEKFITKEIAEAKAYNRQRQAFDSSDVSLESYRKEEIKVDRNCVNLALRDDEKKWLKSDPRIVEDWFNQSSQRIGSHLKKLCRFIKSWRDAQWPNGGGPSSISLMAATVEILNTHPHDETNFGETMKLIANKLPETFNAGVESPDDTDEKPLFPPFSEQDLTQKEIVNRMKELEPSLIESEMAPTKYASLLKINEAFGNRVSNHELITTKPAAPAFKDEPSVSAKPQTISSTFTSG

SEQ ID NO: 2438 - protein, 431 aa, Marinobacterium sp.
MTWNIHYYLANQQEGLISTLELSTSQKSFLSGLKDQVRNRTKEVFDEAKRIAREVIEENLSTVSLQSKISNSYLGYLSTAERTEISLLLQNMSKNERDAFRSISPRFWIQGSYKYNTLNQPYHKPPQEMDIDDGTYLPMDIFDNKPSVGHRLLILLVDASLKSLEVQNKHNGWEFIGDKPTCSRLKIPSKHVHIDVPMYAVPKEEFKRKEEALAILKASEAYRDFSMQALSESTQLESDSVYLAVRTEDKWKKSDPKIVADWFAQSVKEIGIHLRVLCRILKAWRDVQWDKGGPSSICLMKCAVDTLRRNPHDGSDLGETLRLLASHLPNQLLEGVRSPDPTDGDRLLFPSANEHSRKETEIVERARDLTSTLERALVTDTKSEALRILQTLFGSRVTNEELIKHRDAAPAYKEEPAKTKPVYISDTMASG

SEQ ID NO: 2439 - protein, 436 aa, Unknown
  Description of Unknown: Enterobacter cloacae complex sequence
MKWSAHLYLSSSNDGLMKRLEPTREDVTFLEKLKTTIRARTKDVFEEAKDVIKMLIKTPNNSINMLFVENAVQNTFLRYLDPEDIQQVAKLLFNMSDDARKAFLSTEPRFWVQGSYNYKTLNKPYHLPPQQMDIDDGTYMPMEMFKEQPLVGHRLLLLLVDASLASLAKENVGWIASKLPNCGRIIVKEKDVHVDVPMYAIPKEQFVAREVAASRITMDSMDAITANESYRSKSAKVQLEEDCVYLAVRGNDKWIKSDPETVARWFRKAVSRHKEPMRQICRYLKAWRDVQWEHPDLSSIALMKCVVDTFNNIEMPNSLDHSELLLTVTERLPAQLTEGVKSPDTSDDGRLLFPKANMDKAAINKIISKAEELHSTLNTALKDSPTKKQTLQLLNELFGDGVLNEEIIKPWASMPAYQQPRQPQPQNQMKDSMTSG

SEQ ID NO: 2440 - protein, 432 aa, Unknown
  Description of Unknown: Aeromonas sequence
MKWSAHLYLTNTNDGLMKRLEPTSTDKASLEKLKDTIRIRTKGVFTEAKDVVKMLASRSRSSTNIQLVESAIRKTNLRYLDNADVQRVVKLLLDMSDDARGAFLNTEPRFWVQGSYKYKTLNKPYHKPPQQMDIDDGTYMPMDMFKEQPLVGHELLLLLVDASLASLAEENYNWKALKKPTCGRIVIEDRNVHVDVPMYAIPRDQFETREVALNSVAGMDSLNESVLSKSATRKLDENCVYLAVRGKDKWIKSDPEIVARWFRSAVARHGDPMRQVCRYLKAWRDVQWKSPELSSIALMKCVVDTFDNTPMPDTKDHGELLLKVTEQLATKLRDGVESPDASDEGRLLFPKEKMDDNTVQSIISKAETLHEELNRALNRLSTKNEVLKTLNGLFGDSVVNEELIKPWVAIPAYQQQRQPQRQSQMTDSMTSG

SEQ ID NO: 2441 - protein, 415 aa, Thiomicrospira aerophila
MILKYSVDKLLYQRQSSDCFWANLQPDENALTQMNEIKMLVRKTIRNAFRTFQEKAEEKGLSALTEEYGISLESLAATGNVDDAINALKKVKPKFCSQGSSVYKTLNKPAHTPPQQMDVDDGTYLPMTIIEETGPIIAKEAFFKIVDSALQQLCQENRDWKFINNKPTCARIIVSTDMHIDVPLYAIPEGEYATLTEVYDSSSYSLEALATKEQEVILDPDQVYLAMRNEEHWKQSDPREISEWFKSEVKLHGEGLRRVCRYLKAWRDHTWEDGGGPSSISLMACAVNTYNDPQNSSGFAGDSEALLAVVTALPTQLNEGVYLMTKNEMLYPRESDQKNHSEIVSQAEKLKTNIRRSLLSAESQEECVSGFMAIFGSRFPYDTESVESIANQVRGTSAMAQPSPETEMKPNFSAG

SEQ ID NO: 2442 - protein, 415 aa, Thiomicrospira aerophila; identical to SEQ ID NO: 2441

SEQ ID NO: 2443 - protein, 396 aa, Methylobacter tundripaludum
MTKLKYDASKLLYARSENDRLIHQLEIEDDERATLLETRKKARSAIRKAFNESKAVLEEDFKKQSSLKGIHAAFREVSPAFWPQGSFSYGTLNNPAFSPPQQLDIDDGVYLPMDLFEDNPIYSKGVFFQIVDSALKQLVAENQGWKFDDSKPTCARIIVSSRIHLDFPLYAVPIERFKELKEAALSTSFAAMDSAYALEAIKLDPNEIYLARRDKEHWIKSDPKKIKLWFDREKEAHGDRLVRVCRYLKAWRDFTWEKGGPTSITLMACAASVFDNSNGFNRDCEALFAVAKKLPELFSGEIKNPAESEETLYPRELTQEVIVDIVNKAEIFRDTLTEALIHAENSQEVVDLFIRSLGSRIPNDSTYITPISSISAALNTPIRKQPAPIVKNLKSG

SEQ ID NO: 2444 - protein, 396 aa, Methylobacter tundripaludum; identical to SEQ ID NO: 2443

SEQ ID NO: 2445 - protein, 405 aa, Candidatus Endobugula sertula
MKYDAHKLLAQQFLSRLEPDPEDVAELKAAKTLIRNTIRDAFTQTHQSVTPDQHGRFFIDESKISPHLAESIRKLDSSQKEALRQTKPKFAPQGSFVYKTANSPCHAPPQQIDFDDGVYLPTDLFEDKPIVSKDLFFKIVNDSLIKLCDSNSGWEFDDSKPTCERIILDNKKHIDVPLYAIPRKKYEEMAQAINKSHFRDASMEKKLLDSKNVFMAMRNKEHWIKSDPKQISQWFIGNIMDYGEIVRRISRYMKAWRDYVFKKGGPSSITLMACVVKTFEEQASRGTIFKNDSEALLCCANNLYSQLSSGVDSPIDETEPALFPRNIDDDEQNIILGKASEFGMLLKSALLNASSSQEANQKLLAAFGSRMPFIPSLITTTAAAIVRQSKPRPQPQPEVKNMSGG

SEQ ID NO: 2446 - protein, 405 aa, Teredinibacter turnerae
MKYDVHKLLAQYFLIRLDPDADDVAELKSAKTLIRNAIRNAFTETYRSVTPDQHGRFYINESKISPELAELIRKLDSKQKDALRRTKPKFSPQGSFVYKTANGPCHTPPQQIDFDDGVYLPTDLFEDKPIVSKGLFFKIVDDALIKLCDSQPGWKFDNSKPTCARIILDERKHIDVPLYAIPRQKYEEMTAALNKSYFTDEVIERKLLDHENIFMAMRDKEHWIKSDPKQICQWFLGYVKDYGEIVRRISRYMKAWRDYEFIKGGPSSITLMACVVKTFEDHASNGSIFKNDGEALLCCANNLYTQLSNGVNSPIDETEPALFPRNISDDDRKVILAKANGFGLMIKSALLHANSPHEANQKLLAAFGSRMPFNPQLIATAAASIVRQSKPKPQSQPDVDNMSGG

SEQ ID NO: 2447 - protein, 416 aa, Vibrio parahaemolyticus
MKLDISKVLNDEAEGFIRHISISKKREDQLKEVREVVRMSIRAAFEALPEAFQIDSTGRAIYQYPSALSHVEERLLALNTEQKKALTGLSPRFYSQGSFVYGTLNSPCHKGQQIDIDDGVYLPLEDLKGTPQISNKLFFEIIDNTLQGLAKEMDNWIFFEKNTCSRIQISDDAHVDVPLYAIPRREFELIVESMSINSQKSEKGIAMDSRKMLDKDKVHLAIREPCTWQQSDPMAIKAWFQSHIAYHGEILRRVCRYMKAWRDYSWSDGGGPSSIALMACVCDSFNQLVTQRKSKFNDNDDGLALLHCSRILSEQLNGVIDNPIDPENAEKLHPRSNMSAQDRSEVVEFAHKLYEALDLSVNSTTPAAAIDSLRNVFGERVPNKEHLITYFNAAAIVASTPAVTQAAPEQVNSEAG

SEQ ID NO: 2448 - protein, 418 aa, Vibrio parahaemolyticus
MSFDITKSLNNPQKGFISEITPDVAHIDKLRKIREEIRNELREKFQDLASCFENDGGRMRYTPKASTNFLSDDLKKLSHEQKKSLSKLKPKFASQGSFVYKTMNSPCQPPQQMDLDDGIYLPLDMFEDKPLIGKDLFFNYVDKTLSNLAERKGWRFSDEKNTCARLIIDRELHVDIPLYAVPKERHLAMLENVALNAMDGASTKSETTARLEPNEVNLALRNAESWTVSDPAVLNDYFKNNFKFYKELVGGEDVCRRVSRYLKAWRDHAFNTGGPSSVSLMMCVVLSFQEMSRTRSMNKLTDGEALAECAKRLPDQLRSGVVNDAEKGKEEILFPKKDMTESEIEEVYQAANEFFSSLQKAVNAKSKDDAISYLQNSFGSRFPNLPELLISFSSVATAIRSQPAKAQPQPDVVNQDAG

SEQ ID NO: 2449 - protein, 418 aa, Vibrio parahaemolyticus
MSFDITKSLNNPQKGFISEITPDVAHIDKLRKIREEIRSELREKFQDLASCFENDGGRMRYTPKASTNFLSDDLKKLSHEQKKSLSKLKPKFASQGSFVYKTMNSPCQPPQQMDLDDGIYLPLDMFEDKPLIGKDLFFNYVDKTLSNLAERKGWRFSDEKNTCARLIIDRELHVDIPLYAVPKERHLAMLENVALNAMDGASTKSETTARLEPNEVNLALRNAESWTVSDPAVLNDYFKNNFKFYKELVGGEDVCRRVSRYLKAWRDHAFNTGGPSSVSLMMCVVLSFQEMSRTRSMNKLTDGEALAECAKRLPDQLRSGVVNDAEKGKEEILFPKKDMTESEIEEVYQAANEFFSSLQKAVNAKSKDDAISYLQNSFGSRFPNLPELLISFSSVATAIRSQPAKAQPQPDVVNQDAG

SEQ ID NO: 2450 - protein, 418 aa, Vibrio litoralis
MNFDFTKALNHPQNGFIVEITPDSSKIDKLRKIREVIRNELRDQFAELSNSFEDIGGVMRYVPNVSTSFLAEDLKNLSHEQKKSLNKLKPKFASQGSFVYKTMNSPCQPPQQMDLDDGIYLPLDMFEDKPVIGKELFFNFVDKTLSNLAKRKGWSFSDAKNTCSRLIIDDELHVDVPLYAVPKERHAVMLEKAALNAMDSSLSSVKTKVRLEPNEVNLALRNAESWTVSDPAVLNDYFKENFKFYKDLVGGEDVCRRVSRYLKAWRDYAFKTEGPSSVSLMMCVVLSFQEMSRTRSMDKLTDGEALTECAKRLPEQLISGVVNDAEKGKEEILFPKKDMTEPEIEEVYQAANEFFSSLQKAMNAKSKYDAIYYLQNSFGSRFPNLPELLISFSSVAAAIRSQPAKAQPQPNVVNQDAG

SEQ ID NO: 2451 - protein, 418 aa, Vibrio sp.
MNFDISKALNHPKNGFIAEITPEPEQFKKLRVIREEVRNELRDKFTELSSSFSSINGQMCYISNSSTLFLSEDLKKLSSEQKKSLQKLKPKFASQGSFVYKTMNSPCQAPQQMDLDDGIYLPIDMFEDKPLISKDLFFSFVDNTLLNLAKRKGWAFSDKKNTCARLIIDDVTHVDVPLYAVPKQRHEAMLEKAVMNAFDGVLTKSDTRTRLEQNEVNLALRNAESWTVSDPAVLNDYFKQNFKFYKDLVGGEDVCRRVCRYLKAWRDHAFKSGGPSSVALMTSVVLSFQQMSRSRSMEKLSDGEALLECVKCLPDQLLNGIPNDAEKDKGELLFPKKEMSKTEIDEIYESAVELHESLQSAISAKTKNDAIMKLKKSFGSRFPSLLDLLTSTSSVAAAIRSQPAKAQPQPNVVNQDAG

SEQ ID NO: 2452 - protein, 417 aa, Vibrio cholerae
MKQDVSRLLNDSKQGFMSNIEPHQSKMELLYETRREVRNELRMRFQDLSNSFRKQGDKWVLDIKPNVSFLETKLRALDQDAYEVLANLTPKFAPQGSIVYKTMNKPCQPPQQMDLDDGIYLPIDMFEDKPVLSKDLFFKFVDGTLSNLARRKGWEFSDKKNTCSRVILGTDLHVDVPLYAIPRKRFLSMKVESLALNSINASMDAAPEYVRLEPNEVNLALRNTEAWTVSDPKLLNEYFSQNFSYYKDMTGTDVCRRVCRYLKAWRDNAFKTGGPSSVALMTCVVLTFQELAAQGRLRKLTDSVALDECVKRLALQLRNGVPNDAEPSKNEKLFPKSNMLEHELEDIYQKAELLNSHVTAGLNASTASEAITNLQAVFGDRIPNIPGLVVAITVAEAIRSQPAIAHPQPNVANQDAG

SEQ ID NO: 2453 - protein, 414 aa, Unknown
  Description of Unknown: Pseudoalteromonas sequence
MKYSINRLLTEGSSCFLSTITPAADKISTLKSVRVIVRKALRESFQHLASSFEEKQGRMHYIETAETKFLSEELLKLSSEQKSSIHNLKPKFSSQGSFVYKTMNSPCQTPQQMDLDDGIYLPLDMFEDKPIVSKDLFFSFVDSTLKKLADANGWLFDGKKNTCSRVIVSHDIHVDVPLYAIPKERFEMMASSINEKSNLAMESYQDNADLYLQAEEVNLALRNAENWTVSDPKVISDWYLEHVGFHGEVLRRICRYLKAWRDFTFKDGGPSSIALMMCAVESFQIHTSKRKQRFTNKDESEALLCCVKDLPEQLRLGVRNLAQEQEEMMFPKSHMSDNEIDNIISAAEELSSEIDLALTGAVSNNEVISRCQQVFGNRIPNRPDLVEAIPLAATIRKQPAQTQPEPSVHNADAG

SEQ ID NO: 2454 - protein, 393 aa, Gammaproteobacteria bacterium
MQQKFKAHRLLTNGNTNIALIDKLNITDTEDKLLVECRADVRKYLKEGFQQLRSNASIKFQEFEDDIRNLNPKFWTQGSYAYKTMNDPATNPPQQIDLDDGVYFPMALLDGKPLAVKNKLLKLIKLILTELADNKGWGVSEKTTCLRLEVNSRVHIDVPVYAIPEQKYVMLKAAMESRNNFADSSSDLEFMYLDPDEVHLARWDNDDWIKSDPKELHEWFISKTKLHGKRFLRRVCRYMKAWRDHQWDKGGPSSITLMVVVAKVFDDNLMINKKEFASDCEALLAIANELPAIFNTEIKNPIADDEIIFPRDINQIEVEAIRQKVAEFSNSINSLCYSQTEQQVVNEFMRIFGSRLPNKPEWVERYTVGDVVRNSPHVTSTASTAFKEEHRSG

SEQ ID NO: 2455 - protein, 390 aa, Alteromonas macleodii
MHQKYLVKKLLKNNQSEHAYKDKLDVPDNVDSFMLNCRKTIRDKIRNDFSAYQETSNTMLKSDENYAKSLRPKFFTQGSHAYKTQNLPCYSSQEIDLDDGVYFPMTFVENNPAANKSMLVALVRQSLSDLSEQTGWPLSEKKMCFRLQVDKQIHIDVPVYAIPDDKYAQLTEARLAALNFAFKDDNIPYQRLDPTQVYVALLDDNALWRQSDPKQLHDWFISQTKRYPFLRHICRYLKAWRDYEWQEGGPSSIMLMVAAVDALNQFPKMPESECEALLVVTKALPSIFAGDINNPIDNNENMFPSRCKEHAEILDIRERVTALSISYTEAVCEAQTKQLAVNTLISLFGQRLPNREDWVQEKATPSAIRKKPVVAAAAITPSASRSHVSG

SEQ ID NO: 2456 - protein, 412 aa, Oceanospirillum maris
MSQKFNASKVFYCPSGSTGRFLNAISIPDTEIKLLEQLRDSVRKEVKKAFKGIRENGLPKELLDLLLGMDYTREDIEEATRLSPKFFTQGSFAYKTLNKPAMTPPQQIDIDDGVYFPMKVVEKSPVVIKNVLFYLVDEILKDLAAKNDWKFKEKDTCAQLEINPGVHMDIPLYAIPEERAQHLEEARLKASHLTMENYAQDSYIDFWDSIALDPNEVYLALRNEKHWTISDPKKIRDWFLNQKKQFGGTIVRVCRYLKAWRDHTWPNGGGPSSICLMVAVAETFNSRLNQNLPDFASDCQALLDVAKNLPFQFADQIMNPAEEGEIMFPRNHSEKDLQEIRAEIVKFAGNIQQALCGANDEREVINLLIQTFGGRLPNLPQYVKRITVAQTVRQQPIQQQQIPAPPPSQRSA

SEQ ID NO: 2457 - protein, 382 aa, Pseudomonas putida
MLDLSKLFYTETTDDCLLNALELTDVERAYITASKEDVRNCLRTGVPRVLKTMGYEGEVPKPRFFTQGSWAYKTLNSPAHIPPQQSDCDDGAYLPISFLKGTRRPSVASAIFFTAAETALGDLVRENQALGWKLIRDKDTCIRIQISNTAHIDIPLYSIPDEEFVTLAKAATRSGYVSFDEAFNARGAASWADLPTDQVMLAHRRDDWVSSDPRPVKNWFVDQVQDRGEQLRRIVRYLKAYRDWQWEAGGPSSILLMAAATPLFTKVKGRDDLALLEVLKGLPDALRKGVSNPVDESESLTQRLSAEELEEAAEQFERLEMNLNGAVNASDPASACVWLRKMFGPRFPQRTDLVRVVTVASTIAAIPAEAAPSELVGTSKAG

SEQ ID NO: 2458 - protein, 382 aa, Pseudomonas putida; identical to SEQ ID NO: 2457

SEQ ID NO: 2459 - protein, 382 aa, Pseudomonas sp.
MLDLSKLFYTETTDDCLLNALELTDVERAYIAASKEDVRNCLRAGVPRVLKTMGYEGVVPKPRFFTQGSWAYKTLNSPAHIPPQQGDCDDGAYLPISFLKGTRRPSVASAIFFTAAETALEDLVRENQSLGWKLIRDKDTCIRIQISTTAHIDIPLYSIPDEEFVTLAKAATRSGYMSFDEAFNARGAESWADLPTDEVMLAHRKDDWVSSDPRPVKNWFVDQVADKGEQLRRIVRYLKAYRDWQWEAGGPSSILLMAAATPLFTKVKGRDDLALLEVLKGLPDALRGGVSNPVDESESLTERLSAEALEEAAEQFEKFEMNLNGAVNASDPASACVWLRKMFGPRFPQRTDLVKIVTVASTIAAMPAEAAPSELVGTSKAG

SEQ ID NO: 2460 - protein, 382 aa, Pseudomonas syringae
MLNLSPLFNTSEDESCLLQALELTASQRLQITSAKNEVRQCLRHGIPKVLVEQGYKGDIPQPRFFTQGSWAYKTLNSPAHLPPQQSDVDDGAYLPISFLKGSKRPSAASAIFFAAAEEALSRLVESKRSEKWKLVTDKPTCIRIEISTTAHIDIPLYSIPDDEYVTLEKAANSYGFESLMDAVNVRRADSWTTLPIGEVLLAHREEDWINSDPRPVKDWFVDEVESKGEQLRRVVRYLKAFRDWQWEKGGPSSILLMAAAVPLFTKMDRRDDLALLEVLKGLPAALRNGVVNPVSAEESLSDRLPSDELEQAAKKFEMFENYLNGAVNASDETTACNWMISMFGPRFPNRPNRIKQVTVAATIAAVPAQAAASELVGRTKAG

SEQ ID NO: 2461 - protein, 382 aa, Pseudomonas syringae
MLNLSPLFNTSEDESCLLQALELTASQRLQITSAKNEVRQCLRHGIPKVLVEQGYKGDIPQPRFFTQGSWAYKTLNSPAHLPPQQSDVDDGAYLPISFLKGSKRPSAASAIFFAAAEEALSRLVESKRSEKWKLVTDKPTCIRIEISTTAHIDIPLYSIPDDEYVTLEKAADSYGFESLMDAVNVRRADSWTTLPIGEVLLAHREEDWINSDPRPVKDWFVDEVESKGEQLRRVVRYLKAFRDWQWEKGGPSSILLMAAAVPLFTKMDRRDDLALLEVLKGLPAALRNGVVNPVSAEESLSDRLPSDELEQAAKKFEMFENYLNGAVNASDETTACNWMISMFGPRFPNRPNRIKQVTVAATIAAVPAQAAASELVGRTKAG

SEQ ID NO: 2462 - protein, 382 aa, Pseudomonas viridiflava
MLNLSPLLNTSEDELCLLKALELTPVQRLQITSAKNEVRQCLRHGIPKVLIEQGYKGDIPQPRFFTQGSWAYKTLNSPAHLPPQQSDVDDGAYLPISFLKGSKRPSAASAIFFAAAEEALRRLVETKRSENWKLVTDKPTCIRIEISAIAHIDIPLYSIPDDEYQTLERVANTYGYDSLMDAVNVRRADSWTTLPLGEVLLAHREEDWIASDPRPVKDWFVDEVEAKGEQLRRVVRYLKAFRDWQWKKGGPSSILLMAAAAPLFTKMDRRDDLALLEVLKGLPAALRNGVSNPVNDDESLSGRLPADELEAAAEKFEMFEDYLNGAVNASDQTTACNWMISMFGPRFPNRPSRIKQVTVAATIAAVPAQASASELVGRTKAG

SEQ ID NO: 2463 - protein, 382 aa, Unknown
  Description of Unknown: Pseudomonas syringae group sequence
MLNLSPLFNTSEEELCLLNALELTPSQRLQITSAKNEVRQCLRHGIPRVLIEQGYKGDIPQPRFFTQGSWAYKTLNSPAHLPPQQSDVDDGAYLPISFLKGSKRPSAASAIFFAAAEEALGRLVESKRSENWKLVTDKPTCIRIEISAIAHIDIPLYSIPDDEYQKLERAANAYGYDCFMDAVNVRRADSWTMLPSDEVLLAHREEDWIASDPRPVKDWFVDEVEAKGEQLRRVVRYLKAFRDWQWRTGGPSSILLMAAAAPLFTKMDRRDDLALLEVLKGLPAALRNGVSNPVNDDESLSGRLPADELEAAAEKFEMFEDYLNGAVNASDQTTACNWMISMFGPRFPNRPSRIKQVTVAATIAAVPAQASASELVGRTKAG

SEQ ID NO: 2464 - protein, 379 aa, Xanthomonas citri
MLNLSSLFFTTVDGEACMHASLDLSQDERDAIAHARKEVRACLRAGIPRALRENGYSGAVPEPRFFTQGSWAYKTLNSPAKRPQQADVDDGCYLPLGFVAQSQRPSAATTVFFAAAEEALLPLVVARRWRMDRSKATCIRVIISEYAHIDIPLYAIPDEEFTQLALATENYGFDSVAKAVSVRSRDSWTALPKNKVLLAHREDNWLPSDPRPVKDWFLGQVDAKGEQFRRVVRYLKAFRDWRWASGGPSSILLMAAAAPIFEKRDRRDDLALLDVVAQLPGRLRGGVCNPVEESESLTKRLGAEKVEEAAQAFESFEKVLRATVAASNAAQGCTWMRGEFGARFPDEPERVKASTIAQTIMAAPAAAGPSELVGRTMAG

SEQ ID NO: 2465 - protein, 380 aa, Comamonas sp.
MLNLSPLFFTTVDDGTCMHEELDLPVEQRAWIASARNDVRNCLRTGIPRVLRERGYTDDVPQPRFFTQGSWAYKTLNAPAQRPQQADVDDGCYLPLSFVSQTKRPSRATTVFFAAAEEALKPLVQEKHWKLVSDKPTCVRIVIAAYAHIDVPLYAIPDEEFVTLAKASMERYGYDSLTEAVNMAERDAWTALPADKVLLAHRECNWMPSDPRPVKEWFLGEVEAKGEQFRRVIRYLKAFRDWRWSSGGPASILLMAAAAPLFEKRDRRDDLALLDVVAALPAKLRAGVNNPVDESESLTVRLGKEGVEEAAKAFEALEKVLRGATDAGSPSQACIWMQGEFGPRFPNEPARVKVVSVAATIAAAPATAGPSELVGRTKAG

SEQ ID NO: 2466 - protein, 380 aa, Oryzisolibacter propanilivorax
MLNLSPLFFTTVDDESCMHEELNLSVEQRAWIASARNDVRNCLRTGIPRVLRERGYTDDVPQPRFFTQGSWAYKTLNAPAQRPQQADVDDGCYLPLSFVSQTKRPSRATTVFFAAAEEALKPLVQEKHWKLVTDKPTCVRIVIAAYAHIDVPLYAIPDEEFVTLAKASMERYGYDSLTEAVNMAERDAWTALPADKVLLAHRECNWMPSDPRPVKEWFLGEVEAKGEQFRRVIRYLKAFRDWRWSSGGPASILLMAAAAPLFEKRDRRDDLALLDVVAALPAKLRAGVNNPVDESESLTVRLGKEGVEEAAKAFEALEKVLRGATDAGSPSQACIWMQGEFGPRFPNEPARVKVVSVAATIAAAPATAGPSELVGRTKAG

SEQ ID NO: 2467 - protein, 380 aa, Rubrivivax sp.
MLNLSPLFFTTVDDESCMHDELDLAPDQRAWIASARNDVRNCLRTGIPRVLNERGYTEDVPQPRFFTQGSWAYKTLNAPAQRPQQADVDDGCYLPLSFVSQTKRPSRATTVFFAAAEEALKPLVEEKHWKLVTDKPTCIRIVIAAYAHIDIPLYAIPDEEFVTLAKASMERYGYDSLTEAVNMAERDAWTALPADKVLLAHRECNWMPSDPRPVKEWFLGEVEAKGEQFRRVIRYLKAFRDWRWSSGGPASILLMAAVAPLFEKRDRRDDLALLDIVAALPARLRAGVNNPVDESESLTARLGKEGVEDAAKAFEALEKVLRGATDAGSPSQACIWMQGEFGPRFPNEPDRVKVVSIAATIAAAPATVGPSELVGRTKAG

SEQ ID NO: 2468 - protein, 380 aa, Verminephrobacter eiseniae
MLNLSPLFFTTVDDESCMHDELDLSPGQRAWIASARNDVRNCLRTGIPRVLRERGYTEDVPQPRFFTQGSWAYKTLNGPAQRPQQADVDDGCYLPLSFVSQTKRPSRATTVFFAAAEEALKPLVEEKRWKLVTDKPTCIRIVITAYAHIDIPLYAIPDEEFVTLAKASMERYGYDSLTEAVNMAERDAWTALPADKVLLAHRECNWMSSDPRPVKEWFLGEVEAKGEQFRRVIRYLKAFRDWRWSSGGPASILLMAAAAPLFEKRDRRDDLALLAVVAALPARLRAGVNNPVDESESLTVRLGKEGVEEAAKAFEALEKVLRGATDAGSPSQACIWMQGEFGPRFPNEPDRVKVVSVAATIAAAPATDGPSELVGRTKAG

SEQ ID NO: 2469 - protein, 380 aa, Unknown
  Description of Unknown: Proteobacteria sequence
MLNLSPLFFTTVDDESCMHDELDLSPEQRAWIASARNDVRNCLRTGIPRVLRERGYTDDVPQPRFFTQGSWAYKTLNGPAQRPQQADVDDGCYLPLSFVSQTKRPSRATTVFFAAAEEALRLLVEEKHWKLVTDKPTCIRIVIAAYAHIDIPLYAIPDEEFVTLAKASMERYGYDSLTEAVNMAERDAWTALPADKVLLAHRECNWMPSDPRPVKEWFLGEVEAKGEQFRRVIRYLKAFRDWRWSSGGPASILLMAAAAPLFEKRDRRDDLALLDVVAALPARLRAGVNNPVDESESLTARLGKEGVEEAAKAFEAFEKVLRGATNAGSPSQACVWMQGEFGPRFPNEPDRVKVVSVVATIAAAPATAGPSELVGRTKAG

SEQ ID NO: 2470 - protein, 380 aa, Achromobacter sp.
MLNLSPLFFTTVDDESCMHDELDLSPEQRAWIASARNDVRNCLRTGIPRVLRERRYTDDVPQPRFFTQGSWAYKTLNGPAQRPQQADVDDGCYLPLSFVSQTKRPSRATTVFFAAAEEALRLLVEEKHWKLVTDKPTCIRIVIAAYAHIDIPLYAIPDEEFVTLAKASMERYGYDSLTEAVNMAERDAWTALPADKVLLAHRECNWMPSDPRPVKEWFLGEVEAKGEQFRRVIRYLKAFRDWRWSSGGPASILLMAAAAPLFEKRDRRDDLALLDVVAALPARLRAGVNNPVDESESLTARLGKEGVEEAAKAFEAFEKVLRGATNAGSPSQACVWMQGEFGPRFPNEPDRVKVVSVVATIAAAPATAGPSELVGRTKAG

SEQ ID NO: 2471 - protein, 380 aa, Pseudomonas aeruginosa
MLNLSPLFFTTVDDESCMHDELDLSPEQRAWIASARNDVRNCLRTGIPRVLRERGYTDDVPQPRFFTQGSWAYKTLNGPAQRPQQADVDDGCYLPLSFVSQTKRPSRATTVFFAAAEEALRLLVEEKHWNLVTDKPTCIRIVIAAYAHIDIPLYAIPDEEFVTLAKASMERYGYDSLTEAVNMAERDAWTALPADKVLLAHRECNWMPSDPRPVKEWFLGEVEAKGEQFRRVIRYLKAFRDWRWSSGGPASILLMAAAAPLFEKRDRRDDLALLDVVAALPARLRAGVNNPVDESESLTARLGKEGVEEAAKAFEAFEKVLRGATNAGSPSQACVWMQGEFGPRFPNEPDRVKVVSVVATIAAAPATAGPSELVGRTKAG

SEQ ID NO: 2472 - protein, 380 aa, Unknown
  Description of Unknown: Burkholderiales sequence
MLNLSPLFFTTVDDESCMHDELDLSPEQRAWIASARNDVRNCLRTGIPRVLRERGYTDDVPQPRFFTQGSWAYKTLNGPAQWPQQADVDDGCYLPLSFVSQTKRPSRATTVFFAAAEEALRLLVEEKHWKLVTDKPTCIRIVIAAYAHIDIPLYAIPDEEFVTLAKASMERYGYDSLTEAVNMAERDAWTALPADKVLLAHRECNWMPSDPRPVKEWFLGEVEARGEQFRRVIRYLKAFRDWRWSSGGPASILLMAAAAPLFEKRDRRDDLALLDVVAALPARLRAGVNNPVDESESLTARLGKEGVEEAAKAFEAFEKVLRGATNAGSPSQACVWMQGEFGPRFPNEPDRVKVVSVVATIAAAPATAGPSELVGRTKAG

SEQ ID NO: 2473 - protein, 380 aa, Unknown
  Description of Unknown: Achromobacter sequence
MLNLSPLFFTTVDDESCMHDELDLSPEQRAWIASARNDVRNCLRTGIPRVLRERGYTDDVPQPRFFTQGSWAYKTLNGPAQRPQQADVDDGCYLPLSFVSQTKRPSRATTVFFAAAEEALRLLVEEKHWKLVTDKPTCIRIVIAAYAHIDIPLYAIPDEEFVTLAKASMERYGYDSLTEAVNMAERDAWTALPADKVLLAHRECNWMPSDPRPVKEWFLGEVEAKGEQFRRVIRYLKAFRDWRWSSGGPASILLMAAAASLFEKRDRRDDLALLDVVAALPARLRAGVNNPVDESESLTARLGKEGVEEAAKAFEAFEKVLRGATNAGSPSQACVWMQGEFGPRFPNEPDRVKVVSVVATIAAAPATAGPSELVGRTKAG

SEQ ID NO: 2474 - protein, 380 aa, Ventosimonas gracilis
MLNLSPLFFTTADDESCMHDELDLSPERRAWIASARNDVRNCLRTGIPRVLRERGYTDDVPQPRFFTQGSWAYKTLNAPAQRPQQADVDDGCYLPLSFVSQTKRPSRATTVFFAAAEEALKPLVEEKHWKLVTDKPTCIRIVIAAYAHIDIPLYAIPDKEFVMLTKASMERYGYDSLTGAVNMAERDAWTALPADKVLLAHRECNWMTSDPRPVKEWFLGEVEAKGEQFRRVIRYLKAFRDWRWSSGGPASILLMAAAAPLFEKRDRRDDLALLDVVAALPARLRAGVNNPVDESESLTERLGQEGVEEAAKAFEAFEKALRGAIDADSPSQACIRMQGEFGPRFPNEPSRVKVVSVVATIAAAPATAGPSELVGRTKAG

SEQ ID NO: 2475 - protein, 380 aa, Herbaspirillum sp.
MLNLSPLFFTTVDNESCMHEELDLSLDQRAWIAGARNDVRNCLRTGIPRVLRGHGYTDDVPQPRFFTQGSWAYKTLNAPAQRPQQADVDDGCYLPLSFVSQTKRPSRATTVFFAAAEEALRPLVEEKRWTLVTDKPTCIRIVIAAFAHIDIPLYAIPDTEFVTLTKASMESYGYDSITEAVNKAERDAWTALPADKVLLAHRECNWMASDPRPVKEWFLGEVEAKGEQFRRVVRYLKAYRDWRWSSGGPASILLMAAAAPLFEKRDRRDDLALLDVVAALPARLRAGVNNPVDESESLTVRLGKEGVEEAAKAFEELEKALRGATDAGSPSQACIWMQGEFGPRFPNEPDRVKVVSIAATIAAAPAMAGPSELVGRTKAG

SEQ ID NO: 2476 - protein, 380 aa, Acidovorax cattleyae
MLNLSPLFFTAVDDESCMHEELDLSPEQRAWIASARNDIRTCLRTGIPRVLRDRGYTDDVPQPRFFTQGSWAYKTLNAPAQRPQQADVDDGCYLPLSFVSQTKRPSRATTVFFAAAEEALKPLVEEKRWKLVTDKPTCIRIVIAAFAHVDIPLYAIPDMEFDTLAKASMERYGYASLTEAVNKAERDAWTALPADKVLLAHRECNWMTSDPRPVKDWFLGEVEAKGEQFRRVVRYLKAFRDWRWSSGGPASILLMAAAAPIFEKRDRRDDLALLDVVAALPARLRAGVNNPVDESESLTVRLGRDGVEEAAKAFEELEKVLRGATDAGSPSQACVWMQGEFGPRFPNAPDRVKVVSIAATIASAPATAGPSELVGRTKAG

SEQ ID NO: 2477 - protein, 380 aa, Burkholderia sp.
MLNLSPLFFTTVDDESCIHDELDLTPEQRAWIASARTDVRDCLRTGIPRVLRVNGYTEDVPQPRFFTQGSWAYKTLNSPAQRPQQADVDDGCYLPLSFVSQTKRPSTATTVFFAAAEEALRPLVEEKQWKLVTDKPTCIRIVISAYAHIDIPLYAIPDEEFVTLAKASMERYGYDSLTEAVNMAERDAWTALPADKVLLAHRECNWMPSDPRPVKEWFLGEVDAKGEQFRRVVRYLKAFRDWRWSSGGPSSILLMAAAAPLFEKRDRRDDLALQDVVSALPARLRAGVNNPVDESESLTARLGKAGVEEAARAFEEFEKVLRGATDASSPSQACIWMQGEFGPRFPNEPDRVKVVSIVATIAAAPAAAGPSELVGRTKAG

SEQ ID NO: 2478 - protein, 380 aa, Pseudomonas aeruginosa
MLNLSPLFFTTVDDESCIHDELDLTPEQRAWIASARTDVRDCLRTGIPRVLRANGYTEDVPQPRFFTQGSWAYKTLNSPAQRPQQADVDDGCYLPLSFVSQTKRPSTATTVFFAAAEEALRPLVEEKQWKLVTDKPTCIRIVISAYAHIDIPLYAIPDEEFVTLAKASMERYGYDSLTEAVNMAERDAWTALPADKVLLAHRECNWMPSDPRPVKEWFLGEVDAKGEQFRRVVRYLKAFRDWRWSSGGPSSILLMAAAAPLFEKRDRRDDLALLDVVVALPARLRAGVNNPVDESESLTARLGKAGVEEAAKAFEEFEKVLRGATDASSPSQACIWMQGEFGPRFPNEPDRVKVVSIVATIAAAPAAAGPSELVGRTKAG

SEQ ID NO: 2479 - protein, 380 aa, Unknown
  Description of Unknown: Pseudomonas sequence
MLNLSPLFFTTVDDESCMHDELNLTPEQRAWIASARTDVRDCLRTGIPRVLRVNGYTEDVPQPRFFTQGSWAYKTLNSPARRPQQADVDDGCYLPLSFVSQTKRPSTATTVFFAAAEEALKPLVEEKQWKLVTDKPTCIRIVISAYAHIDIPLYAIPDEEFVTLAKASMERYGYDSLTEAVNMAERDAWTALPADKVLLAHRECNWMPSDPRPVKEWFLGEVEAKGEQFRRVVRYLKAFRDWRWSSGGPASILLMAAAAPLFEKRDRRDDLALLDVVAALPARLRAGVNNPVDESESLTERLGNEGVEEAAKAFEEFEKVLRGATDAGSPSQACTWMQGEFGPRFPNEPDRVKVVSVAATIAAAPATAGPSELVGRTKAG

SEQ ID NO: 2480 - protein, 380 aa, Pseudomonas pelagia
MLNLSPLFFTTVDDESCMHDELDLTPEQRAWIASARTDVRACLRTGIPRVLRANGYTENVPQPRFFTQGSWVYKTLNSPAQRPQQADVDDGCYLPLSFVSQTKRPSTATTVFFAAAEEALKPLVEEKHWKLVTDKPTCIRIVISAYAHIDIPLYAIPDEEFVLLAKASMERYGYDSLTDAVNMAERDVWTALPADKVLLAHRECNWMPSDPRPVKEWFLSEVEIKGEQFRRVVRYLKAFRDWRWSSGGPASILLMAAAAPLFEKRDRRDDLALLDVVTSLPAQLRAGVNNPVDESESLTERLGKAGVEEAAKAFGEFEKVLRGATDAGSPSQACIWMQGEFGPRFPNEPDRVKVVSVAATIAAAPATAGPSELVGRTKAG

SEQ ID NO: 2481 - protein, 380 aa, Pseudomonas aeruginosa
MLNLSPLFFTTVDDESCMHDELDLTPEQRAWIASARTDVRACLRTGIPRVLRANGYTEDVPQPRFFTQGSWAYKTLNSPAQCPQQADVDDGCYLPLSFVSQTKRPSTATTVFFAAAEEALRPLVEEKHWKLVTDKPTCIRIVISAYAHIDIPLYAIPDEEFVMLAKASMERYGYDSLTEAVNMAERDVWTALPADKVLLAHRECNWMPSDPRPVKEWFLGEVEIKGEQFRRVVRYLKAFRDWRWSSGGPASILLMAAAAPLFEKRDRRDDLALLDVVTSLPAQLRAGVNNPVDESESLTERLGKAGVEEAAKAFEELEKVLRGATDAGSPSQACIWMQGEFGPRFPNEPDRVKVVSVAATIAAAPAMAGPSELVGRTKAG

SEQ ID NO: 2482 - protein, 380 aa, Pseudomonas aeruginosa
MLNLSPLFFTTVDDESCMHSELDLTPEQRAWIASARTDVRDCLRTGIPRVLRANGYTEGVPQPRFFTQGSWAYKTLNSPAQRPQQADVDDGCYLPLSFVSQTKRPSTATTVFFAAAEEALRPLVEAKRWRLVTDKPTCIRIVISAYAHIDIPLYAIPDEEFVTLAKASMERYGYDSLTEAVNMAERDAWTALPADKVLLAHRECNWMPSDPRPVKEWFLGQVDAKGEQFRRVVRYLKAFRDWRWSSGGPASILLMAAAAPLFEKRDRRDDLALLDVVAALPARLRAGVNNPVDESESLTERLGNEGVEEAAKAFEEFEKVLRGATDAGSPSQACIWMQGEFGPRFPNAPDRIKVVSVAATIAAAPATAGPSELVGRTKAG

SEQ ID NO: 2483 - protein, 380 aa, Pseudomonas sp.
MLNLSPLFFTTLDDEPCMHDELDLTPGQRASIASARTDVRDCLRTGIPRVLRANGYTEGVPQPRFFTQGSWAYKTLNSPAQRPQQADVDDGCYLPLSFVSQTKRPSTATTVFFAAAEEALRPLVEEKRWKLVTDKPTCIRIVISAYAHIDIPLYAIPDEEFITLAKASMERYGYDSLTEAVNMAERDAWTALPADKVLLAHRECNWMPSDPRPVKEWFLGEVEAKGEQFRRVVRYLKAFRDWRWSSGGPASILLMATAAPLFEKRDRRDDLALLDVVAALPARLRAGVNNPVDESESLTERLGKAGVEEAAKAFEEFEKVLRGATDASSPSQACIWMQGEFGPRFPNEPDRVKVVSVAATIAAAPATAGPSELVGRTKAG

SEQ ID NO: 2484 - protein, 380 aa, Unknown
  Description of Unknown: Gammaproteobacteria sequence
MLNLSPLFFTTLDDESCMHDELDLTPGQRAWIASARTDVRDCLRTGIPRVLRANGYTEDVPQPRFFTQGSWAYKTLNAPAQHPQQADVDDGCYLPMSFVSQTKRPSTAATVFFAAAEEALKPLVEERRWKLVTDKPTCIRIVIAAYAHIDIPLYAIPDEEFVTLAKASMERYGYDSLTEAVNMAERDAWTALPADKVLLAHRECNWMSSDPRPVKEWFLGEVEAKGEQFRRVVRYLKAFRDWKWSSGGPASILLMAAAAPLFEKRDRRDDLALLDVVAALPARLRGGVNNPVEESESLTERLGQAGVEDAAKAFEEFEKVLRGATGAGSPSQACIWMRGEFGPRFPNEPDRVKVVSVAATIAAAPATAGPSELIGRTKAG

SEQ ID NO: 2485 - protein, 380 aa, Pseudomonas chloritidismutans
MLNLSPLFFTTLDDESCMHDELDLTPGQRAWIASARTDVRDCLRTGIPRVLRANGYTEDVPQPRFFTQGSWAYKTLNAPAQHPQQADVDDGCYLPMSFVSQTKRPSTAATVFFAAAEEALKPLVEERRWKLVTDKPTCIRIVIAAYAHIDIPLYAIPDEEFVTLAKASMERYGYDSLTEAVNMAERDAWTALPADKVLLAHRECNWMSSDPRPVKEWFLGEVEAKGEQFRRVVRYLKAFRDWKWSSGGPASILLMAAAAPLFEKRDRRDDLALLDVVAALPARLRGGVNNPVEESESLTERLGQAGVEDAAIAFEEFEKVLRGATGAGSPSQACIWMRGEFGPRFPNEPDRVKVVSVAATIAAAPATAGPSELIGRTKAG

SEQ ID NO: 2486 - protein, 380 aa, Unknown
  Description of Unknown: Pseudomonas sequence
MLNLSPLFFTTLDDESCMHDELDLTPGQRAWIASARTDVRDCLRTGIPRVLRANGYTEDVPQPRFFTQGSWAYKTLNSPAQHPQQADVDDGCYLPMSFVSQTKRPSTAATVFFAAAEEALKPLVEERRWKLVTDKPTCIRIVIAAYAHIDIPLYAIPDEEFVTLAKASMERYGYDSLTEAVNMAERDAWTALPADKVLLAHRECNWMSSDPRPVKEWFLGEVEAKGEQFRRVVRYLKAFRDWKWSSGGPASILLMAAAAPLFEKRDRRDDLALLDVVAALPARLRGGVNNPVEESESLTERLGQAGVEDAAKAFEEFEKVLRGATGAGSPSQACIWMRGEFGPRFPNEPDRVKVVSVAATIAATPATAGPSELIGRTKAG

SEQ ID NO: 2487 - protein, 380 aa, Unknown
  Description of Unknown: Proteobacteria sequence
MLNLSPLFFTTLDDESCMHDELDLTPGQRAWIASARTDVRDCLRTGIPRVLRANGYTEDVPQPRFFTQGSWAYKTLNAPAQHPQQADVDDGCYLPMSFVSQTKRPSTAATVFFAAAEEALKPLVEERRWKLVTDKPTCIRIVIAAYAHIDIPLYAIPDEEFVTLAKASMERYGYDSLTEAVNMAERDAWTALPADKVLLAHRECNWMSSDPRPVKEWFLGEVEAKGEQFRRVVRYLKAFRDWKWSSGGPASILLMAAAAPLFEKRDRRDDLALLDVVAALPARLRAGVNNPVDESESLTERLGKAGVEEAAKAFEEFEKVLRGATDAGSPSQACIWMQGEFGPRFPNEPDRVKVVSVAATIAAAPATAGPSELVGRTKAG

SEQ ID NO: 2488 - protein, 380 aa, Pseudomonas aeruginosa
MLNLSPLFFTTLDDESCMHDELDLTPGQRAWIASARTDVRDCLRTGIPRVLRANGYTEDVPQPRFFTQGSWAYKTLNSPAQNPQQADVDDGCYLPMSFVSQTKRPSTAATVFFAAAEEALKPLVEERRWKLVTDKPTCIRIVIAAYAHIDIPLYAIPDEEFVTLAKASMERYGYDSLTEAVNMAERDAWTALPADKVLLAHRECNWMSSDPRPVKEWFLGEVEAKGEQFRRVVRYLKAFRDWKWSSGGPASILLMAAAAPLFEKRDRRDDLALLDVVAALPARLRGGVNNPVEESESLTERLGQAGVEDAAKAFEEFEKVLRGATGAGSPSQACIWMRGEFGPRFPNEPDRVKVVSVAATIAATPATAGPSELIGRTKAG

SEQ ID NO: 2489 - protein, 380 aa, Cupriavidus sp.
MLNLSPLFFTTADDESCMHDELDLTFEQRAWIASARTDVRDRLRTGIPRVLKASGYTEGVPQPRFFTQGSWAYKTLNSPAQRPQQADVDDGCYLPLSFVSQTKRPSTAATVFFAAAEEALKPLVEEKKWKLVTDKPTCIRIVIAAYAHIDIPLYAIPDEEFVMLAKASMERYGYDSLTEAVNLAERDAWTALPADEVLLAHRECNWMPSDPRPVKEWFLGEVEAKGEQFRRVVRYLKAFRDWKWSSGGPASILLMAAAAPLFEKRDRRDDLALLDVVAALPARLRAGVNNPVEESESLTERLGEAGVEEAAKAFEEFEKVLRGATDAGSPSQACIWMQGEFGPRFPNDPDRVKVVSVAATIAAAPAMAGPSELVGRTKAG

SEQ ID NO: 2490 - protein, 380 aa, Pseudomonas aeruginosa
MLNLSPLFFTTVDDESCIHDELDLTPEQRAGIASARTDVRDCLRTGIPRVLRARGFTEDVPQPRFFTQGSWAYKTLNSPAQRPQQADVDDGCYLPLSFVSQTKRPSTAATVFFAAAEEALKPLVEEKRWKLVTDKPTCIRIVITAYAHIDIPLYAIPDEEFVTLAKASMERYGYDSLTEAVNMAERDAWTALPADKVLLAHRECNWMSSDPRPVKEWFLGEVEANGEQFRRVVRYLKAFRDWKWSSGGPASILLMAAAAPLFEKRDRRDDLALLDVVAALPARLRAGVNNPVDESESLTVRLGKSGVEDAAKAFEEFEKVLRGATNAGNPSQACIWMQGEFGPRFPNEPERVKVVSVAATIAAAPAAAGPSELVGRTKAG

SEQ ID NO: 2491 - protein, 380 aa, Thiobacillus sp.
MLNLSPLFFTTLDAESCMHDELDLTPEQRAWIASARTDVRDCLRKGIPRVLRASGYTEDVPQPRFFTQGSWAYKTLNSPARHPQQADVDDGCYLPMSFVSQTRRPSTAAMVFFTAAEEALKPLVEERRWKLVTEKSTCIRIVIAGYAHIDIPLYAIPDEEFVTLAKASMERYGYDSLTEAVNMAERDAWTALPADKVLLAHRECNWMPSDPRPVKEWFLGEVEGQGEQFRRVVRYLKAFRDWRWPSGGPASILLMAAAAPLFEKRDRRDDLALLDIVAALPARLRGRVNNPVDESESLTERLGPAGVEEAARAFEEFEKVLRGATGAGSPSQACVWMQGEFGPRFPNEPDRVKVVSVAATIAAAPATAGPSELVGRTKAG

SEQ ID NO: 2492 - protein, 379 aa, Candidimonas bauzanensis
MLNLSPLFFTTVDDESCMHDELDLTSDERTWIASARTAVRDCLRTGIPRALRASGYTEDVPQPRFFTQGSWAYKTLNSPAQQPQQADVDDGCYLPMSFVSQTKRPSTAAAVFFAAAEEALKPLVEEKRWKLVTDKPTCIRIVIATFAHIDIPLYAIPDEEFVMLKASMERYGYDSLSEAVNMAERDTWTALPADKVLLAHRECNWMSSDPRPVKEWFLDQVAAKGEQFRRVVRYLKAFRDWRWPSGGPASILLMSAAAPLFEKRDRRDDLALLDVVALLPARLHAGVNNPVDESESLTKRLGKTGVEEAAKAFEEFERVLRGAIGAGSRSQACIWMQGEFGSRFPNEPDRVKVVSVAATIAAAPATAGPSELVGRTKAG

SEQ ID NO: 2493 - protein, 380 aa, Unknown
  Description of Unknown: Proteobacteria sequence
MLNLSPLFFTTLDDESCMHDELDLTPEQRAWIASARTDVRDCLRTGIPRVLRASGYTEDVPQPRFFTQGSWAYKTLNSPAQRPQQADVDDGCYLPMSFVSQTKRPSTAATVFFAAAEEALKPLVEEKRWKLVTDKPTCIRIVIAAYAHIDIPLYAIPDQEFVNLAEASMRRYGYDSLMDAVIKAERDAWTALPREKVLLAHRECNWMPSDPRPVKEWFLGEVEAKGEQFRRVVRYLKAFRDWKWSSGGPASILLMAAAAPLFEKRDRRDDLALLDVVAALPARLRGGVNNPVEESESLTERLGQAGVEDAAKAFEEFEKVLRGATGAGSPSQACIWMRGEFGPRFPNEPDRVKVVSVAATIAAAPATAGPSELIGRTKAG

SEQ ID NO: 2494 - protein, 380 aa, Unknown
  Description of Unknown: Proteobacteria sequence
MLNLSPLFFTTLDDESCMHDELDLTPEQRAWIASARTDVRDCLRTGIPRVLRASGYTEDVPQPRFFTQGSWAYKTLNSPAQRPQQADVDDGCYLPVSFVSQTKRPSTAATVFFAAAEEALKPLVEEKRWKLVTDKPTCIRIVIAAYAHIDIPLYAIPDQEFVNLAEASMRRYGYDSLMDAVIKAERDAWTALPREKVLLAHRECNWMPSDPRPVKEWFLGEVEAKGEQFRRVVRYLKAFRDWKWSSGGPASILLMAAAAPLFEKRDRRDDLALLDVVAALPARLRGGVNNPVEESESLTERLGQAGVEDAAKAFEEFEKVLRGATGAGSPSQACIWMRGEFGPRFPNEPDRVKVVSVAATIAAAPATAGPSELIGRTKAG

SEQ ID NO: 2495 - protein, 380 aa, Pseudomonas aeruginosa
MLNLSPLFFTTLDDESCMHDELDLTPEQRAWIASARTDVRDCLRTGIPRVLRASGYTEDVPQPRFFTQGSWAYKTLNSPAQRPQQADVDDGCYLPMSFVSQTRRPSTAATVFFAAAEEALKPLVEEKRWKLVTDKPTCIRIVIAAYAHIDIPLYAIPDQEFVNLAEASMRRYGYDSLMDAVIKAERDAWTALPREKVLLAHRECNWMPSDPRPVKEWFLGEVEAKGEQFRRVVRYLKAFRDWRWSSGGPASILLMAAAAPLFEKRDRRDDLALLDVVAALPARLRGGVNNPVEESESLTERLGQAGVEDAAKAFEEFEKVLRGATGAGSPSQACIWMRGEFGPRFPDEPDRVKVVSVAATIAAAPATAGPSELIGRTKAG

SEQ ID NO: 2496 - protein, 380 aa, Pseudomonas aeruginosa
MLNLSPLFFTTLDDECCMHDELDLTPEQRAWIASARTDVRDCLRTGIPRVLRASGYTEDVPQPRFFTQGSWAYKTLNSPAQRPQQADVDDGCYLPMSFVSQTRRPSTAATVFFAAAEEALKPLVEEKRWKLVTDKPTCIRIVIAAYAHIDIPLYAIPDQEFVNLAETSMRRYGYDSLMDAVIKAERDAWTALPREKVLLAHRECNWMPSDPRPVKEWFLGEVEAKGEQFRRVVRYLKAFRDWRWSSGGPASILLMAAAAPLFEKRDRRDDLALLDVVAALPARLRGGVNNPVEESESLTERLGQAGVEDAAKAFEEFEKVLRGATGAGSPSQACIWMRGEFGPRFPNEPDRVKVVSVAATIAAAPATAGPSELIGRTKAG

SEQ ID NO: 2497 - protein, 380 aa, Cupriavidus pauculus
MLNLSPLFFTTLDDESCMHDELDLTPEQRAWIASARTDVRDCLRTGIPRVLRASGYTEDVPQPRFFTQGSWAYKTLNSPAQRPQQADIDDGCYLPMSFVSQTRRPSTAATVFFAAAEEALKPLIEEKRWKLVTDKPTCIRIVIAAYAHIDVPLYAIPDQEFVNLAEASMRRYGYDSLMDAVIKAERDAWTALPREKVLLAHRECNWMPSDPRPVKEWFLGEVEAKGEQFRRVVRYLKAFRDWRWSSGGPASILLMAAAAPLFEKRDRRDDLALLDVVAALPARLRGGVSNPVEESESLTERLGQAGVEDAAKAFEEFEKVLRGATGAGSPSQACIWMQGEFGPRFPNEPDRVKVVSVAATIAAAPATAGPSELIGRTKAG

SEQ ID NO: 2498 - protein, 380 aa, Unknown
  Description of Unknown: Pseudomonas sequence
MLNLSPLFFTTLDNESCMHDELDLTPEQRAWIASARTDVRDCLRTGIPRVLRTSGYTEDVPQPRFFTQGSWAYKTLNSPAQRPQQADVDDGCYLPMSFVSQTRRPSTAATVFFAAAEEALKPLVEEKRWKLVTDKPTCIRIVIAAYAHIDIPLYAIPDQEFVNLAEASMRRYGYDSLMDAVIKAERDAWTALPREKVLLAHRECNWMPSDPRPVKEWFLGEVEAKGEQFRRVVRYLKAFRDWRWSSGGPASILLMAAAAPLFEKRDRRDDLALLDVVAALPARLRGGVNNPVEESESLTERLGQAGVEDAAKAFEEFEKVLRGATGAGSPSQACIWMRGEFGPRFPDEPDRIKVVSVAATIAAAPATAGPSELIGRTKAG

SEQ ID NO: 2499 - protein, 380 aa, Pseudomonas aeruginosa
MLNLSPLFFTTLDNESCMHDELDLTPEQRAWIASARTDVRDCLRTGIPRVLRTSGYTEDVPQPRFFTQGSWAYKTLNSPAQRPQQADVDDGCYLPMSFVSQTSRPSTAATVFFAAAEEALKPLVEEKRWKLVTDKPTCIRIVIAAYAHIDIPLYAIPDQEFVNLAEASMRRYGYDSLMDAVIKAERDAWTALPREKVLLAHRECNWMPSDPRPVKEWFLGEVEAKGEQFRRVVRYLKAFRDWRWSSGGPASILLMAAAAPLFEKRDRRDDLALLDVVAALPARLRGGVNNPVEESESLTERLGQAGVEDAAKAFEEFEKVLRGATGAGSPSQACIWMRGEFGPRFPDEPDRIKVVSVAATIAAAPATAGPSELIGRTKAG

SEQ ID NO: 2500 - protein, 380 aa, Thauera sp.
MLNLSPLFFTTLDDESCMHDALDLTPAQRALIAGARTDVRNCLRTGIPRVLRASGYTEDMPQPRFFTQGSWAYKTLNSPAQRPQQADVDDGCYLPMSFVSQTRRPSTAATVFFAAAEEALKPLVEEKRWKLVTDKPTCIRIVIAAYAHIDIPLYAIPDQEFVNLAEASVRRYGYDSLMDAVIKAEQDAWTALPRDKVLLAHRECNWMPSDPRPVKEWFLGEVEAKGEQFRRVVRYLKAFRDWRWSSGGPASILLMAAAAPLFEKRDRRDDLALLDVVAALPARLRAGVNNPVDESESLTERLGQAGVEEAAKAFEEFEKVLRGATGAGNPSQACIWMRGEFGSRFPNEPDRVKVVSVAATIAAAPATAGPSELIGRTKAG

SEQ ID NO: 2501 - protein, 380 aa, Unknown
  Description of Unknown: Pseudomonas sequence
MLNLSPLFFTTVDDESCIHDELDLTPEQRTKIASARTDVRSCLRTGIPRVMRAGGYTEDVPQPRFFTQGSWAYKTLNSPAQRPQQADVDDGCYLPMSFVSQTQRPSTAATVFFTAAEEALRPLVEEKGWKLVTDKPTCIRIVIAAYAHIDIPLYAIPDQEFVNLAEASMRRYGYDSVMDAIIKAERDAWTALPRDKVLLAHRECNWMPSDPRPVKEWFLGEVEAKGEQFRRVVRYLKAFRDWRWSSGGPSSILLMAAAAPLFEKRDRRDDLALLDVVAALPARLRAGVNNPVDESESLTVRLGKAGVEEAAKAFEEFEKVLRGATDASSPSQACIWMQGEFGPRFPNEPDRIKVVSIVATIAAAPAAAGPSELVGRTKAG

SEQ ID NO: 2502 - protein, 380 aa, Unknown
  Description of Unknown: Proteobacteria sequence
MLNLSPLFFTTVDDESCIHDELDLTPEQRTKIASARTDVRSCLRTGIPRVMRAGGYTEDVPQPRFFTQGSWAYKTLNSPAQRPQQADVDDGCYLPMSFVSQTQRPSTAATVFFTAAEEALRPLVEEKGWKLVTDKPTCIRIVIAAYAHIDIPLYAIPDQEFVNLAEASMRRYGYDSVMDAIIKAERDAWTALPRDKVLLAHRECNWMPSDPRPVKEWFLGEVEAKGEQFRRVVRYLKAFRDWRWSSGGPSSILLMAAAAPLFEKRDRRDDLALLDVVAALPARLRAGVNNPVDESESLTVRLGKAGVEEAAKAFEEFEKVLRGATDASSPSQACIWMQGEFGPRFPNEPDRVKVVSIVATIAAAPAAAGPSELVGRTKAG

SEQ ID NO: 2503 - protein, 380 aa, Pseudomonas aeruginosa
MLNLSPLFFTTVDDESCIHDELDLTPEQRTKIASARTDVRSCLRTGIPRVMRAGGYTEDVPQPRFFTQGSWAYKTLNSPAQRPQQADVDDGCYLPMSFVSQTQRPSTAATVFFTGAEEALRPLVEEKGWKLVTDKPTCIRIVIAAYAHIDIPLYAIPDQEFVNLAEASMRRYGYDSVMDAIIKAERDAWTALPRDKVLLAHRECNWMPSDPRPVKEWFLGEVEAKGEQFRRVVRYLKAFRDWRWSSGGPSSILLMAAAAPLFEKRDRRDDLALLDVVAALPARLRAGVNNPVDESESLTVRLGKAGVEEAAKAFEEFEKVLRGATDASSPSQACIWMQGEFGPRFPNEPDRVKVVSIVATIAAAPAAAGPSELVGRTKAG

SEQ ID NO: 2504 - protein, 380 aa, Formivibrio citricus
MLNLSPLFFTTADDESCMHDELDLTPEQRALIASARTDVRNCLRTGIPRVLRESGYAEGVPQPRFFTQGSWAYKTLNSPAQRPQQADVDDGCYLPLSFVSQTKRPSTATTVFFAAAEEALKPLVKEKQWTLVTDKPTCIRIVIAAYAHIDIPLYAIPDEEFVMLAKASMEQYGYDSLTEAVRLAERDAWTALPADEVLLAHRECNWMRSDPRPVKEWFLGEVEAKGEQFRRVVRYLKALRDWRWSSGGPASILLMTAAAPLFEKRDRRDDLALLDVVALLPARLRAGVNNPVDESESLTERLGEAGVEEAAKAFEEFEKVLRAATDAGSPSQACIWMQDEFGPRFPNAPDRVKMASVADTIAATPAMAGPSELIGRTKAG

SEQ ID NO: 2505 - protein, 380 aa, Halomonas sp.
MLNLSPLFFTTVDDESCMHGELDLTLEQRTWIASARTDVRDCLRTGIPRVLRENGYTEGVPQPRFFTQGSWAYKTLNSPAQRPQQADVDDGCYLPLSFVSQTKRPSTATTVFFAAAEEALRPLVEEKRWKLVTDKPTCVRIVISAYAHIDIPLYAIPDEEFVTLAKASMERYGYDSLTEAVNMAERDAWTALPADKVLLAHRECNWMSSDPRPVKEWFLGEVEAKGEQFRRVVRYLKAFRDWRWPSGGPASILLMAAAAPLFEKRDRRDDLALLDVVAALPVRLRAGVNNPVDDSESLTARLGKAGVEEAAKAFEEFETVLRGATDAGSPSQACIWMQGEFGPRFPNEPNRVKVVSVAATIAAAPATAGPSELVGRTKAG

SEQ ID NO: 2506 - protein, 379 aa, Pectobacterium carotovorum
MLNLSPLFFTTVDDECCMHGELDLTPEQRAQIASARTDVRNCLRSGIPRVLSANGYTEDVPQPRFFTQGSWAYKTLNSPAQCPQQADVDDGCYLPLSFVSQTKRPSTATTVFFAAAEEALVPLVEEKRWTLVTDKPTCIRIVIADYAHIDIPLYAIPDEEFVQLKVSMEQYGFDSISEAVRRSEQDTWTALPADKVLLAHRECNWIPSDPRPVKEWFLGEVDAKGEQFRRVVRYLKAFRDWRWSSGGPSSILLMAAAAPLFEKRDRRDDLALLDVVAALPARLRAGVNNPVDDAESLTARLGNAGVEEAAKAFEEFEKVLRGAIDAGSSSQACIWMQREFGPRFPNEPDRVKVVSVAATIAAAPAAAGPSELVGRTKAG

SEQ ID NO: 2507 - protein, 379 aa, Yersinia intermedia
MLNLSSLFFTTIDDESCMHKELDLTPEQRAWIASARTEVRACLRTGIPRVLREKGYTDDVPRPRFFTQGSWAYKTLNSPAQRPQQADVDDGCYLPMSFVSQTKRPSIATTVFFAAAEEALKPLVEEKKWKLVTDKPTCIRIVIATFAHIDIPLYAIPDEEFVMLTASMAIYGYDSLTEALNMAERDAWTALPTDKVLLAHRECNWMHSDPRPVKEWFLGEVDAKGEQFRRVVRYLKAFRDWRWPHGGPSSILLMAAAAPLFEKRDRRDDLALLDVVTMLPARLRAGVNNPVEESESLTDRLGRSDVEEAAKAFEVFENVLRGATDASSASQACIWMQGEFGPRFPNEPDRIKVVSVAATIAAAPATAGPSELVGRTKAG

SEQ ID NO: 2508 - protein, 379 aa, Escherichia coli
MLNLSPLFFTTVDDESCMHDELDLPPEQRDWIASARKDVRDCLRTGIPRVLNELGYTEDIPQPRFFTQGSWAYKTLNSPAQQPQQADVDDGCYLPLSFVSQTKRPSTAATVFFNAAEEALKPLIDTKQWTLVTDKPTCIRIVIATYAHIDIPLYAIPDEEFATLRVAMERYGYDSLTKAINIAERDVWTALPADKVLLAHREHNWMASDPRPVKEWFLGEVEAKGEQLRRVVRYLKAFRDWRWSSGGPTSILLMAAAAPLFEKRDRRDDLALLDVVAALPARLRAGVDNPVEGTESLTARLGKTGVEEAAEAFEEFEKVLRGATDAGSPSQACSWMQSSFGPRFPNEPNRVKVVSVAATIAAAPATAGPSELIGRTKAG

SEQ ID NO: 2509 - protein, 380 aa, Unknown
  Description of Unknown: Chromobacterium sequence
MLNLSPLFFTTVDDESCIHNQLDLTPEQRTVIASARKDVRDCLRTGIPRVLRTQGYTKDIPQPRFFTQGSWAYKTLNSPAQHPQQADIDDGCYLPLSFVSQTKRPSTAAQVFFVAAEEALKQLVDEKQWTLVTDKPTCIRIIITDYAHIDIPLYAIPDDEFDTLIKASMEKYGYDSVRDAVILAERDAWTALPADEVLLAHRECNWMCSDPRPVKEWFLAEVEAKGEQFRRVVRYLKAYRDWRWPSGGPASILLMAAVAPLFERRDRRDDLALLDVVSALPDCLRNGINNPVDESESLTDRLGKAGIEEAAKAFEGLEQKLRGAIDASNPAQACIWIRSEFGPRFPNEPGRIKVVSVAATIAATPAVAGPSEFVGRTKAG

SEQ ID NO: 2510 - protein, 384 aa, Gallaecimonas xiamenensis
MLNLGSLFFTTVDDASCMHDELNLTSEERDVIVRARTDVRNCLRTGIPRVLQKNGYMEEVPEPRFFTQGSWAYKTLNSPAKHPQQADIDDGCYMPLSFVAQTQRPSLAAEVFFAAAEEALKPLVEEKKWELVTSKATCIRIVIADYAHIDIPLYAIPDQEFAALKTVAVESYGYHNLFEAVSKASRDVWTALPADKVLLAHRECDWMASDPRPVKEWFLGQVDAKGEQFRRVVRYLKAFRDWRWSEGGPASILLMAAAAPLFEKRDSRDDLALQGVVDALPARLRAGVNNPVEPSESLTNRLGKEGVEEAARAFEAFSEVLRGAIDAGNPAQACTWMQGQFGPRFPDEPGRVRVVPGAASVAATIAATPAAAGPSELVGRTKAG

SEQ ID NO: 2511 - protein, 330 aa, Xanthomonas campestris
MLRERGYTKDVPEPRFFTQGSWAYKTINTPAQSPQQADLDDGCYLPLSFVSETKRPSIAARVFFNAAKEALAPLAERMRWKLTEKPTCIRMVISEHAHIDVPLYAIPDEEFTTLAKATMEHYALDSIAEAAIKAERDAWSALPKDKVLLAHGVDDWVASDPRPIKAWFLSEVDEKGEQFQRVIRYLKAFRDWQWKVGGPSSILLMAAAAPLFEKRERRDDLALLDVVSALPSRLRDGVCNPVESSESFTARLGKEGVEAAAKAFESLEVALRGAIDASNAAQACSWLRKEFGSRFPDEPERIKITSVKATILATAPSPGPSELVGRTKAG

SEQ ID NO: 2512 - protein, 336 aa, Xanthomonas campestris
RSGIPRVLRERGYTKDVPEPRFFTQGSWAYKTINTPAQSPQQADLDDGCYLPLSFVSETKRPSIAARVFFNAAKEALAPLAERMRWKLTEKPTCIRMVISEHAHIDVPLYAIPDEEFTTLAKATMEHYALDSIAEAAIKAERDAWSALPKDKVLLAHGVDDWVASDPRPIKAWFLSEVDEKGEQFQRVIRYLKAFRDWQWKVGGPSSILLMAAAAPLFEKRERRDDLALLDVVSALPSRLRDGVCNPVESSESFTARLGKEGVEAAAKAFESLEVALRGAIDASNAAQACSWLRKEFGSRFPDEPERIKITSVKATILATAPSPGPSELVGRTKAG

SEQ ID NO: 2513 - protein, 379 aa, Stenotrophomonas maltophilia
MLDLSSLFHTTVEGNSCLREALDLTIAQRSVISDARVEVRNCLRAGIPRVLRERGYTKDVPEPRFFTQGSWAYKTINAPAQPPQQADLDDGCYLPLSFVSETKRPSIAARVFFNAAKEALAPLADHMGWELTEKPTCIRMVIAEHAHIDVPLYAIPDEEFTSLAKATMEHYALDSIAEAAIKAERDAWSALPKDKVLLAHGVDDWVASDPRPIKAWFLNEVEEKGEQFQRVVRYLKAFRDWHWPTKGPSSILLMAAAAPLFEKRERRDDLALLDVVSALPDRLRDGVSNPVESSESFTARLGKDGVEEAAKAFEALEVALRGSIDASNAAQACSWLRKEFGSRFPDEPDRVKVSSVKATILATAPSAGPSELVGRTKAG

SEQ ID NO: 2514 - protein, 380 aa, Stenotrophomonas maltophilia
MLNLSPLLFTTLADESCLHSNLDLTDAQRALIAEARSEVRNCLRSGIPRVLGELGYQDQVPQPRFFTQGSWAYKTLNAPAKKPQQADVDDGCYLPMSFVSQGTRPSAASAIFFEATERALAPLVAQKKWKMGGKKDTCIRIEICDIAHIDIPLYAIPDSEFTALAKASMERYTFDSIAEAVTFAERDAWTALPRDKVLLAHREENWKTSDPRPVKEWFLNEVEEKGEQFRRVVRYLKAYRDWHWESGGPSSILLMAAAATIFEKRDRRDDLALLDVVAGLPGRLRSGVTNPVESSESLTDRLGRQGIEDAAQAFESLEVMLRGSINASNPSQACAWMRSEFGNRFPDEADRIKVASVLSTISATEPTPGPSELIGRSKAG

SEQ ID NO: 2515 - protein, 378 aa, Xanthomonas citri
MLNLSPLFFTTVENRTCLHGALDLEEAQRTYIAQSRLDVRNCLRAGIPAVLTARGYPGQVPTPRFFTQGSWAYKTLNAPAKPPQQADVDDGCYLPMSFVSQSNRPSVASEVFFHAAQEALKPLVDRNKWQLIVDKDTCIRIVIAKDAHIDIPLYAIPDEEFVTLAKAFESRGLTMDSITFAEEEDVWTKLPRDKVLLAHRQDNWKVSDPRPVKEWFLGEVEAKGEQFRRTVRYLKAYRDWQWESGGPASILLMAAAAPLFEKHDSRDDMALLSVVEKLPDALRAGVNNPANTNESLTGRLGVAGIENAAKAFENFAVMLRGAIHASNASQSCAWMRQEFGARFPDDPDKVKVVSVASSIASSSAIVGPSELIGRSKAG

SEQ ID NO: 2516 - protein, 378 aa, Xanthomonas fuscans
MLNLSPLFFTTVENRTCLHDALDLEEAQRAYIAQARLDVRNCLRAGIPAVLRARGYPGQVPTPRFFTQGSWAYKTLNAPAKPPQQADVDDGCYLPMSFVSQSNRPSVASEVFFYAAQESLKPLVDRNKWQLITDKDTCIRIVIAKDAHIDIPLYAIPDEEFVTLAKAFESRGLTMDSITFAEEEDVWTKLPRDKVLLAHRQENWKVSDPRPVKEWFLGEVEAKGEQFRRTVRYLKAYRDWHWESGGPSSILLMAAAAPLFAKHDSRDDLALLAVVERLPDALRSGVNNPTDDSESLTGRLGAAGVENAAKAFDESAVMLRGAIHASSASQACIWMRQEFGSRFPNDPDRIKVVSVASSIASSSAIVGPSELIGRSKAG

SEQ ID NO: 2517 - protein, 378 aa, Xanthomonas euvesicatoria
MLNLSPLFFTTVENRTCLHGALDLEEAQRTYIAQARLDVRNCLRAGIPAVLRARGYPGQVPTARFFTQGSWAYKTLNAPAKPPQQADVDDGCYLPMSFVSQSNRPSVASGVFFHAAQEALKPLVDRNKWQLITDKDTCIRIVIAKDAHIDIPLYAIPDEEFVTLAKAFESRGLTMDSITFAEEEDVWTKLPRDKVLLAHRQEDWKVSDPRPVKEWFLGEVEAKGEQFRRTVRYLKAYRDWHWESGGPSSILLMAAAAPLSAKHDSRDDLALLAVVERLPDALRNGVNNPTDASESLTDRLGAAGVENAAKAFDEFAVMLRGAIHASSASQACIWMRQEFGSRFPNDPHRIKVISVASSIASSSAIVGPSELIGRSKAG

SEQ ID NO: 2518 - protein, 378 aa, Xanthomonas phaseoli
MLNLSPLFFTTVENRTCLHGALDLEEAQRTYIAQARLDVRNCLRAGIPAVLRARGYPGQVPTPRFFTQGSWAYKTLNAPAKPPQQADVDDGCYLPMSFVSQSNRPSVASGVFFHAAQEALKPLVDRNKWQLITDKDTCIRIVIAEDAHIDIPLYAIPDEEFVTLAKAFESRGLSMDSLSFAEEEDVWTALPRDKVLLAHRQENWKVSDPRPVKEWFLGEVEAKGEQFRRTVRYLKAYRDWHWESGGPSSILLMAAAAPLFEKHDSRDDLALLAVVEKLSDALRKGVSNPVDTNESLTDRLGTVGVEDAAKAYEGFAVMLRGAIHASSASQACAWMRHEFGSRFPDDPDRVKVVSIASSIASSSAIAGPSELIGRSKAG

SEQ ID NO: 2519 - protein, 378 aa, Xanthomonas phaseoli
MLNLSPLFFTTVDNRTCLHGALDLEDAQRTYIAQARLDVRNCLRAGIPAILKAHGYPGQVPTPRFFTQGSWAYKTLNAPAKPPQQADVDDGCYLPMGFVSQSNRPSVAAGVFFQAAEAALQPLVDQNKWQLVTDKDTCIRIVIAKDAHIDIPLYAIPDEEFVTLAKAFESRGIAMDSITFAEEEDVWTKLPRDKVLLAHRQENWKVSDPRPVKEWFLSEVEAKGEQFRRTVRYLKAYRDWHWESGGPSSILLMAAAAPLFEKHDSRDDLALLAVVEKLSDALREGVSNPADTSESLTERLGAVGVEDAAKAYESFAIMLRGAIHASKASQACAWMRHEFGSRFPDDPERVKVVSVASSIASSSAIAGPSELIGRSKAG

SEQ ID NO: 2520 - protein, 378 aa, Xanthomonas campestris
MLNLSPLFFTTVDNRTCLHGALDLEDAQRTYIAQARLDVRNCLRAGIPAILKAHGYPGQVPTPRFFTQGSWAYKTLNAPAKPPQQADVDDGCYLPMGFVSQSNRPSVAAEVFFQAAEAALQPLVGQNKWQLVTDKDTCIRIVIAKDAHIDIPLYAIPDEEFVTLAKAFESRGIAMDSITFAEEEDVWTKLPRDKVLLAHRQENWKVSDPRPVKEWFLSEVEAKGEQFRRTVRYLKAYRDWHWESGGPSSILLMAAAAPLFEKHDSRDDLALLAVVEKLSDALREGVSNPADTSESLTERLGAVGVEDAAKAYESFAIMLRGAIHASKASQACAWMRHEFGSRFPDDPERVKVVSVASSIASSSAIAGPSELIGRSKAG

SEQ ID NO: 2521 - protein, 378 aa, Unknown
  Description of Unknown: Xanthomonas sequence
MLNLSPLFFTEVENRTCLHSALDLDRTLRDYIDQARLDVRNSLREGIPRVLKAGGYDGQVPRPRFFIQGSWAYKTLNAPAKPPQQADVDDGCYLPMSFVSQSNQPSVASKVFFQAAQTALQPLVDHNKWPPIIEKDTCIRIEVSKNAHIDIPLYAIPDEDFVTLAKAFESRGITMDSLTLSEEEDVWTRLPRDKVLLAHRQENWKVSDPRPVKEWFLGEVETKGEQFRRTVRYLKAYRDWHWESGGPSSILLMAAAAPLFEKHDGRDDLALLAVVEKFPDALRKGVSNPADTSESLTKRLGAVGVENAAKAFDEFVVMLRGAVHSSSASQACTWMRQEFGSRFPDEPDRVKVVSVASSIASSSAIAGPSELIGRSKAG

SEQ ID NO: 2522 - protein, 308 aa, Xanthomonas perforans
MLNLSPLFFTEVENRTCLHSALDLDRTLRDYIDQARLDVRNSLREGIPRVLKAGGYDGQVPRPRFFIQGSWAYKTLNAPAKPPQQADVDDGCYLPMSFVSQSNQPSVASKVFFQAAQTALQPLVDHNKWPPIIEKDTCIRIEVSKNAHIDIPLYAIPDEDFVTLAKAFESRGITMDSLTLSEEEDVWTRLPRDKVLLAHRQENWKVSDPRPVKEWFLGEVETKGEQFRRTVRYLKAYRDWHWESGGPSSILLMAAAAPLFEKHDGRDDLALLAVVEKFPDALRKGVSNPADTSESLTKRLGAVGVENA

SEQ ID NO: 2523 - protein, 380 aa, Methylophilus sp.
MLNLSPLFFTTLEHESCLVTNLDLKATQVDLISRVRTDVRNCLRNGIPRVLRKMGYTDDIPTPRFFTQGSWAYKTLNSPAKHPQQADVDDGCYLPLSFVSQTKKPSKAASVFFRAAEEALTDLVNERNWKLITDKPTCIRIEFSNFAHIDIPLYAIPDSEFQTLAKLAMERFGYASFAEALATVDQDIWTALPKDQVLLAHRECDWKASDPRPVKDWFLNEVDVRGEQLRRIVRYLKALRDWKWGSGGPSSILLMAAAAPLFVKHDRRDDIALLEVLAKLPQRLRAGVNNPVDVSESLTDRLGPEGVEEAALAFGEFEKALRGSVHSSSPSQACSWMCKVFGTRFPNEPDRIVVVTVVSTILATPATPGPSELVGRMKSG

SEQ ID NO: 2524 - protein, 385 aa, Oxalobacteraceae bacterium
MLNLSPLFNSESESENSFYDNIELHTKERELIQLAKTQVRACLREGIPSVLKAHGYDTQVPQPRFFTQGSWAYKTLNAPAQEPQQADVDDGCYLPLSFVSQTHKPSIAARVFFAVAEQALKPLVEANRWALVTDKPTCIRVEISETAHIDIPLYAIPDKEFVALTERAITRGYATVSEAVVAKAERDAWTELPRDCVLLAHREEDWIESDPRPVKEWFLNEVTARGEQLRRVVRYLKAYRDATWSSGGPSSILLMAAAVPLFEKRHGRDDVALLDVVAELPNRLRNGVCNPVEESESLTDRLRKQDSSKDLVEDAARRFERLEGLLRGSLAASDPVQACIWMRQAFGSRFPEAPNRVKISSVAATIAAAPAAAGASELVGRTRAG

SEQ ID NO: 2525 - protein, 380 aa, Janthinobacterium sp.
MLNLSPLFYKSEGDDVTFLDNLNLSPARKAFIAAAKTEVRSCLRDGIPRVLRERGYNGEVPRPRFFTQGSWAYGTLNAPAKPTQQADVDDGCYLPLGFVSLTARPSMASSLFFAAAQEALVPLVKERGWRLITNKSTCIRIEISSDAHIDIPLYAIPDDEFLTLTKAALNAYGFDSVEEAMRQAEQDAWTRLPSNRVLLAHREEDWKESDPRPVKDWFLGEVKVRGEQFCRVVRYLKAFRDWQWTSGGPASILLMAVAAPLFERRTGRDDLALLDVLAQLPAALRAGVKNPAEENESLTDRLGAEGVEDAATHFEEFERFVRGAVNASSESLACTWLIEKLGSRFPYQPSRVLTVSVAATIAAAPAQVAASPLVGRTKAG

SEQ ID NO: 2526 - protein, 380 aa, Roseateles terrae
MLNLTALFHTTDPKEPNLLDSLDLPPSVRTYLAQAKTDVRNCLREGIPKMLQAAGFTEKAPTPRFFTQGSWAYKTLNAPAQHPQQADVDDGCYLPLGFVKQTKRPSAATAIFFKAAEACLAVLCREKGWTLITDKPTCVRIEVTKAAHIDIPLYAIPDDEFQTLTKAAMEAYHTLDSAEAIRRAERDSWSKLPSDVVLLAHREEGWWESDPRPVKDWFEAQVLARGEQLRRVIRYLKAFRDWKWASGGPASILLMAAAVPLFERRHGRDDLALLDVLAGLPAALRAGVVNPVDENESLTKRLGQDKVEEAARELERFEGVLRASLHASSESQVCIWMQQEFGQRFPNRPHRVKVVSVAATVAAAPAAAGASELVGRSKAG

SEQ ID NO: 2527 - protein, 381 aa, Propionivibrio dicarboxylicus
MLNLTALFHTTDLNEPNLLDSLDLRPSDRIYLAQAKTDVRNCLRDGIPKMLQAAGFAEKAPTPRFFTQGSWAYKTLNAPAQHPQQADVDDGCYLPLSFVKQTKRPSAATAIFFKAAEACLADLCLEKGWTLITDKPSTCVRIEVTETAHIDVPLYAIPDDEFLTLAKAAMAAYHTLDSAEAVRLAERDSWSKLPSDVVLLAHREEGWWESDPRPVKDWFEDQVLARGEQLRRVIRYLKAFRDWQWPSGGPASILIMAAAVPLFERRHGRDDLALLDVLVGLPAALRAGVINPVNDKESLTERLGKDKVEEAARELQRFEGVLRASLHASSESQVCIWMQQEFGQRFPNRPHRIKVVSVAATVAAAPAVAGASELVGRSKAG

SEQ ID NO: 2528 - protein, 377 aa, Janthinobacterium sp.
MLNLSVLFNNSNEERPAFLDALTLDSYQKVILEYARKEIRECLKLGLPRVLRARGYELDVPTPRFFTQGSWSYKTLNAPAQTPQQCDLDDGAYLPMGFVTQTKRPSKAASLFFSAAEEALEPLVKMRGWKQSERPTCIRVEVSLDAHVDIPLYAIPDTEFELLKARASYAMDSVEDAVTRSERDAWTALPNDQVLLAHRDKDWIESDPRPLKDWFLNEVDAKGEQLRRVIRYIKAYRDWRWSQGGPASILLMAAASPLFKAKHARDDLALLEVCKALPKTLRDGVDNPTEKAESLTARLGPEGVEEAAEAFEKFAGVLEAAISCSDASLACRWLQEQLGQRFPFEPYWVPTPSAREAVLATAAIPGPSEIVGRNKSA

SEQ ID NO: 2529 - protein, 377 aa, Janthinobacterium sp.
MLNLSVLFNNSNEERPAFLDALTLDSYQKVILEYARKEIRECLKLGLPRVLRARGYELDVPTPRFFTQGSWSYKTLNAPAQTPQQCDLDDGAYLPMGFVTQTKRPSKAASLFFSAAEEALGPLVKMRGWKQSERPTCIRVEVSLDAHVDIPLYAIPDTEFELLKARASYAMDSVEDAVTRSERDAWTALPNDQVLLAHRDKDWIESDPRPLKDWFLNEVDAKGEQLRRVIRYIKAYRDWRWSQGGPASILLMAAASPLFKAKHARDDLALLEVCKALPKTLRDGVDNPTEKAESLTARLGPEGVEEAAEAFEKFAGVLEAAISCSDASLACRWLQEQFGQRFPFEPYWVPTPSAREAVLATAAIPGPSEIVGRNKSA

SEQ ID NO: 2530 - protein, 377 aa, Janthinobacterium svalbardensis
MLNLSVLFSNNNEERPAFLDALTLDPYQKFILESARKEIRECLKLGLPKVLRARGYESDVPTPRFFTQGSWSYKTLNAPAQMPQQCDLDDGAYLPMGFVTQTKRPSKAASLFFSAAEEALSPLVKMRGWKQSERPTCIRIEVSSDAHVDIPLYAIPDAEFELLKARASYVMDSVEEAVSRSERDAWTALPNDQVLLAHREKDWIESDPRPLKNWFLDEVDAKGEQLRRVVRYLKAYRDWRWSQGGPTSILLMAAASPLFEAKHGRDDLALLEVCKALPRALREGVDNPTEESESLTARLGIEGVEEAAKAFEKFANILDAAISCSDASLACRWLQEQLGQRFPFQPYWVPTPSAREAVLAAAAIPGPSEIIGRNKSA

SEQ ID NO: 2531 - protein, 399 aa, Comamonadaceae bacterium
MLNLSQLFFSSDQGQTALLDNLDLQAKQSTEIQNAKGLVRAALREGIPKKYAELQLPGKAPQPRFFTQGSWAYKTLNAPCQPPQEADIDDGCYLPMTFVTQQTKRPSVAAETFFDIAQAALEPLVKAMSWKFGREKPTCVRIHISKLAHIDVPLYAIPDEEFEKLKKSMAVESMTMDSAERAKKIDRWDALPLDQVLLAHRTEDWMPSDPRPLNDWFVDHVKVQGPQLRRVVRYLKAFRDHEWASGGPASVLLMAAVVPLFQQELGREDLSLLNVVKGIPAALRKGVNHPTDDSESLTDRLRKTGAGEGRDLVEEAAKKFSQFAGVLEATLAASNAEQGVIWMRQQFGDRFPNRADLVKVIAPPTSTTAAAAPPGVAGVIASTPAKAGPSPLVGSTRAG

SEQ ID NO: 2532 - protein, 399 aa, Unknown
  Description of Unknown: Alcaligenaceae sequence
MLNLSQLFFTSDADETALLDLLDLDATQKTEIQNAKGLVRAALREGIPKKYAELGLPGKAPQPRFFTQGSWAYKTLNAPCQPPQEADIDDGCYLPMTFVTQQTKRPSVAAEAFFRIAEDALAPLVKAKSWRFGGVKPTCIRIHISTSAHIDVPLYAIPDDEFEKLKKSMALEARAMDSATLNDSIDRWDTLPLDQVLLAHRDENWMPSDPRPLNDWFIDQVEVQGRQLRRVIRYLKAFRDHQWKSGGPASVLLMAAAVPIFQQEIGRDDLSLLNVAKGIPRALRTGVSHPTDESESLTDRLRKAGLAEGRDLVEEAALKFDQFASVLEATLAASDAVQGVIWMRGQFGHRFPNRPDRVKIIAAATSVAATTATAGVASVIASTPAKAGPTPLVGPTHAG

SEQ ID NO: 2533 - protein, 379 aa, Herminiimonas arsenicoxydans
MLNLSSLFYSGVEQPTLLDNITLSDRRCEFILEAKDAIRAQLRTGLPAVLKELGHPGAAVQPRFFTQGSWAYKTLNAPAHPEQQADIDDGAYLPLSFMRLTSKPSLASKVFFAAAETALMPLVQERKWRLITDKPTCIRIEIAEFAHIDVPLYAIPDDQFEQLRKAALSVHGYYTFDEAMKRAERDAWTELPHDQVLLAHREDDWFKSDPRPVKRWFLGEVDRHGEQFRRVVRYLKSFRDWQWVQGGPSSILLMAAAAPLFESRDRRDDLALLDLLDNLPDALRQGVLCPTDPNESLTDRLGQPGVEDAAHKLEQLEKSLRGAIHASSPSQALIWVREQFGPRFPNAPERVKVSSATAVVQATPAAIVSTPLVGRTQAG

SEQ ID NO: 2534 - protein, 379 aa, Achromobacter sp.
MLNLSSLFYSGVEQPTLLDNITLSDRRCEFILEAKEAIRAQLRTGLPAVLKELGYPGAAVQPRFFTQGSWAYKTLNAPAHPEQQADIDDGAYLPLSFMRLTSKPSVASKVFFAAAETALMPLVQERKWRLITDKPTCIRIEIAEFAHIDVPLYAIPDDQFEQLRKAALSVHGYYTFDEAMKRAERDAWTELPHDQVLLAHREDDWFKSDPRPVKRWFLGEVERHGEQFRRVVRYLKSFRDWQWVQGGPSSILLMAAAAPLFESRDRRDDLALLDLLDNLPDALRQGVLCPTDPNESLTDRLGQPGVEDAAHKLEQLEKSLRGAIHANSPSQALIWVREQFGPRFPNAPERVKVSSATAVVQATPAAIVSTPLVGRTQAG

SEQ ID NO: 2535 - protein, 379 aa, Achromobacter xylosoxidans
MLNLSSLFYSGVEQPTLLDNITLSDRRCEFILEAKEAIRAQLRTGLPAVLKELGYPGAAVQPRFFTQGSWAYKTLNAPAHPEQQADIDDGAYLPLSFMRLTSKPSVASKVFFAAAETALMPLVQERKWRLITDKPTCIRIEIAEFAHIDVPLYAIPDDQFEQLRKAALSAHGYYALDEAMKRAERDAWTELPHDQVLLAHREDDWFKSDPRPVKRWFLGEVDRHGEQFRRIVRYLKSFRDWQWVQGGPSSILLMAAAAPLFEPRDRRDDLALLDLLDNLPRALRQGVLCPTDPNESLTDRLGAPGVEDAAQKLEQLEKSLRGAIHASSPSQALIWVREQFGPRFPNTPERVKVSSATAVVQATPAAIVSTPLVGRTQAG

SEQ ID NO: 2536 - protein, 379 aa, Unknown
  Description of Unknown: Achromobacter sequence
MLNLSPLFYSGVEQPTLLDNITLSDQRCEFILEAKEAIRTQLRTGLPAVLKELGHPGAAVQPRFFTQGSWAYKTLNAPAHPEQQADIDDGAYLPLSFMRLTSKPSIASKVFFAAAETALMPLVQERKWRLITDKPTCIRIEIAQFAHIDVPLYAIPDEQFEQLRKAALSTHGYYALDEAMKRAERDAWTALPHDQVLLAHREDDWVKSDPRPVKRWFLGEVERHGEQFRRVVRYLKAFRDWQWVQGGPSSILLMAAAAPLFDSRDRRDDLALLDLLDSLPGALREGVLCPTDPNESLTERLGAPGVEDAAQKLEQLERSLRGAIHASSPSQAIIWVQGQFGPRFPNAPERVKASSATAVVQATPAAIVSTPLVGRTQAG

SEQ ID NO: 2537 - protein, 379 aa, Bordetella bronchiseptica
MLNLSSLFHAGVEDPTLLINITLSDHRCALILEAKEAIRTQLRTGLPAVLKEIGHPGAAVQPRFFTQGSWAYKTLNAPAHPEQQADIDDGAYLPLSFMRLTSKPSIASKVFFAAAETALMPLVKERKWQLITDKPTCIRIEIAEYAHIDVPLYAIPDDQFEQLRKAALSAHGYYTLDEAMKRAERDAWTELPQDQVLLAHREDDWVKSDPRPIKRWFLGEVDRHGEQFRRIVRYLKSFRDWQWVQGGPSSILLMAAAAPLFESRDRRDDLALLDLLDTLPNALRRGVLCPTDSNESLTDRLGAAGVEDAAQKLEQLHRSLRGAIHASSPSQAIIWVREQFGPRFPDAPERVKVSSATAVVQATPAAIVSTPLVGRTQAG

SEQ ID NO: 2538 - protein, 379 aa, Paraburkholderia phenoliruptrix
MLNLSSLFHSTVDGPTLLENLELTLGQKAYIAEAKSAVRICLRENLMKVLRDHGYVGPTVRPRFFTQGSWAYKTLNAPARHPQQADVDDGAYLPLSFVSQSTRASVASAIFFAAAQKALEPLVTARKWKLVTDKPTCIRIEIAKFAHVDIPLYAIPDEEFETLQKAALTTYGYMTFDAAIVEAERDAWTALPRDHVLLAHREDDWVKSDPRPVKSWFLDEVERHGEQFRRAIRYLKALRDWQCDSGGPSSILLMAAAAPVFEARERRDDLALLNLAERLPGVLRYGVCNPVDANESLTERLGPQGVENAVQMFQRFERFLRAAIESSSSHQACAWMTNQFGERFPNLPSRVKVATVAATVLGTPATVVASPLVGRSQAG

SEQ ID NO: 2539 - protein, 379 aa, Burkholderia cepacia
MLNLSSLFHSTVEDSTLLSNIELTPRDQSFIAEAKSAVRICLRENLMQVLRDHGYSGPTVRPRFFTQGSWAYKTLNAPAQHPQQADVDDGAYLPLSFVSQTDKPSVASAIFFAAAEEALRPLVWARGWTLITDKPTCIRIEISAFAHVDIPLYAIPDKEFETLQKAALNQYGYITLDSAISVAERDAWTALPRDHVLLAHREDDWVKSDPRPVKDWFLDEVERHGEQFRRVVRYLKAFRDWQWVSGGPSSILLMAASASIFDSRDRRDDLALQNLADKLPSVLRDGVSNPVDAGESLTDRLGFEGVDEAARKIELFETFLRGALGCNSSGQACAWMVQQFGPRFPNAPSRVKVASVAAAVLATPASAVASPLVGRSQAG

SEQ ID NO: 2540 - protein, 379 aa, Burkholderia multivorans
MLNLSSLFHSTVEDSTLLSNIELTLQERSFIAEAKSAVRICLRENLMQVLRNHGYTGPTVRPRFFTQGSWAYQTLNAPAQHPQQADVDDGTYLPLSFVSQTARPSVASAIFFAAAEEALRPLVRVRGWKLITDKPTCIRIEISAFAHVDIPLYAIPDDEFDKLQKAALSQYGYIALDSAISAAERDAWTELPRDHVLLAHREDNWVKSDPRPVKDWFLDEVERHGEQFRRIVRYLKAFRDWQWVSGGPSSILLMAASAPVFDSRDRRDDLALLDLVDKLPSVLRDGVSNPVDAGESLTDRLGHDGVEEAAGKIELFETFLRGALGSGSPNQACAWMLQQFGPRFPNAPSRIKVASVAATVLATPVSAVASPLVGRSQAG

SEQ ID NO: 2541 - protein, 378 aa, Caballeronia pedi
MLNLSSLFYSSVEEQTLLRNLDLNDEERIFIAEAKSAVRRCLRDNLMKVLREHGYDGAAVHPRFFTQGSWAYKTLNAPAQAPQQADVDDGAYLPLSFVSQEEKPSVASGIFFEAAEKALEQLVKARRWKLVTDKPTCIRIEIAKFAHVDIPLYAIPDDEFETLQKAMEQYGYPIFDSALGQAERDVWTALPRDHVLLAHRERNWVKSDPRPVKTWFLEEVDRHGEQYRRSVRYIKGFRDWQWKSGGPSSILLMAASAPVFEARERRDDLALLDVVEKMPAVLRDGVRNPVDPNESLTDRLGRAAVEEAAKKLERLESFLRAALHGSNAAQACSWLVNQFGDRFPDEPHRVKVTSVAATVLTAPACAVASPLVGRRQAG

SEQ ID NO: 2542 - protein, 380 aa, Hylemonella gracilis
MLNISTLFYTDAGDANLLQNLNLKSPQEKYIGEAKRVIRERLRTGIPQELKKAGYPGPVPEPRFFTQGSWAYKTLNAPAQKPQQADIDDGAYMPLSFVSQTKRPSMASAIFFKAAEAALKLLVDANKGWQLIIDKPTCVRVVISDYAHVDIPLYAIPDQEFTTLAKMAMDHGYNEIREAVMAKAEQDAWWALPRHSVLLAHREEDWLESDPRPVKKWFEREVLVKGEQLRRIIRFIKAFRDWQWPTDGPSSILLMAAATPNFEKRERRDDVALLDVVAKIPGALRRGVFNPIDPAESLTARLGPQKVEEAAKAFEELERYLRGAINASNAAQACTWLVEKFGHRFPNEPERIKSVTVAATVAAAPAQPGPSEIIGRTKAG

SEQ ID NO: 2543 - protein, 387 aa, Betaproteobacteria bacterium
MLNLSALFYTEVDSEPCLFGNLELLDEDREIIAEAKNTVRMALRDGIPRVYREEGHPGEVPQPRFFTQGSWAYKTLNAPAQAPQQADVDDGCYLPLSFLIQTDKPSVAADVFFEVAEKALQPLVDERGWTLSGKPTCIRIEISDLAHIDVPLYAIPDKEFATLVKAENVRRAALDSVAFAEAAADSWDEMPTTKVLLAHREDGWTHSDPRPVKKWFVDQVEKKGVQLRRIVRYLKAYRDWTWPAGGPSSILLMAAAAPLFFKQDRRDDQALLEVVKGLPSALRNGVNNPANIDESLTDRLRASSSEVDMVEQAASSFEELGRQFQAALDAGNAAQACAWMRKLFGPRFPDRPDCAKVSAAVSAVAAAIAASPAIAGPSELMGRTRAG

SEQ ID NO: 2544 - protein, 388 aa, Zoogloea sp.
MLNLSALFYTEVESEPCLFGNLSLRDEDRKDIAEAKNEVRMALRDGIPRIYAAEGHPGKVPQPRFFTQGSWAYKTLNAPAQRPQQADVDDGCYLPLSFLNQTDSPSVAAEVFFGVAERALADLVEERGWELSGKPTCIRVEISDLAHIDIPLYAIPDNEFETLVKAENVRRAALKGIRNFAEAATDSWEELPKTKVLLAHREEGWMHSDPRPVKEWFVDQVETKGVQLRRVVRYIKAYRDWTWKSGGPSSILLMAAAAPLFVKQDRRDDQALLDVVKQLPAALREGVDNPVNPKESLTDRLRASSDDVDMVEQAALQFEDMGRRLQAAMDAGNAAQACAWMQSLFGPRFPAHPDRVKVGAAASAVAATIASSPAIAGPSELVGRTRAG

SEQ ID NO: 2545 - protein, 388 aa, Rhodoferax saidenbachensis
MLNLSALFYTEVEFETCLFDNLNLPEDAKSDIADAKNDVRMALRDGIPRVYADEGHPGKVPQPRFFTQGSWAYKTLNAPAQSPQQADVDDGCYLPLSFLTLTDRPSVAAEVFFDVAQKALAELVEQRGWKLSSKPTCIRIEINDLAHIDVPLYAIPDKEFETLVKAENVRRATLDGKSYSFEAAADSWDELSTTKVLLAHRDEGWMHSDPRPVKTWFVDQVATKGEQLRRVVRYLKAYRDWTWDKGGPSSILLMAAAAPLFVRQDRRDDQALLDVVKLLPAVLRKGVNNPINPEESLTDRLRASSDDADMVEQAALQFEDLGSRLQAALDAGNAEQACSWLRDLFGPRFPNRPERVKVGAAVSSVAAAIASSPAIAGPSELVGRTRAG

SEQ ID NO: 2546 - protein, 377 aa, Marinomonas atlantica
MLNLSPLFNTSTGEPHLLKNLDITKDQRDEINEARNAVRNCLRDCLPKVLQDQFDVSSPPNPRFFTQGSWAYKTINAPAKNPQQADIDDGCYLPLSFVANTERPSIAANIFFKASEQALKALLEIKGWRLTSKATCIRVIIADYAHIDIPLYAIPDNEFVTLSKASMEHGHGSLSEAMNRSDRDSWVALPHDKVLLAHRENNWMPSDPRPVKTWFQTQVEVKGEQFRRIVRYLKAFRDWKWSTGGPSSILLMTAAAPFFEKHNQRDDLALLNVVKEIPEKLRSGVYNPVDSSESLTDRLGKDAVEEAAQAFEEFERSLSSAIYGSRSTTACITMQELFGSRFPYDPNRVVSVSVEDTITATPAKAGPSELVGRTKAG

SEQ ID NO: 2547 - protein, 381 aa, Desulfovibrio sp.
MLNISPLFYTTENACPCLLCEIDLTRKEKDYINAAKTSIRACLRSGIPKLLKDNNFEGVTPIPKFYTQGSWAYKTINAPAHIQIQQADIDDGCYLPMSFATLTKRPSHASKLFFVAAENALEPLCKENGWELCRDKDTCIRVYISNTAHIDIPLYAIPDDEYQTMSQHILEAHGYASFSAALEKHYSDSWTALPADRVMLAHRVEDWIPSDPRPVKKWFEDEVAAKGEQLRRVVRYLKAFRDWKWPTKGPSSILLMAAAAPVFEESQKRDDLALLTVVSSLPEALRQGVSNPTDPDESLTDRLGEPGVSDAIKVFMDFAEVLRAAIEAGNADQVCHWMQKEFGPRFPHEPARIKSESIREKIVAAPAMAGPSVLPERTHSA

SEQ ID NO: 2548 - protein, 379 aa, Pseudomonas sp.
MPNFSPLLFTTTGEACFLDQLDLAPEELSRIDNARKDIREALKADLPGALRDKGLEGDICEPRFYIQGSRAYKTLNSPCTTPPQQSDIDDGVYLPLSVMREESSPKLAIALFFDAVLDVLRPMCAERGWHTESKDTCVRVTISPYAHIDLPLYVIPDTLFQQIKANMESRGHAVFDSAINSERDSWKTLPSDKILLADRKQGWRKSDPMAMKNWFKRECLEKGDQLIRVVRYLKAFRDKQWEEKGPSSILLMAAACPLFEYFDKRDDRSLLNVVKGIPDALRNGVASPIDSTASLTAHMPKEAIADAVEFFEEFARHLEGAINATDATTANNWLHKMLGDRFPYAPHRMRSSPEGMPASMAAIAPLAGPAEPVKRTKAG

SEQ ID NO: 2549 - protein, 379 aa, Pseudomonas tolaasii
MPNFSPLLFTTTGEACFLDQLDLAPEELSRIDNARKDIREALKADLPGALRGKGLEGDICEPRFYIQGSRAYKTLNSPCTTPPQQSDIDDGVYLPLSVMREESSPKLAIALFFDAVLDVLRPMCAERGWHTESKDTCVRVTISPYAHIDLPLYVIPDTLFQQIKANMESRGHAVFDSAINSERDSWKTLPSDKILLADRKQGWRKSDPMAMKNWFKRECLEKGDQLIRVVRYLKAFRDKQWEEKGPSSILLMAAACPLFESFDKRDDRSLLNVVKGIPAALRNGVASPIDSTASLTAHMPKEAIADAVEFFEEFARHLEGAINATDATTANNWLHKMLGDRFPYAPHRMKSTPEGMPASMAAIAPLAGPAEPVKRTKAG

SEQ ID NO: 2550 - protein, 375 aa, Pseudomonas tolaasii
MPNFSPLLFTTTGEACFLDQLDLAPEELSRIDNARKDIREALKADLRGKGLEGDICEPRFYIQGSRAYKTLNSPCTTPPQQSDIDDGVYLPLSVMREESSPKLAIALFFDAVLDVLRPMCAERGWHTESKDTCVRVTISPYAHIDLPLYVIPDTLFQQIKANMESRGHAVFDSAINSERDSWKTLPSDKILLADRKQGWRKSDPMAMKNWFKRECLEKGDQLIRVVRYLKAFRDKQWEEKGPSSILLMAAACPLFESFDKRDDRSLLNVVKGIPAALRNGVASPIDSTASLTAHMPKEAIADAVEFFEEFARHLEGAINATDATTANNWLHKMLGDRFPYAPHRMKSTPEGMPASMAAIAPLAGPAEPVKRTKAG

SEQ ID NO: 2551 - protein, 379 aa, Pseudomonas sp.
MPNFSPLLFTTTGEVCFLDELDLKPEELAQIDGARKDIREALKADLPGALRDKGLEGDICEPRFYIQGSRAYKTLNSPCTTPPQQSDIDDGVYLPLSVMREESSPKLAITLFFDAVIDVLRPICAQRGWHTEPKDTCVRVTISRSAHIDLPLYVIPDTLFQLIKASMESRGHAVFDSAINSERDSWKTLPSDKILLADRKQGWRKSDPMAMKNWFKRECQEKGDQLIRVVRYLKAFRDKQWKDKGPSSILLMAAACPLFEYFDKRDDRALLNVVKGIPDALRNGVASPIDARASLTAHMPKEAIADAVEFFQEFARYLEGAINATDADTAYNWLRQMLGDRFPYAPHRMKSNPEGMPATMAAIAPLAGPAEPVKRTKAG

SEQ ID NO: 2552 - protein, 379 aa, Pseudomonas fluorescens
MPNFSPLLFTTTGEACFLDELDLKPEELAQIDGARKDIREALKADLPGALRDKGLEGDICEPRFYIQGSRAYKTLNSPCTTPPQQSDIDDGVYLPLSVMREESSPKLAIALFFDAVIDVLRPICAQRGWYTEPKDTCVRVTISRSAHIDLPLYVIPDTLFQLIKASMESRGHAVFDSAINSERDSWKALPSDKILLADRKQGWRKSDPMAMKNWFKRECQEKGDQLIRVVRYLKAFRDKQWEDKGPSSILLMAAACPLFEYFDKRDDRALLNVVKGIPDALRNGVASPIDASASLTAYMPKEAIADAVEFFQEFARYLEGAINATDAHTAYNWLHQMLGDRFPYAPHRMKSNPEGMPATMAAIAPLAGPAEPVKRTKAG

SEQ ID NO: 2553 - protein, 379 aa, Pseudomonas syringae
MPNFSPLLFTTTGEACFLDELNLAPEELAQIDGARKDIREALKAELPSALRDKGLEGDICEPRFYIQGSRAYKTLNSPCTTPPQQSDIDDGVYLPLSVMREESSPKLAIALFFDAVIDVLGPMCAERGWHTQAKDTCVRVTISPSAHIDLPLYVIPDTLFQLIKANMESRGHAVFDSAINSERDSWKTLPSDKILLADRKQGWRKSDPMAMKNWFKRECLEKGDQLIRVVRYLKAFRDKRWEDKGPSSILLMAAACPLFQFFDKRDDRALLNVAKGIPDALRNGVASPIDPDASLTAPMAKEALADAVEFFEEFSRYLEGAIDATDAHTANNWLHQMLGDRFPYAPYRMKSNPESMPASMAAIAPLAGPAEPVKRTKAG

SEQ ID NO: 2554 - protein, 379 aa, Unknown
  Description of Unknown: Pseudomonas syringae group sequence
MPNFSPLLFTTTGEACFLDELNLAPEELAQIDGARKDIREALKAELPSALRDKGLEGDICEPRFYIQGSRAYKTLNSPCTTPPQQSDIDDGVYLPLSVMREESSPKLAIALFFDAVIDVLGPMCAERGWHTQAKDTCVRVTISPSAHIDLPLYVIPDTLFQLIKANMESRGHAVFDSAINSERDSWKTLPSDKILLADRKQGWRKSDPMAMKNWFKRECLEKGDQLIRVVRYLKAFRDKRWEDKGPSSILLMAAACPLFQFFDKRDDRALLNVAKGIPDALRNGVASPIDPDASLTAPMAKEALADAVEFFEEFARYLEGAIDATDAHTANNWLHQMLGDRFPYAPYRMKSNPESMPASMAAIAPLAGPAEPVKRTKAG

SEQ ID NO: 2555 - protein, 379 aa, Pseudomonas syringae
MPNFSPLLFTTNGEACFLDELNLAPEELAQIDGARKDIREALKAELPGALRDKGLEGDICEPRFYIQGSRAYKTLNSPCTTPPQQSDIDDGVYLPLSVMREESSPKLAIALFFDAVIDVLGPMCAERGWNTQAKDTCVRVTISPSAHIDLPLYVIPDTLFQLIKANMESRGHAVFDSAINSERDSWKTLPSDKILLADRKQGWRKSDPMAMKNWFKRECLEKGDQLIRVVRYLKAFRDKQWEDKGPSSILLMAAACPLFQFFDKRDDRALLNVAKGIPDALRNGVASPIDPSASLTAHMPKEALADAVEFFEEFARYLEGAIDATDAHTANNWLHQMLGDRFPYAPYRMRSNPESMPASMAAIAPLAGPAEPVKRTKAG

SEQ ID NO: 2556 - protein, 379 aa, Pseudomonas sp.
MPNFSPLLFTTNGEACFLDELNLAPEELAQIDGARKDIREALKAELPGALRDKGLEGDICEPRFYIQGSRAYKTLNSPCTTPPQQSDIDDGVYLPLSVMREESSPKLAIALFFDAVIDVLGPMCAERGWHTQAKDTCVRVTISPSAHIDLPLYVIPNTLFQLIKANMESRGHAVFDSAINSERDSWKTLPSDKILLADRKQGWRKSDPMAMKNWFKRECLEKGDQLIRVVRYLKAFRDKQWEDKGPSSILLMAAACPLFQFFDKRDDRALLNVAKGIPDALRNGVASPIDPSASLTAHMPKEALADAVEFFEEFARYLEGAIDATDAHTANNWLHQMLGDRFPYAPYRMKSNPESMPASMAAIAPLAGPAEPVKRTKAG

SEQ ID NO: 2557 - protein, 379 aa, Pseudomonas sp.
MPNFSPLLFTTTGEACFLDELNLAPEELAQIDGARKDIREALKAELPGALRDKGLEGDICEPRFYIQGSRAYKTLNSPCTTPPQQSDIDDGVYLPLSVMREESSPKLAIALFFDAVIDVLGPMCAERGWHTQAKDTCVRVTISPSAHIDLPLYVIPDTLFELIKANMESRGRAVFDSAINSERDSWKTLPSDKILLADRKQGWRKSDPMAMKNWFKRECLEKGDQLIRVVRYLKAFRDKRWEDKGPSSILLMAAACPLFQFFDKRDDRALLNVVKGIPDALRNGVASPIDPDASLTAPMAKEALADAVEFFEEFARYLEGAIDATDAHTANNWLHQMLGDRFPYAPYRMKSNPESMPASMAAIAPLAGPAEPVKRTKAG

SEQ ID NO: 2558 - protein, 393 aa, Pseudomonas syringae
MSETPFIQPLSGGVMPNFSPLLFTTTGEACFLDELDLKSNELAEIDGARQDIREALKADLPRVLSEKGLEGEICEPRFYIQGSRAYKTLNSPCTTPPQQSDIDDGVYLPLSVMREESSPKLAISLFFDAVIDVLGPMCAERGWCTESKDTCVRVTISPYAHIDLPLYVIPDTLFKLIKASMESRGHATFDSAINSERDSWKTLPSDKILLADLKQGWRKSDPMAMKNWFKRECQEKGDQLIRVVRYLKAFRDKQWEDKGPSSILLMAAACPLFEYFDKRDDRALLNVVKGISDALRNGVQSPIDPEASLTAHMPKEAIAEAVELFQEFAKYLQGAIDAADAQTAYNWVHSMLGDRFPYAPHRMKSNPEGMPASMAAIAPLAGPPEPVKRTKAG

SEQ ID NO: 2559 - protein, 379 aa, Unknown
  Description of Unknown: Pseudomonas syringae group sequence
MPNFSPLLFTTTGEACFLDELDLKSNELAEIDGARQDIREALKADLPRVLSEKGLEGEICEPRFYIQGSRAYKTLNSPCTTPPQQSDIDDGVYLPLSVMREESSPKLAISLFFDAVIDVLGPMCAERGWCTESKDTCVRVTISPYAHIDLPLYVIPDTLFKLIKASMESRGHATFDSAINSERDSWKTLPSDKILLADLKQGWRKSDPMAMKNWFKRECQEKGDQLIRVVRYLKAFRDKQWEDKGPSSILLMAAACPLFEYFDKRDDRALLNVVKGISDALRNGVQSPIDPEASLTAHMPKEAIAEAVELFQEFAKYLQGAIDAADAQTAYNWVHSMLGDRFPYAPHRMKSNPEGMPASMAAIAPLAGPPEPVKRTKAG

SEQ ID NO: 2560 - protein, 379 aa, Pseudomonas syringae
MPNFSPLLFTTTGEACFLDELSLKSHELAEIDRARQDIREALKADLPRVLSEKGLEGEICEPRFYIQGSRAYKTLNSPCTTPPQQSDIDDGVYLPLSVMREESSPKLAISLFFDAVIDVLGPMCAERGWRTESKDTCVRVTISPYAHIDLPLYVIPDTLFKLIKASMESRGHATFDSAINSERDSWKTLPSDKILLADLKQGWRKSDPMAMKNWFKRECQEKGDQLIRVVRYLKAFRDKQWEDKGPSSILLMAAACPLFEYFDKRDDRALLNVVKGIPDALRNGVQSPIDPEASLTAHMPKEAIAEAVELFQEFAKYLQGAIDAADAQTAYNWVHSMLGDRFPYEPHRMKSNPEGMPASMAAIAPLAGPPEPVKRTKAG

SEQ ID NO: 2561 - protein, 379 aa, Pseudomonas congelans
MPNFSPLLFTTTGEACFLDELNLKSHELAEIDGARQDIREALKADLPRVLSEKGLEGEICEPRFYIQGSRAYKTLNSPCTTPPQQSDIDDGVYLPLSVMREESSPKLAISLFFDAVIDVLGPMCAERGWRSESKDTCVRVTISPYAHIDLPLYVIPDTLFKLIKASMESRGHATFDSAINSERDSWKTLPSDKILLADLKQGWRKSDPMAMKNWFKRECQEKGDQLIRVVRYLKAFRDKQWEDKGPSSILLMAAACPLFEYFDKRDDRALLNVVKGIPDALRNGVQSPIDPEASLTAHMPKEAIAEAVELFQEFAKYLQGAIDAADAQTAYNWVHSMLGDRFPYEPHRMKSNPEGMPASMAAIAPLAGPPEPVKRTKAG

SEQ ID NO: 2562 - protein, 379 aa, Pseudomonas amygdali
MPNFSPLLFTTTEEACFLNELNLKPQELAEIDGARQDIREALKADLPRVLSEKGLEGEICQPRFYIQGSRAYKTLNSPCTIPPQQSDIDDGVYLPLSVMREESSPKLAISLFFDAVIDVLGPMCTERGWHTESKDTCVRVTISLYAHIDLPLYVIPDTLFKLIKASMESRGHAVFDSAINSERDSWKTLPSDKILLADRKQGWRKSDPMAMKNWFKSECQEKGDQLIRVVRYLKAFRDKQWEDKGPSSILLMAAACPLFEYYDKRDDRALLNVVKGIPEALRKGVQSPVDPEASLTAHMPKEALADAVELFQEFAKHLQGAIDATDAYTAHNWLHSMLGDRFPYAPHRMKQNPESLPASMAAIAPLAGPAEPVKRTKAG

SEQ ID NO: 2563 - protein, 379 aa, Pseudomonas chlororaphis
MPNFSPLLFTTTGEDCFLDELNLTPDELTEIDGARKDIREALKADLPRALREKGLEGEVCEPRFYIQGSRAYKTLNSPCTTPPQQSDIDDGVYLPLSVMREESSPKLAITLFFDAVIDVLQAMCAERGWNAESKDTCVRVTISPYAHIDLPLYVIPDTLFLLIKASMESRGHAVFDSAINSERDTWKTLPSDKILLADRKQGWRKSDPMAMKNWFKRECQEKGDQLIRVVRYLKAFRDKQWEDKGPSSILLMAAACPLYEYFDKRDDHALLNVVKGIPDALRKGVMSPIDPESSLTAHMPKEAIAEAVELFQVFANHLEGSIKATDAQTAYHWLHSMLGDRFPNAPYRMKPNSESLPASMAAIAPLAGPAEPVKRTKAG

SEQ ID NO: 2564 - protein, 379 aa, Pseudomonas marginalis
MPNFSPLLFTTTGEDCFLDELNLTPDALTEIDGARKDIREALKADLPRALREKGLEGEVCEPRFYIQGSRAYKTLNSPCTTPPQQSDIDDGVYLPLSVMREESSPKLAITLFFDAVIDVLQAMCAERGWNTESKDTCVRVTISPYAHIDLPLYVIPDTLFLLIKASMESRGHAVFDSAINSERDTWKTLPSDKILLADRKQGWRKSDPMAMKNWFKRECQEKGDQLIRVVRYLKAFRDKQWEDKGPSSILLMAAACPLYEYFDKRDDHALLNVVKGIPDALRKGVMSPIDPESSLTAHMPKEAIAEAVELFQVFANHLEGSIKATDAQTAYHWLHSMLGDRFPNAPYRMKPNSESLPASMAAIAPLAGPAEPVKRTKAG

SEQ ID NO: 2565 - protein, 379 aa, Pseudomonas fuscovaginae
MPNFSPLLYTTTGEACFLDELNLKAHELAEIDGARQDIREALKADLPRALREKGLDGDICEPRFYIQGSRAYKTLNSPCTTPPQQSDIDDGVYLPLSVMREESSPKLAIGLFFDAVIDVLGPMCERRGWYTESKDTCVRVTISPHAHIDLPLYVIPDDLFLLIKASMESLGHAMFDSAINSERDSWKTLPSDKILLADRKEGWRKSDPMAMKNWFKRECQDKGDQLIRVVRYLKAFRDKQWKEKGPSSILLMAAACPLFEFVDKRDDCALLNVVKGIPDALRKGVQSPIDPEASLTAHMPVEAIADAVELFEEFAKHLEGAINATDAQTAHNWMNSMLGDRFPYALDRMKSNPEGLPASMAAIAPLAGPAEPVKRTKAG

SEQ ID NO: 2566 - protein, 380 aa, Pseudomonas sp.
MPNFSTLLFTTTGEDCFLDELNLAADELAQIDGARKDIREALKADLPRVLREKGLEGEICPPRFYIQGSRSYKTLNSPCTTPPQQSDIDDGVYLPLSVMREETSPKLAIALFFDAVVDVLTQICAERGWQIESKDTCVRVTISLYAHIDLPLYVIPDTLFLLIKSSMENRGQVVFDSAINSERDTWKTLPSDRILLADRNQGWRKSDPMAMKNWFKRECQDKGPDQLIRVVRYLKAFRDKQWEEKGPSSILLMAMSCSLFEYVDKRDDRALLNVVKGIPAALQNGVMSPIDPEASLTAHMLKENIADAVEQFQIFATHLEGAINSTDAETAYVWLHRMLGDRFPNAPHRMKSNSEGIPASMAAIAPLAGPAEPVKRTKAG

SEQ ID NO: 2567 - protein, 381 aa, Pseudomonas argentinensis
MRDEPNFSPLLFTTTGESCFLDELNLDAGELSQIDGARKDIREALKAGLPQKLRDKGLEGDVCEPRFYIQGSRAYKTLNSPCFTPPQQSDIDDGVYLPLSVMREESSPKLAISLFFDAVIEVLGPLCRANWWSTKSKDTCVRVTISDRAHIDLPLYVIPDKLFMQIKANMESRGHAVFDAAINSEQDSWKTLPKDKILLADREQGWRKSDPMAMKNWFKHEALEKGDQLVRVVRYLKAFRDKQWKEKGPSSILLMAAACPLFEYHDKRDDRSLLNVVKGIPAALRAGVKSPIDPEASLTAHLSREDIDTAVMHFQDFAQYLQGAIDSPDPHTAYAWMHKMLGDRFPNAPHRMKASDGMPASMAAIAPLAGPPETVKRTKAG

SEQ ID NO: 2568 - protein, 379 aa, Pseudomonas psychrotolerans
MPNFSPLLFTTVEENCFLNNLNIDSDDLSRIDDARKDIRKVLKENLPNKLRDKGLEGEICEPRFYIQGSRSYKTLNSPCTTPPQQSDIDDGVYLPLSVMREEKSPRLAIELFFDSVMEVLNPLCGEKGWALEAKDTCVRVIISAYAHIDLPLYVIPDDLFQQLKVAMESYGYMTLDEAMSSQRDSWTMLPSDRIMFADRKQGWRNSDPMKMKAWFKDEVQERGEQLIRIVRYLKAFRDKQWKDKGPSSILLMAVACPLFEKDDRRDDRALLNVVKGIPSALKAGVLSPIDSEASLTDHMSKEAIDEAAAKFETFAQHLEGAIHATDSSIACSWMREMLGDRFPDEPQRVKSSQEDMPPAMAAIAPLAGPAEAVKRTRAG

SEQ ID NO: 2569 - protein, 378 aa, Pseudomonas putida
MPNFSPLLYTTTGDACFLDQLDLTPEQLGEIDGARREIRAALKAELSNVLRDEGLEGDICDPRFYIQGSRAYKTLNSPCITPPQQSDIDDGVYLPLSVMREKRSPKLAIELFFDAVIKVLEPMCKTKGWETEKKATCVRVTISPYAHIDLPLYVIPDTRFMLLKAGLESNEGRMFDSAMNTEQQTWRTLPSDEILLADRDQGWRKSDPMAMKDWFKAEVEGKDQLVRVVRYLKAFRDKQWEEKGPSSILLMAMACPLYERFDKRDDCALLHVVKGIPSALRAGVASPIDPESSLTAHMTQQSIDDCVEKFENFGRYLDGAIAAIDARVACNWLLEVLGDRIPNEPDRMKANTEAMPPAMAAIPPLAGPAEPVKRTKAG

SEQ ID NO: 2570 - protein, 378 aa, Pseudomonas fluorescens
MPNFSPLLYTTTGDTCFLDELDLTPEQLAEIDGARKEIRVVLKAELPKVLREKGLEGEICEPRFYIQGSRAYKTLNSPCITPPQQSDIDDGVYLPLSVMREKSSPKLAIDLFFEAVVDVLDLMCTDKDWQTEIKATCVRVTISPYAHIDLPLYVIPDTRFMLLKASVEGTEGRALDSAMNTEQQTWKTLPSDQILLADRELGWRKSDPMAMKDWFKAEVEGKDQLVRVVRYLKAFRDKQWEEKGPSSILLMAMACPLYERFDKRDDCALLHIVKGIPTALRAGVASPIDSESSLTAHMSKQSIDDAVEKFQNFARYLEGAIGATDSRVACNWLLEVLGDRIPNEPDRMKPNTEAMPPFMAAIPPLAGPAEPVKRTKAG

SEQ ID NO: 2571 - protein, 378 aa, Pseudomonas syringae
MPNFSPLLYTTTGDTCFLDELDLTPEQLAEIDGARKEIRVVLKADLPKVLREKGLEGEICEPRFYIQGSRAYKTLNSPCITPPQQSDIDDGVYLPLSVMREKSSPKLAIDLFFEAVVDVLDPMCTDKDWQTEIKATCVRVTISPYAHIDLPLYVIPDTRFMLLKASVEGAEGRALDSAMNTEQQTWKTLPSDQILLADRELGWRKSDPMAMKDWFKAEVEGKDQLVRAVRYLKAFRDKQWEEKGPSSILLMAMACPLYERFDKRDDCALLHIVKGIPTALRAGVASPIDSESSLTAHMSKQSIDDAVEKFQNFARYLEGAIGATDSRVACNWLLEVLGDRIPNEPDRMKPNTEAMPPFMAAIPPLAGPAEPVKRTKAG

SEQ ID NO: 2572 - protein, 196 aa, Pseudomonas sp.
MTPSKLPRALRERGYEGKECNPKFFIQGSWAYKTLNRPCQTPPQQSDVDDGVYLPMSIVTEENRPTMAIKDFRAAVSDVLKPLCDEKGWELSSKATCLRIEISTFAHIDLPLYAIPDDQYLKIVDSMEARNYTAIKALATNSEQDCWKKLPSDKILLACEDKWIISDPLKMKEWFELEISDKEEHAVHDYMAKARR

SEQ ID NO: 2573 - protein, 381 aa, Pseudomonas sp.
MPNLSPLLYSSKEHSTFLKRLDLGDSEKQSINSARADVRDALRRKLPRALRDRGYEGKECNPKFFIQGSWAYKTLNRPCQTPPQQSDVDDGVYLPMSIVTEENRPTMAIKDFRAAVSDVLKPLCDEKGWELSSKVTCLRIEISTFAHIDLPLYAIPDDQYVMIVESMEARNHSVIKALATDSEQDCWKKLPSDKILLACEDKWIISDPLKMKEWFELEVSDKEEQLRRVIRYIKAFRDKQWDKGGPSSILLMAAACPLFQFYPKRDDLALFHVVKGLPDALRNGVKSPIDSKVYLTDALGEEGVTEAAEKFETFRIYLEASTADSAKKDMACQWMCAMLGDRFPNRPDLIPDQPAQPMPAVMAATPPERGPSEIVKRTKAG

SEQ ID NO: 2574 - protein, 381 aa, Pseudomonas sp.
MPNLSSLLYSSNEHITFLKELDLVETEKQEINSARADVRDELRKKLPSAMKARGYNGKERKPKFFIQGSWAYKTLNRPCQTPPQQSDVDDGVYLPMSIITEENRPIMAIQDFRAAVWDALKPMCDEKGWTLSSKTTCMRVEVSTTAHIDLPLYAIPDDQYALIIEGMEARNYGVLKGLAINSEQDSWKKLPSDKILLACEDKWIVSDPLKMKEWFELEISDKEEQLRRVIRYIKAFRDKQWDKGGPSSILLMAAACPLFEFHYKRDDLALLAVVSGLPNALREGVKSPVDSKVYLTDALGENGIEEAAEKFETFKKYLVASIEDSAQKEMACLWMRTMLGERFPNRPDLIGDQVFKPMPAAMAAIAPEQGPSEIVKRTKAG

SEQ ID NO: 2575 - protein, 381 aa, Pseudomonas corrugata
MPNLSPLLYSSNDHTTFLTELNLVETEKQEINSARADVRDELRKKLPAAMKARGYNGEERKPKFFIQGSWAYKTLNRPCQTPPQQSDVDDGVYLPMSIITEENRPIMAIQDFRAAVWDVLKPMCDEKGWTLSSKATCMRVEVSVTAHIDLPLYAIPDDQYALIVEGMEARNYGVLKGFAINSEQDSWKKLPSDKILLACEDKWIVSDPLKMKEWFELEISDKEEQLRRVIRYIKAFRDQQWEKGGPSSILLMAAACPLFEFHYKRDDLALLAVVSGLPKALREGVKSPVDSKVYLTDALGENGIEEAAEKFETFKKHLVASIEDSAQKEMACLWMRTMLGERFPNRPDLIGDPVSKPMPAAMAAIPPEQGPSEIVKRTKAG

SEQ ID NO: 2576 - protein, 381 aa, Pseudomonas fluorescens
MPNLSSLLYSTNEHVTFLKALDLDVGEKNDINSARAYVRDALRKKLPAALRARGYEGKECNPKFFIQGSWAYKTLNRPCQTPPQQSDVDDGVYLPMSIVKEENRPSMAIKDFRAAVSDVLEPLCEEKGWALFSKATCMRVEISTFAHIDLPLYAIPDEQYAMILEGMEARNFTVLKAFAANSEQDSWKKLPSDKILLACEDGWITSDPLKMKEWFELEISDKEEQLRRVIRYIKAFRDNQWDKGGPSSILLMAAACPLFEFKYKRDDLALLHVVAGLPSALRMGVKSPIDSKVYLTDALGEKGVEEAAEKFDTLMVSLKAATAESANKDMACLWMRSMLGDRFPDRPDLISDLPAQAMPAVMAAIPPERGPSEIVKRTKAG

SEQ ID NO: 2577 - protein, 391 aa, Pseudomonas bauzanensis
MLNLSPLLYTTRDLPDDPGRSLDHPTFLKALDLTSEEKQSIDVARKRIRDALREGLPAALREKGYTGRMCEPKFYIQGSWAYKTLNRPCHTPPQQSDVDDGVYLPLSIMKEEAKPHLAIDDFFAAVAETLQQLCNDNGWSLERKANCMRVVISLYAHIDLPLYAIPDDQYLLLKAAMEARNVTAMDSIDSTASTQTWKRLPSDQILLACDRGWIKSDPLTMKEWFEQEVQDKGKQLRRVIRYIKGFRDQQWDEQGPSSILLMAAACPLFEFEYKRDDEALLAVVKSIPQALRDGVLNPIDQGVYLTAALSSREVEVAAEKFEMFAKYLEAAMSLSATAKEQACHWMRDMLGDRFPNRPDLIDEKPAGLPAAMAAVDPEPGELEILQRSKSG

SEQ ID NO: 2578 - protein, 391 aa, Pseudomonas bauzanensis; identical to SEQ ID NO: 2577

SEQ ID NO: 2579 - protein, 391 aa, Pseudomonas nitroreducens
MLNLSPLLYTTKDRPDQDGRSVDHPTFLKALDLTAEEKQSIDTARKEIRDALRADLPTALREKGYTGGMCEPKFYIQGSWAYKTLNRPCQTPPQQSDVDDGVYLPLSIMKEEAKPHLAIDDFFEAVTEVLQPLCTDNGWKLERKANCMRIVISQYAHIDLPLYAIPDEQYLLLKAAMEDRNARALDSINATAATQTWKKLPSDQILLACDRGWIKSDPLSMKEWFEQEVQDKGQQLRRIIRYIKGFRDQQWDEKGPSSILLMAAASPLFEFEYKRDDEALLTVVKGIPAALRGGVLSPIDQDVYLTAALSKEEVEVAAEKFETFAKYLEAAMSASTAAKEQACHWMREMLGGRFPNRPDLVEETSAGLPAALAAVEPEPGELEILKRSKSG

SEQ ID NO: 2580 - protein, 392 aa, Pseudomonas umsongensis
MLNLSPLLYTTKDRFDEFGTVVDHPTFLKSMDLTTDEKQKIDAARKDIRQSLRDGLSQALREKGYDGETCDPKFYIQGSWAYKTLNRPCQTPPQQSDVDDGVYLPLSIMKEEEKPHLAIGDFFDAVYEVLKPLCDANGWTLERKPNCMRVVIATYAHIDLPLYAIPDVQYKLLKAGMEERGIPTMDGIIANAATQSWKKLPSDKILLACDRGWIKSDPLQMKEWFELEVQDKGEQLRRVIRYIKGFRDQQWDERGPSSILLMAAACPLFEFESKRDDEALLNVVRGIPKALRDGVLSPIDPKVYLTAALTEDEIDSAAEKFETLARYLDAAINASDEAKSSACLWMREMLGDRFPNRPDLIDVMSKAALPAAMAAIEPQPGEMEILDRSKSG

SEQ ID NO: 2581 - protein, 391 aa, Pseudomonas brassicacearum
MPNLSPLLYTTKDLPNGDGAVADHPTYLKSLDLTTDEKQKIDAARKDIRQALRDGLPQALRDQGYEGDTCEPKFYIQGSWAYKTLNRPCQTPPQQSDVDDGVYLPLSIMKEEEKPHLAIDDFFDAVHEVLKPLCNDNGWSLERKPNCMRVVISTYAHIDLPLYAIPDVQYMLLKAGMEARGIPVMDGINAAATQSWKKLPSDKILLACDRGWIKSDPLAMKEWFELEVQDKGEQLRRVIRYIKGFRDQHWDEKGPSSILLMAAACPLFEFENKRDDEALLNVVKGIPKALRDGVLSPIDSEVYLTAGLSQDELQDTVKKFEMFESYLGAAINASSEAKVSACGWMRDMLGDRFPNRPDLIVDKPVAALPAAMAAVEPEPGELEILERSKSG

SEQ ID NO: 2582 - protein, 392 aa, Pseudomonas jessenii
MPNLSPLLYTTKDRPDGDGTVADHPTFLKSLDLTTDEKQKIDAARKDIRQALRDGLPQALRDQGYEGETCEPKFYIQGSWAYKTLNRPCQTPPQQSDVDDGVYLPLSIMKEEEKPHLAIDDFFDAVREVLKPLCDVNGWSLERKPNCMRVVISTYAHIDLPLYAIPDVQYMLLKAGMEARGVPVMDGINATAATQSWKKLPSDKILLACDRGWIKSDPLAMKEWFELEVQDKGEQLRRVIRYIKGFRDQHWDDKGPSSILLMAAACPLFELESKRDDQALLNVVRGIPKALRDGVLSPIDSKVYLTAAMSEDELQAAAEKFETFEKYLDAAINASSEAKVSACRWMREMLGDRFPNRPDLIDDKPVAALPAAMAAVDPEPGELEMLKRSKSG

SEQ ID NO: 2583 - protein, 391 aa, Unknown
  Description of Unknown: Pseudomonas syringae group sequence
MLNLSPLLYTTKDRNDDTAAIDHPTFLKSMDLTPAEKQSIDLARKDIRQALREGLPQALREIGYEGGTCVPKFFIQGSWAYKTLNRPCQTPPQQSDVDDGVYLPLSIMKEETKPHLAIDDFFQAVHTVLEALCGEEEGWTLERKPNCMRVVISDYAHIDLPLYAIPDDQYLLLKSGMESFDVLTMDGAATASTQTWKKLPADKILLACERGWIKSDPLEMKEWFEREVQDKGEQLRRVIRYIKGFRDQQWEERGPSSILLMATACPLFEFENKRDDHALLTVVKGIPKAFRDGVLSPIDASVFLTDALSPADLEAAAEKFDTFGRYLEASMSASSEAKVSVCGWMRQMLGDRFPNRPDLIDDKSFNMLPAAIAAVDPERGEMEILKRSKSG

SEQ ID NO: 2584 - protein, 393 aa, Pseudomonas aeruginosa
MLNLSPLFYSTKDRTGEDHPTFLKSLDLSDDEKQEINSARIAIRSALREQLPGVLRAKGYEGGMCEPKFFIQGSWAYKTLNRPCHTPPQQSDVDDGVYLPLSIIQEENKPHLAIEDFFDGVQEVLEPLCRANGWKVGPKPNCMRVEISYLAHIDLPLYAIPDDQYLLLKSVMEARAALTMDGIAANSEVQSWKKLPSDKILLACQSGWKVSDPLAMKEWFDNEVEDADGDGEKQLRRVIRYIKAFRDNQWNGRGPGNAPSSILLMAAACPLFEFKYKRDDEALLTVLRGIPKALRDGVRSPIDPEVYLTDALSYEDREDAANRFELFAGFLDAAIAASDKVAACNWIRSKLGYRFPNRPDLIDDKPANALPAAMAAFAPEPGAKEIVKKTKAG

SEQ ID NO: 2585 - protein, 393 aa, Pseudomonas putida
MLNFSPLFYSTKDCIGEDHPTFLKALDLTADEKQEINSARIAIRNALREQLPGVLRAKGYEGGMCEPKFFIQGSWAYKTLNRPCHTPPQQSDVDDGVYLPLSIIQEENKPHLAIEDFFDGVQEVLEPLCQANGWKVGPKPNCMRVEISVLAHIDLPLYAIPDDQYLLLKSAMEARAALTMDGIATNSEVQSWKKLPSDKILLACQSGWKVSDPLAMKEWFDREVEDADGDGEKQLRRVVRYIKAFRDNQWNGHGSGNAPSSILLMAAACPLFEFKYKRDDEALLAVVKGIPKALRDGVRSPIDSTIFLTDALSDEDREDAARRFENFAGFLDAAISANDRTAACNWIRSKLGDRFPNRPDLITDKLANPLPAAMAAFEPEPGAKEIVKKTKAG

SEQ ID NO: 2586 - protein, 380 aa, Aeromonas caviae
MPNFSSLLYTTTQERCFLNELDLTTSEYESIDSARKLIRDTLKAQLPSVLKEKGFQGNMREPRFFIQGSRAYKTLNRPCITPPQQSDIDDGVYLPMTTIQEEERPSLAIETFFEAVVEVLEPLADKQGWKISQKDTCVRAVISDAAHIDLPLYAIPDAQFVLLKAMMESRGCESLKDVAMDASNDNWSALPSDKILLAHKTEGWIESDPRAMKSWFVQQVSDKGEQLRRVVRYIKAFRDFQWPTRGPSSILLMAASCPLFKQFDRRDDIALLEVVKGIPKALQEGVLNPVDSTKYLTGALSREEIQDAVERFTIFAEQLEEAINSMESIHACKCMTATLGKRFPNEPDRMKVSNEELPAAIASYLPERGPSEKIQRTKAG

SEQ ID NO: 2587 - protein, 380 aa, Aeromonas caviae
MPNFSSLLYTTTQERCFLNELDLTTSEYESIDSARKLIRDTLKAQLPSVLKEKGFQGSMREPRFFIQGSRAYKTLNRPCITPPQQSDIDDGVYLPMTTIQEEERPSLAIETFFEAVVEVLEPLADKQGWKISQKDTCVRAVISDAAHIDLPLYAIPDDQFVLLKAMMESRGCESLKDVAMDASNDNWSALPSDKILLAHKAEGWIESDPRAMKSWFVQQVSDKGEQLRRVVRYIKAFRDFQWPTRGPSSILLMAASCPLFKQFDRRDDIALLEVVKGIPKALQEGVLNPVDSTKYLTGALSREEIQDAVERFTIFAEQLEEAINSMESIHACKCMTATLGKRFPNEPDRMKVSNEELPAAIASYLPERGPSEKIQRTKAG

SEQ ID NO: 2588 - protein, 378 aa, Pseudomonas sp.
MLDLSALFYTTKEQTCFLNELDLTPGEKDGISKAKNDVREALRTGIPRVMRENGYEGKTVIPRFFIQGSWAYKTLNRPCHTPPQQSDVDDGVYLPMSLVQEEERPSIASSFFFEAAEGALKSLVEKNGWTLVTTKPTCIRIEISELAHIDVPLYAIPDKQFLLITEKFEARRLLGNVAVMDSAPDHWDSLPSDKVLLAHREENWMKSDPRAMKDWFVGQVEKMGEQLRRIVRYLKAFRDSQWPKGGPSSILLMAAAVPLFEANLRRDDLALLQVLKGLPAALRSGVVNPTDSNSYLTDALTPEALEDAAQKFEKFDAYLDGAIHANDATQACTWLGQMLGDRFPNRPDLVGTISIAAAVASVPAEAGPVEPVKRTKAG

SEQ ID NO: 2589 - protein, 382 aa, Leeuwenhoekiella sp.
MLNLSSLFHTTVDDYPNFLAELDLLPHQKEYISHCKNEIRSTLRAGLKEKLSLILRSQGIDDLDIEPRFFIQGSWAYKTLNRPHSSPPQQSDLDDGVYLPMSIVKESEKPSVASELFFEAAELVLAPIVDERRWNMVQKPTCIRVEISGYAHIDIPLYAIPDEDFAQLRATMDAKGYLSINEAITASDDSWTTLPSDHVLLAHRDENWIKSDPRAMKDWFLRAVGDHGEQLRRVVRYLKAFRDKSWKSDGPSSILLMAAAVSVFEQRRRRDDKALADVVAQIPNVLREGVLSPIDSEIYLTDSLGPDGVEDAASKFEDFSHYLNAALSCKDKQVACNWVRQMLGDRFPNRPDLVIAVSVSEVVKATPAEPGPNELVKNTKAG

SEQ ID NO: 2590 - protein, 382 aa, Pseudomonas aeruginosa
MLNLSALFYTTLDNPSFLAELDLLAHEKEYINQAKNEIRTTLRASLKECLSKVLYDHGLSDLKIEPKFYIQGSWAYKTLNRPHTTPPQQSDLDDGVYLPMSIMKEHQKPSVASALFFEATEAALAPLVKDKKIWRMSPKPTCIRIEISDFAHIDIPLYAIPDEDFVLLKESMEARGYAALTYAMDSAKDRWTALPTDHVLLAHREEDWIKSDPRAMKEWFVQAVEDHGPQLRRVVRYLKAFRDKTWSKGGPSSILLMAAAVSVFEQRRARDDQALRDVVRQIPAALRGGVRSPIDPEIYLTDSLTPDELEDAAVQFEAFFNYLDGAINASDKQTACNWMRHVLGTRFPNRADLVIAVSVSEIVQATPAEPGPHELVKTTKAG

SEQ ID NO: 2591 - protein, 381 aa, Pseudomonas pseudoalcaligenes
MLNLSALFYTKLDQPNFLAELDLTEGEKTYISDAKNEIRAALRERLKASIADVLAQNGLEAVSVEPKFYIQGSWAYRTLNRPCTTPPQQSDLDDGVYLPMSIMKEHRRPSVASALFFEATEAALKPLAADKKWTLSAKPTCIRLEISPFAHIDIPLYAIPDDEFMLLKAANESFEGRVFNAATDSAKDHWAALPSDHVLLAHREENWIKSDPRAMKDWFVQEIADRGEQLRRVVRYLKAFRDKVWTKGGPSSILLMAATAPIFEKRDKRDDLALKDVLEKLPNVLREGVLSPIDSEVYLTASLAAEEIEEIARQFEAFHNHLSGAIFGTDKQQACTWVRSMLGDRFPNRADLVLVSTVAAAVQAVPAEAGPRELVKTTKAG

SEQ ID NO: 2592 - protein, 380 aa, Thalassospira xiamenensis
MLNLSSLLYSTANDNLLKQLDLEANEKDFISKCKNKVRACIRDELTATLKETFSVEQTVSPKFFTQGSWAYKTLNSPCHTPPQQCDIDDGVYFPLSIMQEEKKPSIASTTLFAAIEGILEKLAKKEGWTLDSGKDTCVRLILTERAHLDIPLYAIPDGAFTQMATEAIDRGYGNFADALSKRDQESWTQLPSDEVLLAHRKEGWITSDPRPIKQWFLDEVDAKGEQLRRVVRYLKSIRDMHWKSGGPSSILLMAASAPLFKRHDKRDDLALLNVLQQLPEHLRNGVNNPAKGQTNESLTDRLSQEELNTVVSLFEKVSSDLNTAIYDSAPHAACEILIGIFGARLPNLPNEATQSAAKDVLAATPVISGPDEPITRTKAG

SEQ ID NO: 2593 - protein, 247 aa, Pseudomonas aeruginosa
MPVFNLHSLLDSTVYADTFLAGLTLASDEREHMQSARTEIRDRLRTRLPALLQRALGSDQQVRKPRFFTQGSWAYKTLNAPCKDPQQADLDDGTYLPFSYLEATPPSVMSNVLFTCVEEVLQDLADEKGWKLIDDNPNCTRLEIASDKHIDVPAYSIPDEEFEELRESRALAICNAFDSVLAKAQLEEDDNWDLMPTHGVLMATKDRGWRDNDPRPIKDWVESEVALKTEQLRRLMRYIKGWRDYQV

SEQ ID NO: 2594 - protein, 390 aa, Unknown
  Description of Unknown: Pseudomonas sequence
MPVFNLHSLLDSTVYADTFLAGLTLASDEREHMQSARTEIRDRLRTRLPALLQRALGSDQQVRKPRFFTQGSWAYKTLNAPCKDPQQADLDDGTYLPFSYLEATPPSVMSNVLFTCVEEVLQDLADEKGWKLIDDNPNCTRLEIASDKHIDVPAYSIPDEEFEELRESRALAICNAFDSVLAKAQLEEDDNWDLMPTHGVLMATKDRGWRDNDPRPIKDWVESEVALKTEQLRRLMRYIKGWRDYQVWESEDPKSILLMVAVAKALDVAVPRRDDLALLKVVKALPKILQGKVFNPATAMKPVEEQEDLAARLDKDGIRADVVARLTRLGQQLDEAIYRSSSPEQACRLLRDAFGNRVPYDPGRVVIDTVQSTPADKSKAVSPVGIMTAG

SEQ ID NO: 2595 - protein, 391 aa, Pseudomonas fluorescens
MPKFNLHSLLRSTIHEDTYLARLTLEDEDRTEMQSARTQIRSRLRDRLPRVLQKELKSDEKVRSPRFFTQGSWAYKTLNAPCRSPQQADLDDGAYLPFSYLEQEPPSVVSAALFNSVEKVLRELADETEGWTLFDDNPNCTRLEIAPDKHIDVPVYSIPDFEFEKLREARCAMLDSLGMEALALDQSPEDDNWDLMPTHGVLMATKDRGWRDNDPRPVKEWVDNEVSLKSEQLRYTMRYLKGWRDHQTWENGDPKSILLMVAAAKAFDTQVHARDDLALLDVVKKLPAILAGKLINPTTATKPDGEQEDLAKRLDDDGIRGDVIERFKTLAKKIEDALENSATPQEACNLLISEFGSRIPNDPKRVVVETVKSSAAQKTPAILPIGNRTSG

SEQ ID NO: 2596 - protein, 390 aa, Pseudomonas sp.
MPTFNLHSLFRSTVYDDTYLTELTLEEDERTQMQSARTRIRDRLRTRLPGVLQNELRTDERVRAPRFFTQGSWAYKTLNSPCRAPQQADLDDGTYLPFSYLEQEPPSVVSTALFNSVEKVLRELADETDGWTLYDDNPNCTRIEIASDKHIDVPVYSIPDGEFEKLREAREYILKARFEGYAADQAPEDDNWDLMPTHGVLMATKNRGWRDNDPRPVKDWVNGEIALKSEQLRHIMRYLKGWRDHQTWTKGDPKSILLMVAAAKAYDTQIYARDDLALLGVVSRLPDILSGKLINPTTLDKPDEEQEDLAERLDEDGIREEVIQRFKKLALTMQKAIQGSTTPQESCDLLISEFGTRFPNDATRVVVETVKSDSPDRTPAILPVGNRTSA

SEQ ID NO: 2597 - protein, 399 aa, Pseudomonas alcaliphila
MPSLNLHSLFDTRVEGRVAFLDNLTLAPDDRKLMLSARTDIRARLKARLPKRIQKKAEDAGQGHIEVPEPRFFTQGSWSYKTLNAPCRPPQQADLDDGVYLPFSYIESQPPAQMSALLFEAVEEVLSELADDKGWAIDPSNDNCTRLIINDDKHIDVPVYSIPDHEFETLVKASMEMYRIAVANAAFDSVDYAERADEQEWHMMPTEGVLMATKNRGWQDSDPRPIRDWVVEQVELKGEQLRRVMRYLKAWRDFQKWDKDDPKSILLMVAADAAFDMATEKRDDLALLKVLRRLPDILRGKVINPASRDKPLSEQEDLAKRMDNKGIRDDVIARIEYFAAQLEYAIDTCGVPAKACEILIEHLGDRLPNDPDRVTQSTVQSQPAQKTTAVPPLGKATAG

SEQ ID NO: 2598 - protein, 399 aa, Pseudomonas thivervalensis
MPSLNLHSLLDTRVEGRVAFLDNLTLAPEERKLMLSARTDIRQRLKARLPKRIQKKAEDAGQGHIEVPDPRFFTQGSWAYKTLNAPCRSPQQADLDDGAYLPFSYIESQPPAQMSALLFEAVEEVLSELADDKGWTIDTSNDNCTRLIIDSDKHIDVPVYSISDIEFATLVKASMEMYRFGLEQLTFDSAESQERADEQEWHLMPTEGVLMATKNRGWQDSDPRPVRDWVTEQVELKGEQLRRVMRYLKAWRDFQKWEKDDPKSILLMVAADAAFDMAIEKRDDLALLKVLQRLPDILRGKVINPATRDKPLYEQEDLAKRLDNKGIREDVIARIEHFADQLEYAIDTCGVPSKACEILIELLGKRIPNDPDRVTQSTVQSQPAQKIAAVPPLGKATAG

SEQ ID NO: 2599 - protein, 388 aa, Pseudomonas tolaasii
MQILNLHSLFSSTVHSDVFINNLSLPGDESQMMLDARTDIRARLRDELPKRLREVLEDAGAAPRPRFFTQGSWAYKTLNAPCKEPQQADLDDGTYLPFSYIESAPPSEMSSILFNAVEDILGELGVEKGWTLVTENPNCTRLEIDSDKHIDVPVYSIPDTEFALLTKAAVVLESRGMAMDAAAAIDDNWDLMPTHGVLMATKTNGWRDSDPRPVKDWVNNEVGIKGEQLRRVMRYIKAWRDHQTWDPDKDPKSILLMVATAEAFDISVHGHDDVALAKVCERLPEILRGKVINPVTLDRPTDKQEDLAARLDRDGIRDLLISRMEHLSKCINHAIYECGDPEKACVILRSEFGIRLPNDPNRVVVESVKAVAPLATAAAKPVGDITAG

SEQ ID NO: 2600 - protein, 386 aa, Pseudomonas tolaasii
MLNLHSLFSSTVHSDVFINNLSLPGDESQMMLDARTDIRARLRDELPKRLREVLEDAGAAPRPRFFTQGSWAYKTLNAPCKEPQQADLDDGTYLPFSYIESAPPSEMSSILFNAVEDILGELGVEKGWTLVTENPNCTRLEIDSDKHIDVPVYSIPDTEFALLTKAAVVLESRGMAMDAAAAIDDNWDLMPTHGVLMATKTNGWRDSDPRPVKDWVNNEVGIKGEQLRRVMRYIKAWRDHQTWDPDKDPKSILLMVATAEAFDISVHGHDDVALAKVCERLPEILRGKVINPVTLDRPTDKQEDLAARLDRDGIRDLLISRMEHLSKCINHAIYECGDPEKACVILRSEFGIRLPNDPNRVVVESVKAVAPLATAAAKPVGDITAG

SEQ ID NO: 2601 - protein, 391 aa, Gammaproteobacteria bacterium
MSTNNLHRLFQPASTDKTLLNALTLTADEDAILRKARTQVRETLRRDLPRLIKQALPGIQTIETPRFITQGSFAYKTINRHCHPKQQIDMDDGCYLPLSFAKEFEVGHASNLFFQAVELVLTPLAKANGWKLVPKDTCTRLEIDSTKHIDIPLYAIPDADFKKMLMDASVLEYAALKGQVHDHARAVQWSDLPRNKVLLAIRGGDWRPSDPRPVIRWVENQVATKTEQWRRLIRYLKAWRDYQWPSGGPTSICLMAAMDQVFLRPNAGRDDLALLDIVRRLPQVFAGDIYNPAEPTARPEDRELLSRRLDEEPGLRRVVQEKLREFERDLNMAINGNVSPMDACNLVSRHLGPRIPVRPDWVLVESVAQQVRSTAPRVSVVAPLIGTTKSG

SEQ ID NO: 2602 - protein, 374 aa, Methylobacterium aquaticum
MANVSKLLHTTTDPETFLANLTPEDDDLKAAKRKIRGHLRLSFAVASREEFDVEVQPRFFTQGSSSYRTLNDPAWPPGQQKDLDDGCYLPLSFVKGERPSKAAEQFFAFVDRVLGELAEDEGWALIQKPTCVRLVIADDAHVDIPLYAIPDQDFALLEARATQDHAMVQKRAPDRWDALPSDKVLLAHRVEGWKSSDPRKIHTWFLKAVDDFGERLRRDCRYLKAWRDHHHLDDDHLSSILLMACAWNAYKAIGKPFLPDREDQRLLRVVELLPAMLCKDMANPASQDENLNRMSPEERSRTVRAAESLRDRLKEAIEACDAKRRAVDLMRVAFGTRLPDRPDQVSVPVQAEATVAAQPKRYVPAPVVGRSQSG

SEQ ID NO: 2603 - protein, 373 aa, Methylobacterium phyllostachyos
MANVSKLLHTTTDPETFLVNLDAEDSDLKAAKQKVRAHLREAFGKASRDLFGQEVRPRFFTQGSSSYRTLNDPAWPPSQQKDLDDGCYLPLSFVKGEQPSRAAEQFFEFVDAVLDELAKAEGWTLIKKPTCVRLEIAPDAHIDIPLYAIPDHEFVLLEARAQKMEKAYDHAPKRWEDLPSNAVLLAHRDDDWVESDPRKIHKWFVDAVDIYGERLRRDCRYLKAWRDHHHLDDDKLSSIILMACVWTAYETIRGPFLPEREDERLLRVVERLPGMLTKGMPNPASKDEDLNRMSPAQRSRVAAEAGRLRDRLKEAVESCDEKRRAIDLMHVAFGKRVPDRPDLVSIPVRAEATITSQPKKTVPAPVVGRSQSG

SEQ ID NO: 2604 - protein, 373 aa, Methylobacterium sp.
MANVSKLLHTTTDPETFLINLKAEDGDLKEAKQKIRMCLRLAFREASRERFDADVQPRFFTQGSSSYRTLNDPAWPPSQQKDLDDGCYLPLSFVKGERPSKAAKQFFEFVDTVLGGLAEAEGWTLIKKPTCVRLEIALDAHVDIPLYAIPDHDFALLEARAQRMDKAYDHAPKRWEDLPSNAVLLAHRDDDWVESDPRKIHKWFVDAVDIYGERLRRDCRYLKAWRDHHHLDDDKLSSIMLMACVWTAYEAIRGPFLPDREDERLLRVVERLPGMLTKGMPNPASKDEDLNRMSPEQRSRVAAEAGELRDRLKEVVEACDEKRRAIDLMQAAFGRRVPDRPDLVSIPVRAEATITSQPKKTVPAPVVGRSQSG

SEQ ID NO: 2605 - protein, 377 aa, Rhizobium etli
MANVSKLLYSSVADVSFLLEIEPEDDAKADLREAKGKIRNRLREAFAEKSMDMFGKSIRPRFFTQGSHSYKTLNEPAWPPEQQMDLDDGCYLPMSFVKGVRPSQASALFFEFVDGVLKQLAEEEGWEFKEKDTCCRLVISSIAHIDIPLYAIPDTEFVLLEKSMTASATFAEDRRRDTWDTLPSDSVLLAHRKEDWKVSDPRKIKTWFLAAVEIFGEKLRRICRYLKAWRDHHKPELDGVSSILLMVCAWRAFDEIRRPFIPDREDQALLAVLERLPAYLESAVPNPTDPDEDINRLSAEDRKTAAKCAREFAERLRTTIIAVTDPTRAVLDTQISLGLRVPNRPDLVSVAETAKVTVLSQPRKEVAAPVVGRSQSG

SEQ ID NO: 2606 - protein, 372 aa, Rhizobium anhuiense
MLYSTVVDECFLLEIDPEDEAKKALLQARTKIRQRLKEAFAERSRDLFGKAIAPRFFTQGSHSYKTLNDPAWPPEQQMDLDDGCYLPMSFVTGARPSQASVLFFDFVDGVLRQLAKEEGWGFKEKDTCCRLVISHNAHIDIPLYAIPDVEFVLLEKAMDSRHTSFSASARPDTWEALPSDSVLLAHRKEDWKVSDPRKIKTWFLGAVDIYGEKLRRVCRYLKAWRDHHKPALSEVSSILLMVCAWKAFEVTRRAFVPDREDEALLMVLDRLPAYLEGEVLNPTDPDEDINRVSSEGRKVAARYAKDFADQLRRTISSVADQNVAVTEMQASLGLRVPSRPDLVSVAETAKVTILSQPRKEVAAPVVGRSQSG

SEQ ID NO: 2607 - protein, 383 aa, Aminobacter aminovorans
MANVSKLLYSSTASAPHFLANIKAEDDDLRLARQLIRDHLRAAFDKGGVAAFGLAIRPRFFTQGSHAYKTLNDPAWTPPQQKDLDDGCYLPMSFVKGLGPVGRSKPSVAADAFFKFVDKALIELAAQHEGWRFVKKPTCARLIISKSAHVDVPLYAIPDAEFAQLQERVNKHVLASKDAKRPDRWDALPEDAVLLAHREEDWIVSDPRKIHTWFLEAVDTYGEALRRVCRYLKAWRDHHQPHLDGVSSILLMACAFMAFEEKTRQLLPNREDEILLLVVKKLPTLLNQDIPNPAVSSENLNRMAAEQRKLAVSKAEEFRTRLSRAVTTSTVAKDAVANMMSIFGERLPDRPDLVTIAETATVTVLSQPRKEVAAPVVGRSTSG

SEQ ID NO: 2608 - protein, 374 aa, Shinella sp.
MANVSKLLHNTVDEHLLSNLEADQVSLRNARTKIRGRLRDAFETSSVEYFGVRVRPRFFTQGSFAYKTLNHPAFPPGQQKDLDDGCYLPLSFVRGEKPSAAAAYFFAFVETALGELADEEGWTLVKDKPTCVRLVISRDGHVDVPLYAIPDGDFRHLVEARNMEKSATFDAKVDSWDALPSDAVLLAHREKDWVESDPRKIFDWFVDAVSLYQERLRHDCRFMKAWRDNHRLDEDGLTSINIMACVWKAYEVIRGPFLPTRADERLLRVVEKMQGFLANDVRIPPCGDENINRMTAEQRKKVVGKLKDLEATLRETVTKCDDKDRAVDLLRAGFGSRVPKRPDLVIIQASPAVTVLSEPKRTVPAPEVGRSVSG

SEQ ID NO: 2609 - protein, 374 aa, Shinella sp.; identical to SEQ ID NO: 2608

SEQ ID NO: 2610 - protein, 382 aa, Bradyrhizobium elkanii
MANVSKVLHAAGDAPCFLNNLNIADTDRASLMEAREKVRDCLRKTFAALTKQELGVTVHPRFFTQGSFAYRTINDPCWTPPQQMDLDDGAYLPMTFIQGSQRPSVAAAAFFKVVDAALVKLAKEEGWQFVKKPTCSRLVISSNSHIDVPLYAIPDAEFEKLEKQMKSFDAMARDARADSDDRWDALPSDCVLLAHREHDWISSDPRKIRDWFVDAIKVYGPVLRRACRYLKAWRDHHRPHLDDVSSILLMVCAFEACEDLGRPNVPGRDDLALLRIAERLPRLLEGPVYNPTDRDERVDGRLSAASRRIAIDMAKKLDAELTEIVEKCFDPEEAIERLTALFGERIPDRIDLVDVAKAAHAEVRSHAPRIAAAPTVGKSTSA

SEQ ID NO: 2611 - protein, 382 aa, Bradyrhizobium sp.
MANVSGLLYRGGETPSFLDNLQITEACHSELRAARTKVRQCLRAEFTKASKADVGFTVRPRFFTQGSFAYRTINDPAWTPPQQMDLDDGTYLPMTFVQGAKPSVAAAAFFTIVDRALQALAKVEGWIFVKKPTCARLIISEYAHIDVPLYAIPDKEFRLLEKAAQARTFDGAFDARADSIDRWDALPSDCVLLAHREEDWVASDPRQINDWFVGAVDVYGERLRRICRYLKAWRDHHRPHLDRVSSILLMVCAWKVFDDFGRPNVPARDDAALLLVARRLPILLAGPVENPTDPEEKVDARLPDADRRVAIAMAEGLAKELGEIVEKCFDPQEAVTRLQALFGDRIPDRPDLIDVTKAAYAEVRSHDRRISAAPVVGKSTSA

SEQ ID NO: 2612 - protein, 381 aa, Bradyrhizobium yuanmingense
MLHGAQGGVDLLAKLELLADEQDKLQNAKRKIRDHLRAMIASETKRQLGRQITPRFFTQGSEAYKLLNRRAWMPPQQIDVDDGLYLPMTFVKGNGPAEAAKLYFDIIEAALKVLIKREKWKGFEEKDTCARVIIDDCLHVDVPLYAIPDDQFGRLTKAAMDRAIADSEDNIDFMGSRKMRIDRWDQVDSDKVLLAHRKDNWKPSDPRKIHDWFLNAVDFYGELLRRECRYLKAWRDYHKLEHISSIILMACAFYAFEDVGHLSVPRRDDLALLQVTSRLADMFAGEILNPADTAEVLGSSWTREQRQQAIKAANAMHEQLDDAINHCYLPEVAVDHLKAIFGERIPNRPDLVKAHAAAAAAVVAAPAIILPAPSVGRSTSG

SEQ ID NO: 2613 - protein, 387 aa, Bradyrhizobium yuanmingense
MANVDKLLHGAQGGVDLLAKLELLADEQDKLQNAKRKIRDHLRAMIASETKRQLGRQITPRFFTQGSEAYKLLNRRAWMPPQQIDVDDGLYLPMTFVKGNGPAEAAKLYFDIIEAALKVLIKREKWKGFEEKDTCARVIIDDCLHVDVPLYAIPDDQFGRLTKAAMDRAIADSEDNIDFMGSRKMRIDRWDQVDSDKVLLAHRKDNWKPSDPRKIHDWFLNAVDFYGELLRRECRYLKAWRDYHKLEHISSIILMACAFYAFEDVGHLSVPRRDDLALLQVTSRLADMFAGEILNPADTAEVLGSSWTREQRQQAIKAANAMHEQLDDAINHCYLPEVAVDHLKAIFGERIPNRPDLVKAHAAAAAAVVAAPAIILPAPSVGRSTSG

SEQ ID NO: 2614 - protein, 381 aa, Bradyrhizobium sp.
MLHGAQGGVDLLAKLELLADEQDKLQNAKRKIRDHLRAVIGSETKRQLGRQITPRFFTQGSEAYKLLNRRAWMPPQQVDVDDGLYLPMTFVKGNGPAEAAKLYFDIIDAALKVLIKREKWKGFEEKDTCARVIIDDCLHVDVPLYAIPDDQFARLTKAAMDRAIADSEDNIDFMGSRKMRIDRWDQVDSDKVLLAHRKDNWKPSDPRKIHDWFLNAVDFYGELLRRECRYLKAWRDYHKLEHISSIILMACAFYAFEDVGHLSVPRRDDLALLEVTSRLADMFAGEILNPADTAEVLGSSWTREQRQLAIKAANAMHEQLDDAINHCYLPEVAVDHLKAIFGERIPNRPDLVKAHAAAAAAVVAAPAIISPAPSVGRSTSG

SEQ ID NO: 2615 - protein, 411 aa, Bradyrhizobium sp.
MQAVPDARIAEPSVASDCNQEGTTVANVDKLLHGAQGGVDLLAKLELLADEQDKLQNAKRKIRDHLRAVIGSETKRQLGRQITPRFFTQGSEAYKLLNRRAWMPPQQVDVDDGLYLPMTFVKGNGPAEAAKLYFDIIDAALKVLIKREKWKGFEEKDTCARVIIDDCLHVDVPLYAIPDDQFARLTKAAMDRAIADSEDNIDFMGSRKMRIDRWDQVDSDKVLLAHRKDNWKPSDPRKIHDWFLNAVDFYGELLRRECRYLKAWRDYHKLEHISSIILMACAFYAFEDVGHLSVPRRDDLALLEVTSRLADMFAGEILNPADTAEVLGSSWTREQRQLAIKAANAMHEQLDDAINHCYLPEVAVDHLKAIFGERIPNRPDLVKAHAAAAAAVVAAPAIISPAPSVGRSTSG

SEQ ID NO: 2616 - protein, 395 aa, Azospirillum sp.
MADFSRLLYRSSVGLDPFFLDILNPLEREDVTLRSARRDIRQHLREEFKLADLKTFGGRRLQPRFFTQGSAAYKTLNRPPFVPPQQMDMDDGCYLPMSFVKQAKPKLAAETFFNFVDTALGELAKRRNWKLVQKDTCVRLEISEWAHIDVPLYAIPDDQYETLAKAAMESQLITASGQINFSEAMARQPIDRWDRLPSDVVLLAHRQDNWVASDPRKIHDWFIGAVEEHGDELRRACRYLKAWRDFNHAKIGAVSSILLMACAAAVFDKNARVMPKRDDEVLLKIATELPTLLSGAVANPADPDSGEDLTAKLDDAARKAAVVAAYDLHRVLSDVINKCHIQQSVVNHVQSLFGNRVPNRPDLVKVSAPQQAKAEVLSYEPRKVAAPVVGVSTSG

SEQ ID NO: 2617 - protein, 396 aa, Azospirillum brasilense
MANVSRLLNYTTEDVAYLSRLDLLREERALLVSARRDVRSHLKRVFAEADPARYGGPRVEPRFFTQGSYAYKTINRPAFAPLQQMDMDDGCYLPMSFIRRGRPSQVSEAFFTFVDNALQDLARVKGWHFEEKPTCCRLIISDSAHVDVPLYAIPDAEFMTLQKAARAAGLETATGSVMLHEAARQPSRDRWDLLPRDEVLLAVRGEDWKESDPRAVHDWFTRLVEERHGELLRRVCRYLKGWRDYNHEKIGAVTSILLMACAARAFEDALGDGAPVPSRDDQALAAVARRLPELLSGPVVNPAAPDQGEDLTERLDVMDIRGVAVTTARVLSAELDSAIDRCYDRQLAVDTVRRQFGPRVPNRPDLVGAVSEATAQVLSRPAVKTAAPAVGRSISG

SEQ ID NO: 2618 - protein, 376 aa, Rhodospirillaceae bacterium
MLNATPLLKQFLKDIDLTPAQKMKLENAKQTVRSTLRKAFKDAGREIHDQSGKTVAQKPKFWPQGSIAYKTANQPAYPPKQQIDIDDGTYLPMSFMDEMTPSVASSLFFAFVDRVLENLAVSKDWAFDGSKKTCVRLILDQESHIDVPLYAIPDDEFNLLEAKMNVASEGQIAAFSVNDNMYIEPDRVQLAHRDEGWKASDPRKIHKWFLTKVQHHGNDNQLRRICRLIKAWRDNHDDLDGLTSILLMVAVTEIYDGHDEMPKRDDLALLIVADELPHILSRDIYNPAEPDESLSARVPTAVLRKATDRMWNLRQDINGTLNSYSQDAALSRIRDHFGTRVPERPDLILIDSARVEVEKHPAATMAMAAIIPSKSG

SEQ ID NO: 2619 - protein, 393 aa, Methylobacterium populi
MTLANAHALFYGLKADPSFLASLTVPEGERKALMDARQEIREELKAAASYIITQDEYWQPGSVQRSAIRNRPPIQIKFMTQGSFSYKTLNVPARRRVQEIDLDDGMYVPIDYLENGEPALVAKGLYDFVEKTLASLCKRRGWKLDTTKECCVRVKLWEGAHIDLPIYSIPRDRFVQLRESMARTATASMTYDSVKGDWKLPSDKIMLAQRDGKWVQSDPQQLHDWVEGRVERYGAVYRRLSRFFKGWRDFTWERSKLSSLCLMCAVDLALRQLDGLPTENRDDELVLEVAKRLPDILNGKIMNPVLGHLCINEWDNEVRGEILEGAEKLRIQMIAALERTGDAEQVVLKLRARFGHRIPYRPDVVTISSTISAIEKAPAQTVAAPRVIPTTSG

SEQ ID NO: 2620 - protein, 393 aa, Methylobacterium populi; identical to SEQ ID NO: 2619

SEQ ID NO: 2621 - protein, 393 aa, Methylobacterium sp.
MTLANAHALFTGLKTDPSFLANLTISDRERKALLEARQEIRTTLKNAAARIPIDDTYWQADYTRKVAARQRPQIQIKFMTQGSFAYGTLNAPAQKPAQEIDLDDGMYVPVDFLESGEPSLAAKQLFKFAEEALKPLCEKQGWSLDDTKDCCVRVKLWPGAHVDLPIYSIPRDRFVQLRENMERTATAKMTFDSIKGSWKLPSDKIMLAHRNGVWKQSDPQQLHDWVDERVDRYGPIYRRLSRFFKGWRDHTWEKSALSSLCLMCAIDEALKRIDGFPTESRDDEITMEVAKLLPEILGGKVSNPVIKELCINEWDQKDREAIVDGAKALRDEMTAALERTGDAEQVVIKLQKRFGVRIPYRPDAVKIAPKIAAIQKAPAAVVAAPRVTASTSG

SEQ ID NO: 2622 - protein, 393 aa, Methylobacterium sp.; identical to SEQ ID NO: 2621

SEQ ID NO: 2623 - protein, 393 aa, Mesorhizobium sp.
MTLANAHALFYGLKAEPSYLANLDVSDDERAQLMEARSEIRATLKAAASQIQLTDNYWQDSYRQKVSWRQRPEIQVKFMTQGSFAYRTLNEPAQKPKQEIDLDDGMYVPVQFIANGEPALAAKGLFEFVDSVLIPLCDARGWVRDTTKACCARVKLWPGAHIDIPIYSIPQDRFNQLRESLAKAHIAVATRGSVKGGWKLPSDKIMLAQRDGSWVQSDPQMIHDWVDGRSERYGPPFRRLCRFFKGWRDYTWEKSVLSSICLMRAIDMALSELPGLPRGDRDDELILEIAKRLPGIFDGTIVNPVLWHLCINDWSDQDRNEIVRGAVALRGEMEAALERTGDAEQVVLKLRNRFGTRIPYRPDAIKMAPKISAIQKAAAAVVPAPRIIASTSG

SEQ ID NO: 2624 - protein, 393 aa, Mesorhizobium sp.
MTLANAHALFYGLKAEPSYLANLDVSDDERAQLMEARSEIRATLKAAASQIQLTDNYWQDSYRQKVNWRQRPEIQVKFMTQGSFAYRTLNEPAQKPKQEIDLDDGMYVPVQFIANGEPALAAKGLFEFVDSVLIPLCDARGWVRDTTKACCARVKLWPGAHIDIPIYSIPQDRFNQLRESLAKAHIAVATRGSVKGGWKLPSDKIMLAQRDGSWVQSDPQMIHDWVDGRSERYGPPFRRLCRFFKGWRDYTWEKSVLSSICLMRAIDMALSELPGLPRGDRDDELILEIAKRLPGIFDGTIVNPVLWHLCINDWSDQDRNEIVRGAVALRGEMEAALERTGDAEQVVLKLRNRFGTRIPYRPDAIKMAPKISAIQKAAAAVVPAPRIIASTSG

SEQ ID NO: 2625 - protein, 393 aa, Mesorhizobium sp.
MTLANAHALFYGLKAEPSYLANLDVSDDERAQLMEARSEIRATLKAAASQIQLTDSYWQDSYRQKVSWRQRPEIQVKFMTQGSFAYRTLNEPAQKPKQEIDLDDGMYVPVQFIANGEPALAAKGLFEFVDSVLIPLCDARGWVRDTTKACCARVKLWPGAHIDIPIYSIPQDRFNQLRESLAKAHIAVATRGSVKGGWKLPSDKIMLAQRDGSWVQSDPQMIHDWVDGRSERYGPPFRRLCRFFKGWRDYSWEKSVLSSICLMRAIDMALSELPGLPRGDRDDELILDIAKRLPGIFDGTIVNPVLWHLCINDWSDQDRDEIVRGAVALRGEMEAALERTGDAEQVVLKLRNRFGTRIPYRPDAIKMAPKISAIQKAAAAVVPAPRIIASTSG

SEQ ID NO: 2626 - protein, 395 aa, Labrenzia aggregata
MTLANAHALFCGLKSTPSYLANLTIDDEERKGLLDARRAIRATLKSAAKHLVIEDKYWQEGSRFKDSWRQRPDTIELKFMTQGSFAYGTLNAPAQAPWQEIDLDDGMYVPVDFLESGEPALAAKALFEFVETALKPLCDENDWGVTQKANCVRVKLWHGAHIDIPIYSIPRIKFGQLVEAATKMDFADGLFSQKRISQMNRLPSDQVMLARRDGTWVQSDPQQLHEWVQARKDRFGAVYLRLCRFYKGWRDFIWIDSPLSSLCIMRTVEMALNEFDGFPSDERDDELILKVAELVPGYFDGKISNPVLTNLHLNEWKKKERAVIVKAANDLKDEMTSALHRTGDAERVVQKLRDRFGDRIPYRPDAVKIGSRIEAVQQSSPDKVAAPSVIASTSG

SEQ ID NO: 2627 - protein, 393 aa, Ensifer sp.
MTLANAHALFCGLKSQPSYLANLNIDENDRAGLIEARRKIRIALRAAAQGIAAKDEYWHSGYAARTSWRNRPAVEVKFMTQGSFAYGTINAPAQIPQQEIDLDDGMYVPVEFLMNGEPALAARGLFLFVETALAPLAAENGWKLAEKPNCVRIKLWSGAHIDIPIYSIPRDRFSQIKEAFDSAHTSFSERRASLSNSWRLPSDKIVLAQRDGTWIQSDPQQLHDWVLSRTDRYGPVYKRLSRFFKGWRDYTWEKCVLSSLCIMCAVDLALQKLNGFPTEERDDALVLEIAKRLPDILRGEVKNPVLTDLCINDWSEEDRSEIVRAAENLKVELESALERTGDAERVVQKLRSKFGERLPYRPEAIKMVSSIAAIQVAVPAVAAAPKVIPSTSG

SEQ ID NO: 2628 - protein, 393 aa, Rhizobium sp.
MTLANAHALFCGLKAQPSYLANLAIDEDDRVGLMEARKQIRATLKAAASGLAVKDEYWQPGYAAHTNWRTRPVVEVKFMTQGSFAYGTINAPAQIPQQEIDLDDGMYVPVEFLMNGEPALAARGLFLFVETALASLVARNGWELAEKPNCVRIKLWPGAHIDIPMYSIPRDRFAVLKEALDSAHTSFSEVRASLSNSWRLPSDKIMLAQRDGTWIQSDPQQLHDWVNSRADRYGPVYKRLSRFFKGWRDYTWDKCVLSSLCIMCAVDVALQRLEGFPTEERDDVLVLEVAKRLPDILRNEVKNPVLTELCINEWSEQHRAEIVAAAQQLKEELESALERTGDAERVVQKLRSKFGERLPYRPEAIKMVSAIAAIQVAKPAVAAMPKIIPSTSG

SEQ ID NO: 2629 - protein, 391 aa, Unknown
  Description of Unknown: Rhizobium sequence
MTLANAHALFCGLRSQPSYLANLTIEEEQRLGLMAARREIRTALKAAAAGLTTHDEYWQDSSYSNWRKRPSIEIKFMTQGSFAYGTINAPAQSPHQEIDLDDGMYVPVDFLSNGKPALAAKGLFAFVEGALADLCQARNWRLAEKPNCVRVKLWPGAHIDIPIYSIPQDRFVAIKESLEKSHTAAFSARDSAMVSWRLPSDKIMLAQRDGTWLQSDPQQLHDWVNSRSERYGPVYKRLCRFFKGWRDYAWVKSPLSSLCIMCAIDKALQRLPALPSEDRDDALVLEVAKALPDLFKGEIENPVLDHLCINGWEDHDRKEIVAAASELRDEMQSALERTGDAELVVKKLRNKFGERIPYRPDSIKMASKIAAVVAAPASSVAAPSVIATTSG

SEQ ID NO: 2630 - protein, 393 aa, Sphingobium lactosutens
MTLANAHALFCGLKSEPSYLANLTIPEDDRRALMDARNLIRATLKQAASSIPVHDEYWQEDFARITARMRPVIHVKFMTQGSYAYGTLNAPAQIPAQEIDLDDGMYVPVQFLQNGQPALAAKGLFAFAEAALAPLCSRKGWQLDSSKKNCVRVKLWRGAHIDIPIYSIPQDRFETMVEALQNAETTALMARDAMAQSWRLPSDQIMLAQRDGTWLQSDPQQLHDWVNGRSERYGAVYRRLCRFFKGWRDYTWEKSSLSSLCIMCAVDEALRRMNGFPGDSRDDELVMEVAKLLPAIFNDKVANPVIRHLCLNEWGDDERAAIIEEAEALRDEMVAALERTGHADVVITRLRNQFGQRIPYRPDAVKIATKIETIRQAPAAKVAAPIVIPSTSG

SEQ ID NO: 2631 - protein, 395 aa, Thalassospira sp.
MTLANAHALFCGPSNTSSFLSSLNIDDIDRAKLLAARNKIRSILKASADTLLKDDTFWQESSKFRTYRHSRPTRVTLKFMTQGSFSYGTLNIPAQSPKQEIDLDDGMYVPVDFLENGEPALAAKGLFSFVTKSLSDACSQNGWTVKEKRSCVRVQLWQGAHIDIPIYSIPTEKFATLRAAMDSANFAEANISRAYLSNDMRIPSDKIMLAQSDGSWLRSDPQELEEWVKARKDRLGTCYTRLCRFFKAWRDFNWLSSPLSSLCIMRAVEIALEELPGFPSQNRDDELVMLVAEKLPLILGKTVQNPVLRDLSLNDWEEKDREAIISASEELYAEMHSALMQTGDATKVVNKLRVRFGDRIPNRPDVVKIGSKIEAVQKEKPATVAAPAIVASTSG

SEQ ID NO: 2632 - protein, 395 aa, Thalassospira xiamenensis
MTLANAHALFCGPLNSPSFLSSLNIDDIDRAKLLAARNKIRSILKASADTLLKDDTFWQERSKFRTYRHSRPTSVTLKFMTQGSFSYGTLNIPAQSPKQEIDLDDGMYVPVDFLENGEPALAAKGLFSFVINSLSDVCSQNGWTVKEKRSCVRVQLWQGAHIDIPIYSIPTERFAALRAAMDSANFAEANISRAYLSNDMRIPSDKIMLAQSDGSWLRSDPQELEEWVKARKDRLGTSYTRLCRFFKAWRDFNWLSSPLSSLCIMRAVEIALEELPGFPSQNRDDELVMLVAEKLPLILGKTVQNPVLRDLSLNEWEAKDREAIISASEELYAEMHSALMQTGDATKVVNKLRVRFGDRIPNRPDVVKIGSKIEAVQKEKPATVAAPAIVASTSG

SEQ ID NO: 2633 - protein, 392 aa, Erythrobacter sp.
MTLANAHALFVGLQKNPSYLASLEIEDNERQRLLNARQTIRTALRNATHRLETDKSFWRRGYLIETANRIQDDVKVKFMTQGSFAYKTLNAPAQPALQEIDLDDGMYVPVRFLSDNHPALAAGALFTFVEEVLRPVCRANGWSLDSSKSTCVRIRLWRGAHIDIPIYSVPEERFRIMKAAIEEAAFSARNLTFDSVPAIPSDRVMLAQRSGEWVQSDPKQLHDWVENRVDRHGPSFRRMSRFFKGWRNHVWADSPLSSICLMCAIDAALLELGQSAENRDDKTILDVARLLPPIFSGEIKNPVVKASCLNSWSEEERGDVLAETRALAATMEAALERTGDADRVIEHLRDAFGRRIPYRPDIIAIESDTAAAVRAAPAATVATPHITSSDSG

SEQ ID NO: 2634 - protein, 392 aa, Erythrobacter litoralis
MTLANAHALFVGLQKNPSYLASLEIEDNERQRLLNARQAIRTALRNATHRLESDKSFWRRDYLIETANRIQDDVKVKFMTQGSFAYKTLNAPAQPALQEIDLDDGMYVPVRFLSDNHPALAAGALFTFVEEVLRPVCRANGWSLDSSKSTCVRIRLWRGAHIDIPIYSVPEERFRVMKAAIEEAAFSARKLTFDSVPAIPSDRVMLAQRSGEWVQSDPKQLHDWVESRVDRHGPSFRRMSRFFKGWRDHVWANSPLSSICLMCAIDAALLELGQSADNRDDKTILDVARLLPQIFSGEIKNPVVKASCLNSWSEEERGAILAETRALTETMEAALERTGNADRVIEHLRDAFGRRIPYRPDVITIESDTAAAVRAAPAATVATPHITSSDSG

SEQ ID NO: 2635 - protein, 392 aa, Erythrobacter sp.
MTLANAHALFVGLQKNPSYLASLEIEDNDRQRLLNARQTIRTALRNATHRLESDKSFWRRDYLIETANRIQDDVKVKFMTQGSFAYKTLNAPAQPALQEIDLDDGMYVPVRFLRDNHPALAAGALFTFVEDVLRPVCQANGWSLDSSKGTCVRVRLWRGAHIDIPIYSVPEERFRVMKAAIEEAAFSARNLTFDSVPAIPSDRVMLAQRSGEWVQSDPKQLHDWVENRVDRHGPAFRRMSRFFKGWRDHVWANSPLSSICLMCAIDAALLELGQSADNRDDKTILDVARLLPRIFSGEIKNPVVKASCLNSWSEEERGDILAETQALAATMEAALERTGDADRVIEHLRDAFGRRIPYRPDIIAIESGTAAAVRAAPAATVATPHITSSDSG

SEQ ID NO: 2636 - protein, 398 aa, Novosphingobium naphthalenivorans
MTLANAHPIFVGLRNDPSYLASLNIDEQEQTRLINARTTIRKALRDASWKLEQQTRFWRDSYLIETSHRVRDSVAVKFLTQGSFAYKTLNTPAKPEVQEIDLDDGMYVPVRFMKDSHPALAAGALFTFVEETLKPVCIANGWELELQNPKNTCVRVRLWKGAHVDIPIYSVPEERFEAMQQAILEKAIASTSFNFDSIPSLVRIPSHLIMLAQRDGHWVQSDPKQLHDWVEGRVERYGPIFRRLCRFFKGWRDHTWVNSKLSSICLMCAIDAALIELGGAPANDRDDREILRVAKLLPGILDGQINNPVVPDSCLNGWSDTDKKEIISGAQALANEMESALERTGNAEIVITRLRNAFGERIPYRPDIITIDNSSAESVRAAPAIIVPTPKIIDSSSG

SEQ ID NO: 2637 - protein, 396 aa, Sphingorhabdus flavimaris
MTLANAHPIFVGLKKNLSYLAQLNIEDEEHHKLMEARTIIRKALRDASSRLENEKRFWRDSTVFAAAKQVAETVAVKFLMQGSFAYRTLNSPAKPNCQEIDLDDGMYVPVRFMQDSHPALAAGSLFTFVEETLSPVCNENGWELDSSKNTCARVRLWKGAHVDIPIYSVPEDKYRLMKSAIADARMASISFTADKFPSMAAIPTNLVMLAQRDGKWIQSDPKQLHDWVEARSARYGPVFRRLCRFFKGWRDHTWENSPLSSICLMCAIDAALIELGGNPVDDRDDMQIMEVAKLLPDIFRGEINNPVVEGSCLNGWSDADRNEILKSTEALADEMEGALERTGHPDIVIDHLRNVFGRRIPNRPDIITIANDTASSVRAFPAATVPTPKIINSNSG

SEQ ID NO: 2638 - protein, 397 aa, Sphingomonas sp.
MGFLAKASALFIGLRVSSSYHQALQVPPAKESALQAAKRDVRAAIKAASSFIQLNDANWEPEFASRAPRSRPSVEPRFFTQGSVAYNLLVDPCQKPPQQLDLDDGMYVRVEFLNGRPALVAKALFEMVEAALAPLCQARGWILNPPPAKSTCVRVQISADSHIDIPIYSAPVETIETLSFQSASLQKSMVDARSGREYARLPSDEIMLANRDGTWQPSDPLKLHEWVDACAERYGEEFRRACRYIKGWRDFAWDGCCLSSITIMAGVAKAFDELQGTHRRMADDELVYEIAQRLPAIFEGTLWNPAYPGKEIVLNDWCDEERTEVVAAARALAQNMDDALKGTAVADLVVAALRRAFGSRIPLRPDMIEIAAPVAAIVLAEKAAAVPAPRIIKSTQG

SEQ ID NO: 2639 - protein, 396 aa, Unknown
  Description of Unknown: Sphingomonadaceae sequence
MGFLAKASALFVGLRVTASYHQALQVADLQKSSLLDARRDIRKAIRASAARIQIEDGFWEPAYAARSARSRPSIMPKFFTQGSFAYDLLVDPCHKPPQQLDLDDGMYVRVDYLENGQPALVAKTLFALVEDALRPLCRERGWILDTSKLTCVRVQLSRESHVDIPIYSAPRELAESISFGDAQIQSGQFAKRAGRFYAKLPSDQIMLAHRDGTWQQSDPLELQKWVEACVARYGEDFRRACRYFKGWRDHRWEHCCLSSITIMAAVAEALEQLNGTHRNLDDDRIAYEIAQRLPGIFRGELLNPAFPGQRIVLNDWTDDDRTTVVKASEALAADMHSALKGTANADLVVHALRRAFGERIPYRPDMVEILPTVAATVAAEAPALVPAPKVTNSTSG

SEQ ID NO: 2640 - protein, 396 aa, Sphingomonas haloaromaticamans
MGFLAKASALFVGLRVSASYHQALQVADSRKSSLLDARRDIRNAIRASAARIQIEDVFWEPAYAARSARSRPSIMPKFFTQGSFAYDLLVDPCHKPPQQLDLDDGMYVRVDYLENGQPALVAKTLFALVEDALRPLCRERGWILDTSKLTCVRVQLSRESHVDIPIYSAPRELAESISFGDAQIRSGQFAKRAGRFYAKLPSDQIMLAHRDGTWQQSDPLELQKWVEACVARYGEDFRRACRYFKGWRDHRWEHCCLSSITIMAAVAEALEQLNGTHRNLDDDRIAYEIAQRLPGIFRGELLNPAFPGQRIVLNDWADDDRTTVVKAAEALAADMHSALKGTANADLVVQALRRAFGERIPYRPDMVEILPTVAATVAAEAPALVPAPKVTNSTSG

SEQ ID NO: 2641 - protein, 383 aa, Sphingomonas sp.
MFVGASRFQSYHEALLVEDDREAALRSAQREIRQTLREAARKIPLEGRFWRGRFMTVAASQRPSIVPKFKTQGSVDYDLLVEPWHLPPQQIDLDDGVYFNVEYLDSGEPALVAEALYQFIEEALMPLCKARGWYLSEKDCCVRVQVARDAHIDLPIYSAPRRVTEAISFQAQDTALAKRSGERYERLPSDKIMLAYRDGTWTQSDPLRMKDWVEACVTRYGPDFRRVCRYLKGWRDQRWAKPCLTSITLMVAVEKALGMLNGGHRALPDDHLLYEVAQRLPGILRGELLNPVFPGQRIILNDWSPEDRDAVIGSAEALAADLHSALKGTHDATLVVESLRRALGTRIPYRPDAVEMMPTIAATVAAERPAKVASPTVSASTSG

SEQ ID NO: 2642 - protein, 397 aa, Tardiphaga sp.
MKFLANANALFIGLRETKSYHEALQVGPARHAKLLAARGLIRERIREEAKRIRSEDQFWDASFAIRARRTRPEVSPKFFTQGSVAYNLLVDPVLRIVQQLDLDDGMYVGVEYLQNGKPALVAQALFSLVEEALASLCKEQGWELDKSKETCVRVVLDAESHIDIPIYSAPADRMIAMDAVALNARADSVILKRAGHEYAKLPTDKIMLAHRNGDWDQSDPLALHEWVDRCVERYGELFRRGCRYFKGWRDFRWSNGRLTSITIMAAIAEALEHMNGAHRSLSDDQVVYEISQRLPDILEREILNPAFPGQQKVLNDWSANDRREIVRAAHALAERMTDALVNTGVAELVVDALRKAFGDRIPNRPDVIKIVPPVAAAVIAQAAVATPVPKVTASTSG

SEQ ID NO: 2643 - protein, 404 aa, Roseovarius sp.
MSTMNAHALFLGANTTASYHQAILLPDETRRTLLQADRKLRAAIRRDAAEAVQFGKQMALATDAYRASKQAPPTLEVRFLLQGGLAYDTAVEPAIIPPQQCDRDTGVYVKTSFLARQEPSLAAKKFFDLVENAIKALCDAEGWTIKKKSTCVRVELNPFMHIDYPLYAIPDDAFETLEKSLRDATGETLVNAASQMLTLMDRHRTLRIPSDRIMLAHREEGWVQSDPRALHDWFEEQFSRYGPQVRRQSRYFKGWRDFAFEQDGPSSVALMVCIANCYRDGLVSADETRDDLAFHQVAGALSDLMRDPIQNPVLDVPSALNDWDDIERARYRSAANQLHDTVGTALNGHYLRDLTVQRLQSALGRRVPNRPDLVKAHSKVPEIAAPATIISSAPLKTTARTTSG

SEQ ID NO: 2644 - protein, 404 aa, Thiobacimonas profunda
MSTMNAHALFLGANTSASYHQAILLPDETRRALLQADRKLRAAIRRAAAEAVQFGKQMALATDAYRASKQAPPTLDVRFLLQGGLAYDTAVEPAFMPPQQCDRDTGVYVKTSFLARQEPGLAAKKFFELVETAIKPLCDAEGWTIKKKSTCVRVEISPFMHIDYPLYAIPDDAFETLEKSLRDATGETLVTAASQMLTLMDRHRTLRIPSDRIMLAHREEGWVQSDPRALHDWFEEQFSRYGPQVRRQSRYFKGWRDFVFEQGGPSSVALMVCIANCYREGFVSADEARDDLAFHQVAGALSNFMRDPIQNPVLDVPSALNDWDDIERARYRSAANQLHETVGTALNGHYLQDLTVQRLQKALGRRVPNRPDLVKAHSKVPEIAAPAAVISSAPLKTTARTTSG

SEQ ID NO: 2645 - protein, 404 aa, Roseovarius mucosus
MSTMNAHALFLGANTSASYHQAILLPDETRRALLQADRKLRAAIRRAASEAVQFGKQMALATDAYRASKQAPPTLDVRFLLQGGLAYDTAVEPAIMPPQQCDRDTGVYVKTSFLSRQEPGLAAKKFFELVENAIKPLCIAEGWTIKKKSTCVRVEISPFMHIDYPLYAIPDDAFETLEKSLRDATGQTLVTAASQMLTLMDRHRTLRIPSDRIMLAHREEGWVQSDPRALHDWFEEQFSRYGPQVRRQSRYFKGWRDFAFEQGGPSSVALMVCIANCYREDLVSADEARDDLAFHQVAGALSNFLRDPIQNPVLDVPSTLNDWDDIERARYHSAANQLHETVGTALNGHYLQDLTVQRLQNALGRRVPNRPDLVKAHSRVPEVAAPAAVISRAPLMTTARTTSG

SEQ ID NO: 2646 - protein, 404 aa, Roseobacter litoralis
MTYMNAHALFVGANVSASYHQAILLPDDKAEALRSDDKQLRAAMRSAAELVVKQGNVMAFASDAFRDQKQTAPSLELKFLLQGGMAYKTAVHPAFLPPQQCDRDTGVYVKTSYLDHDSPGIASEKYFALAERAIKPLCDLHGWKIVKKATCVRVELSPELHIDYPLYAIPDEEFIALAMAFADTTGIALNSAMDDMSNYFKRFPHLRIPTDRVMLAHRELGWIHSDPRALHDWFEDHFSRFSGLRRQCRYLKGWRDFTFDTGGPTSILLMVCAANAYRSGMVDAKDNRDDEAFLSIAKALPEMLRGDVLNPVLEERSVLNAWDDVERRRIISEIEQLEQHVDTALNGHFHSSITVERLRNALGGRVPNRPDLVKAHMSVPGEVSAPVKIAPVSALPQVRRTVSG

SEQ ID NO: 2647 - protein, 404 aa, Mesorhizobium australicum
MALMNANTLLYGARDAIAYHQAIQLPDDVRAAMFQADRDIRARLRKVTRFVIDSGRAMSYASAEYRRAKQEPLQFELRFLRQGSVVYDTVIDPARRPPQQTDLDDGIYARTSFLSDFEPGLAATKYFELVETALAPLCKERGWRLVTNKDTCVRVVIDEKIHIDLPLYAVPDTEFVTLEKCFQDVTGLKLVAGSARLSTVLDGFSDIRIPTDRVMLAHRKKGWISSDPRALHDWFVRECERHGPQLRRTCRYLKGWRDFLFLEGGPASIALMACAVRSYKEGGWVPQNDRDDLAMLEIAKRLPVFFSATIVNPVLPDAEPLNDWDEVTRKRFVNAANDLHGHMHTALEGTANAEITVRRLQEALGTRVPYRPDLVRAFDKTPARAPVAAVVASPLPLRRPTTSA

SEQ ID NO: 2648 - protein, 414 aa, Phaeobacter inhibens
MPINAHRAFVSRSSGYKFALNLSDKQEQTLRNARDDIRSEISSQFGSFAKALGDQVLFEDRAPVLVRSYQTPKFKMQGSFSYHTCNQPAHVPPQEIDLDDGLFMPVSYFQKGGDRSPVIQSAAYFSIVERILAPLCDKKGWQLVTDKPSCIRVKIDNTMHTDLALYSVPDTDFQRIVKDAQSRGVDFTAELMMEDTAYRMLSHDEMMLAHRNEGWMKSDPRKLEDWFVDAVKQYGEQVRTVSRYLKGWKDFQWPEGRLASIALMAAVVSVFEKASAAIASDRDDLALLRVAEDLPDFLANDIPNPVVEGARLDQGWSPEERSDFVAKARVLAERLKDALTQTSDRTAAFEALQNQFGGRIPDDLTLYVPDAGLETKASELAAPAALTLGIVEKIDSEQSDDLAAVNKQGGGRYG

SEQ ID NO: 2649 - protein, 431 aa, Phaeobacter inhibens
MGVLRSHHNIKTKRDRFMPINAHRAFVSRSSGYKFALNLSDKQEQTLRNARDDIRSEISSQFGSFAKALGDQVLFEDRAPVLVRSYQTPKFKMQGSFSYHTCNQPAHVPPQEIDLDDGLFMPVSYFQKGGDRSPVIQSAAYFSIVERILAPLCDKKGWQLVTDKPSCIRVKIDNTMHTDLALYSVPDTDFQRIVKDAQSRGVDFTAELMMEDTAYRMLSHDEMMLAHRNEGWMKSDPRKLEDWFVDAVKQYGEQVRTVSRYLKGWKDFQWPEGRLASIALMAAVVSVFEKASAAIASDRDDLALLRVAEDLPDFLANDIPNPVVEGARLDQGWSPEERSDFVAKARVLAERLKDALTQTSDRTAAFEALQNQFGGRIPDDLTLYVPDAGLETKASELAAPAALTLGIVEKIDSEQSDDLAAVNKQGGGRYG

SEQ ID NO: 2650 - protein, 414 aa, Phaeobacter inhibens; identical to SEQ ID NO: 2648

SEQ ID NO: 2651 - protein, 414 aa, Sedimentitalea nanhaiensis
MPVNAHRAFVSRPSGYKFALNLSEEQEQTLRNARDDIRSEISSQFGSFAKALGDQALFEDQAPVLVRSYQTPKFKMQGSFSYHTCNQPAHVPPQEIDLDDGLFMPVSYFQKGGDRSPVIQSAAYFFIIERILAPLCDKKGWQLVTDKPSCIRVKIDNTMHTDLALYSVPDTDFQRIVKDAQSRGVDFTAELMMEDTAYRMLSHDEMMLAHRNEGWMKSDPRKLEDWFVDAVKQYGEQVRTVSRYLKGWKDFQWPEGRLASIALMAAVVSVFEKASAAIASDRDDLALLRVAEDLPDFLANGIPNPVVEGARLDQGWSPEERRDFVAKARVLAERLKDALTQTSDRAAAFEALQNQFGGRIPDDLTLYVPDAGLETKASKLAAPAALTLGIVEKVDAEQSNDLAAVNKQGGGRYG

SEQ ID NO: 2652 - protein, 414 aa, Sedimentitalea nanhaiensis; identical to SEQ ID NO: 2651

SEQ ID NO: 2653 - protein, 405 aa, Sedimentitalea nanhaiensis
MSRPSGYKFALNLSEEQEQTLRNARDDIRSEISSQFGSFAKALGDQALFEDQAPVLVRSYQTPKFKMQGSFSYHTCNQPAHVPPQEIDLDDGLFMPVSYFQKGGDRSPVIQSAAYFFIIERILAPLCDKKGWQLVTDKPSCIRVKIDNTMHTDLALYSVPDTDFQRIVKDAQSRGVDFTAELMMEDTAYRMLSHDEMMLAHRNEGWMKSDPRKLEDWFVDAVKQYGEQVRTVSRYLKGWKDFQWPEGRLASIALMAAVVSVFEKASAAIASDRDDLALLRVAEDLPDFLANGIPNPVVEGARLDQGWSPEERRDFVAKARVLAERLKDALTQTSDRAAAFEALQNQFGGRIPDDLTLYVPDAGLETKASKLAAPAALTLGIVEKVDAEQSNDLAAVNKQGGGRYG

SEQ ID NO: 2654 - protein, 427 aa, Sulfitobacter sp.
MSINAHKSLNGSHENAYIKQLKLPQHREDELRAVRDELRDAIRTGLKDWTERFPVNQIITKDAEIALMQEEISVADAFGRPKFRMQGSFSYSTVNEPAKGKTPALQIDLDDGMFLPTRYISRDGALAPSVAAEGYFRAVEQLVSEVCDKHGWTLKTKTSCVRVEIDTEAHVDIALYAVPQSDFVTLVETAHAQKRVMMDGLMELRDEEFADEIYGSLSADEMRLACRDDDGRGKWIPSDPRKLEDWFRDAVREHGDQVRFVSRYVKAWRDEQDLPGLASIALMWAVVQVFDNHQGYKPFTGRDDLALLAVARALPGLLSEAIPNPVVAGARLDQNWQESDRRAYVSAAADLETKLNAALIMSSNPQVTVQHMLDALGERFPTDTSLLVDETVVANEAIAAPATLTSGLLETKDDRPAVKLDGDERYA

SEQ ID NO: 2655 - protein, 416 aa, Altererythrobacter sp.
MGANAHRTLFSSGEHDTYLRGLTVDAKQRAALQAAREEIRDEIRSGLRAWSDHVDRTQFFEVTALASVSFADSDLALRPKFRMQGSWSYHTLNRATHNPPQEIDLDDGVFLPVSFLSQNGGAHPIVASAGYFTAVERILAPLCDRNGWTLITNKPSCVRVEINDDAHVDLALYAIPDDEFEELLEKAAASLQFDTRMLDENVSFAEQIYPRLPTDQIMLAHREEGWKPSDPRKLEDWFQDAINAHGQQLRRVCRYLKGWRDHNWTGCRLSSIALMACVVAAYDEAAALIAENRDDLALQMVAKRLPELLERRIPNPVVHGQYLDEGWAYECRADFIAKARCLVTRIDAALAANQSGTVIEHLRAALGDYLPDDEDLVVIEAPIGAPTILQSGILKDFADQPDAREAVKKGGDGRYG

SEQ ID NO: 2656 - protein, 416 aa, Citromicrobium sp.
MGANAHKTLFSSGDHDSYLRALTVDIPEKEALQVARDEIRDEIRSGLRNWSDHVDRRQLFEARALASDYLTDSDLALRPKFRMQGSWSYHTLNRATHNPPQEIDLDDGVFLPVSFLSQNGGAHPIVASAGYFAAVERILAPMCDRNGWTLITDKPSCVRVEIDDDAHVDLALYAIPDEQFEVLLEKAEASMQFDTKMRDENISFAEQIYPRLPTDQIMLAHRREGWKPSDPRKLEDWFQEAIDVHGQQLRRVCRYLKGWRDHNWTACRLSSIALMACVVAAYDEATAAIAENRDDLALQMVAKRLPELLERSIPNPVVHGQYLDEGWTGECRADFIAKAHDLATRIDVALASNQSGTVIEHLRASLGTYLPDNEDLVVIEAQIGAAPILQSGILKDFADEPDAREAVQKGGDGRYG

SEQ ID NO: 2657 - protein, 414 aa, Sphingomonas sp.
MTVAINAHRAFYREGADDTYLSALNIDEEDRLALRAVRDEIRETLRQGFRDWEDYLGGQEMFEHAALAKVEFAAAPPPLRPKFKMQGSWSYDTLNRTTHEPPQEIDLDDGVFLPVSFLSQNGEAHPAVISGAYFAAVEAMLAPICEKRGWTLSDPKPSCVRVEVRDGAHVDLALYAIPDDDFAVLIEKAEASVAFAGALDEQIAFTRDVYPRLPSDHIMLAHRDEGWKPSDPRKLEEWFKAAIALHGYQLRRVCRYLKAWRDHHWGVCRLSSITLMACTVAAFDQLGSTIDQTRDDKALLMAAEQLAMRLNHRVYNPVVAGQFLDDGWSTEMRREFITEAQELAAGLRVVLNGTRAADASAKLCELFGDYLPDDADLLVVESAPSILTTGMLGDFEKSEEAQRSVRLGGDSRVG

SEQ ID NO: 2658 - protein, 419 aa, Rhizobium sp.
MGLNAHRVFKSESATPSYLSALNLDQKTENSLRSARDEIRQTLKDGLRNWPVMVTKRELLEGIALDSTPVLRPKFRMQGSFSYRTCNLPAQKNQEIDLDDGVFLPVSFLNQGGSVHPAIASRGYFTAVERALAPLCSKRSWQLITDKSSCVRVQISKEAHIDLALYAIPDTDFETLVESAMSTHMASDRALLRKSLEDSVEFAEAQYVELPDDHIMLAHRDEGWKKSDPRKLEDWFRDALKVHGEQLRRVCRYLKGWRDQQWSSSRLASIALMSAAITAYQQAKEKVADNRDDKALLMVMEQLPDILNGSISNPVVKGARLDEGWTDKERGQYVQAAKALESRLRQTLHQTRDVNVALSALTGLFGKRIPDDTGLLSFEDNLGSELASPPVLSMGLLQDVGDTQEARQAVKLEGDGRYG

SEQ ID NO: 2659 - protein, 417 aa, Pleomorphomonas sp.
MTLNAHRVFTGPADADHFLAALTLEPATEQLLRAARETCREAIRSGLRTWSTILQKSMLFEAAQVNIAPASLKPKFKMQGSFAYRTLNRPAHTPPQEIDLDDGVFVPVSFLNDNGRAHPALISSGYFQAVEATLIPVCQEKGWTLVTDKPSCVRVELNDEAHIDFALYAIPDDEFGQLIETEALAKAMNAQDRALLNEQIELAEDLYRGLREDQIMLAHRKEGWKPSDPRKLEDWFRAALRTHGEQLRRVCRYLKGWRDHHWEACRLSSIALMSCVITTYDEAAAKPADDRDDLALLAVADRLPNLLQGRIVNPVVDDQYLDEGWEEEDRTRFVNEAQALRDRLHEAIVDTDSAPRALASLVSAFGDRLPDDYNLIKSEDSATLAAPAVLTSGLVKQMGGDREPQQAVKREGDRRYG

SEQ ID NO: 2660 - protein, 404 aa, Hyphomonas jannaschiana
MTELLNLHALLGDSSGYLDALRVPDADERALSLAREKIRSTLRDAFRQPSNFVAKRALFEDRAPVDTESAKLRAPKFRLQGSFQYGTANDCQITPPQEIDQDDGVFLPISFFRTQFGDRPVIASEAYFLLVEKALQPLVEREGWSLDTSKDTCVRIRLSKRLHMDLPLYVIQDSAFTHLAKADAQARFLDEASLRHETELAEAVYRGLSEDQILLAHRKKRWMSSDPRTLENWFANAIGVHGSILRRLSRAYKGMRDAHEMDDELGSICIMVGAVEAYGNIGKPPQGREDIALRDVAREMSHLFQNPVYNPAFPGDDEHCLCIDWDADTRQRICTLFAEAADHLDYATTGTTDKSMALHRARLAFGDRVPDDVSLIKQVGQAALIRSQEPRRQPAPLAPRTRSG

SEQ ID NO: 2661 - protein, 404 aa, Hyphomonas jannaschiana; identical to SEQ ID NO: 2660

SEQ ID NO: 2662 - protein, 350 aa, Brevundimonas diminuta
MAGAYLTQDEVPLVKAHGVPDPAALSFTPKFRTQGSWAYGTLNQPAKACQQLDLDDGMYVPMSIVGLNPAVASNTLFAIVERILGALCDAQGWTLDTSKSICVRVVIDAEAHLDLNIYAIPDVKMALLEKAFHAAANRAIDGSAFSSPPPEIRLDPSEIYVAHRTTGWEQSDPLELEDWFVNAAARHASWTDLKRLTRYLKAWRDYHWDSCRLSSLVLMVCAVEALDEANTPPQPGRDDDGLLVVARALSAKIAGVVWNPVVDDKALNDNWTTTEQNQFELKARALASELDGALNNETSIFNVVERFRRLFGHRVPDNAALVSPIASASQVRSTVAAQSPSPRVGSQTSG

SEQ ID NO: 2663 - protein, 398 aa, Brevundimonas sp.
MRYNAHRLLHQAANQPCLRCELVITDAQKHKLQTAQKLVRDALRAGLRVAGAYLTQDEVPLVKAHGVPDPAALSFTPKFRTQGSWAYGTLNQPAKACQQLDLDDGMYVPMSIVGLNPAVASNTLFAIVERILGALCDAQGWTLDTSKSICVRVVIDAEAHLDLNIYAIPDVKMALLEKAFHAAANRAIDGSAFSSPPPEIRLDPSEIYVAHRTTGWEQSDPLELEDWFVNAAARHASWTDLKRLTRYLKAWRDYHWDSCRLSSLVLMVCAVEALDEANTPPQPGRDDDGLLVVARALSAKIAGVVWNPVVDDKALNDNWTTTEQNQFELKARALASELDGALNNETSIFNVVERFRRLFGHRVPDNAALVSPIASASQVRSTVAAQSPSPRVGSQTSG

SEQ ID NO: 2664 - protein, 398 aa, Brevundimonas vesicularis
MRYNAHRLLHQAANQPCLRCELVITDAQKHKLQTAQKLVRNALRAGLRVAGAYLTQDEVPLVKAHGVPDPAALSFTPKFRTQGSWAYGTLNQPAKACQQLDLDDGMYVPMSIVGLNPAVASNTLFAIVERILGALCDAQGWTLDTSKSICVRVVIDAEAHLDLNIYAIPDVKMALLEKAFHAAANRAMAGSAFSSPPPEIRLDPSEIYVAHRTTGWEQSDPLELEDWFVNAAARHASWTDLKRLTRYLKAWRDYHWDSCRLSSLVLMVCAVEALDEANTPPQPGRDDDGLLVVARALSAKIAGVVWNPVVDDKALNDNWTTTEQNQFELKARALASELDGALNNETSIFNVVERFRRLFGHRVPDNAALVSPIASASQVRSTVAAQSPSPRVGSQTSG

SEQ ID NO: 2665 - protein, 405 aa, Methylophaga thiooxydans
MPNKFHSLLASTTHESLLANLDLSKRDEEALVDAAKEIRSAIIAGFVELREKLQRQHLDYEVPKPKFAIQGSYIYGTLNSPANPPKQQVDIDLGMYLPFSALGDGQRPKTATQFYFSAVTEILEKYIQNKRKHWVLPPASQQKDTCIRVLINEKTHIDIPLYAVPEGELNRVTEANLAAYDQDSYMPEMMRGNELSLEYFALEAITPDVIHMAHRKDGWQPSDALVIRDWVKSQFRKMGSMIRPVNRFLKAWRDHAWPDGGGPSSIFLLAHSLHSFPSDTNGLSHCEALEAVINELPSVFNRPLLVPRPTSTDKFAKEDLCERISDEEKKEFYTYFESLRQQYALAKRTDPRAANSILISIFGRRMPNDPSRIVVTNTTTSRVEEIRGSKPDIRPLYTTDRSNSG

SEQ ID NO: 2666 - protein, 405 aa, Methylophaga thiooxydans; identical to SEQ ID NO: 2665

SEQ ID NO: 2667 - protein, 405 aa, Methylophaga thiooxydans
MPNKFHSLLASTTHESLLANLDLSKRDEEALVDAAEEIRSAIIAGFVELREKLQRQHLDYEVPKPKFAIQGSYIYGTLNSPANPPKQQVDIDLGMYLPFSALGDGQRPKTATQFYFSAVTEILEKYIQNKRKHWVLPPASQQKDTCIRVLINEKTHIDIPLYAVPEGELNRVTEANLAAYDQDSYMPEMMRGNELSLEYFALEAITPDVIHMAHRKDGWQPSDALVIRDWVKSQFRKMGSMIRPVNRFLKAWRDHAWPDGGGPSSIFLLAHSLHSFPSDTNGLSHCEALEAVINELPSVFNRPLLVPRPTSTDKFAKEDLCERISDEEKKEFYTYFESLRQQYALAKRTDPRAANSILISIFGRRMPNDPSRIVVTNTTTSRVEEIRGSKPDIRPLYTTDRSNSG

SEQ ID NO: 2668 - protein, 386 aa, Pseudoalteromonas undina
MLKFSINKLLSSSGLRDREYYLDNLRISDEIRSKLVSLRDDARSGILEAWSYAKEQVKQDKDLYERVPLRKLEQLIKLKPRFKMQGSYVYGTIVQPAHNSQDIDLDDGMYIPMSVVQHDDKTMSTAMFEVVDRVLKKMASANGWKQIPKKTCSRLQTNEAIHLDIPCYAIPDEDFNRLWLFESASMESNSAQDTELKTHTVNLALRNGEWLESNPEHIKDWVSRAKKLHPNFKDIVMVVKGLRDHNYPTGGPSSISLMVAIEKIMSNSPKHGDLTEELYNVVQKLPAVISNELKHPHPESSHLTIHSPTELEKQELRMKFDSFAMSFKQALVTSLTERETLDILINLFGIRMPNDQTRIIRCSRDSDLKTKKSEVITPIQEHNTFG

SEQ ID NO: 2669 - protein, 386 aa, Unknown
  Description of Unknown: Pseudoalteromonas sequence
MLKFSINKLLSSSGLRDREYYLDNLRISDEIRSKLVSLRDDARSGILEAWSYAKEQVKQDKDLYERVPLSKLEQLIKLKPRFKMQGSYVYGTIVQPAHNSQDIDLDDGMYIPMSVVQYDDKTMSTAMFEVVDRVLKKMASANGWKQIPKKTCSRLQTNEAIHLDIPCYAIPDEDFNRLWLFESASMESNSAQDTELKTHTVNLALRNGEWLESNPEHIKDWVSRAKKLHPNFKDIVMVVKGLRDHNYPTGGPSSISLMVAIEKIMSNSPKHGDLTEELYNVVQKLPAVISDELKHPHPESAHLTIHSPTELEKQELRMKFDSFAMSFKQALVTSLTERETLDILINLFGIRMPNDQTRIIRCSRDSDLKTKKSEVITPIQEHNTFG

SEQ ID NO: 2670 - protein, 374 aa, Treponema sp.
MRNLSPLFFRGKNNLLKNISLSEEQNQLMRDAVSKIKICLNEAISKEYGIHPRFMTQGSAGYKTQNTPCYSSQEVDYDIGCYLPFSEIQDTGKPKTAANIYYTTVDNALQKLAEENHWKGINTKKQTCSRVCINSQLHIDIPLYSVPDDEFSSIHEHATESFSKSFCAADSKFDETESWDDFNFKKVLLGRRNGDWQESDPRKINMYFADAFEKKGEQLRRLCRYLKAWRDFKWENGGPKSIYLMCLADDLFQYENNLGDDIAFLDLISKIPNRLESGEPVKNKAENEPLPIDESDCELLKEYAKAFSKDLSSAITNEMITDEEACKLLRKHLGTRFPLESFVIHEKERLREYVKSTPINEASKSRPLTRTRAG

SEQ ID NO: 2671 - protein, 365 aa, Fibrobacter sp.
MECKSLNDCFRGYLKEIEVSQEVKETLEDARLKIKRALTEGIGERTAQEENRIVPRFMRQGSAGYKTQNMPCCPPAQQVDFDYGCYLPLSYHEDESEPREAANDFFDMVDSILKPLAKANGWTAEKGKKSYCLTLSDEIHFDVPLYSVPDKKFQKIRDMRPVNESAQGSTFAACDEQEERDLDWDDLPTKSIMLAYREDNGLYSWKKSDPRLLNLYFMNKDDDDRAIYRILKGWRDFNFQDGKGPSSIFLMSLAEKANAGKSFTDDISAELLKVLKFIKSMSLPDDEVSVENPADPREGIKCPTEKFKVLQSRAVGFASAIAGNMDPSDAARSQAVQRHLGKRFPVIKDSVQINRRGALPSVRAG

SEQ ID NO: 2672 - protein, 365 aa, Fibrobacter sp.
MECKSLNDCFRGYLKEIEVSQEVKETLENARLKIKRALTDGIGERTAQEGNRVVPRFMRQGSAGYKTQNMPCVPPAQQVDFDYGCYLPLSYHEDKSEPREAANDFFDMVDSILKPLAKVNGWTAEKGKKSYCLTLSQEIHFDVPLYSADKDFPKIRDMQSANESVQGSTYSACDEQEERDLDWDDLPTESIMLAYREDNGLYSWKKSDPRMLNLYFMNKGDDDRAIYRILKGWRDFNFQDGKGPSSIFLMSLAEKANAGKSFTDDISAELLMVLKFIKSMPLTDDDEVSVENPADPREGIKCPTEKFKVLQSRAVGFASAIAGNMDPSDASRSQAVQRHLGKRFPVIKDSVQINRRGALPSVRAG

SEQ ID NO: 2673 - protein, 415 aa, Kordiimonas lipolytica
MSRLNLHKVFKGKLFSPGFLKNIEVVSSERDALLSARSEIRDHIRQEFKELPEMASAQVVFSEAFYKHTRYDHSLQPDLEFKPKFLTQGSFQYKTVNWPAKLPPQQVDLDDGIYVPMPFYLGQPTLKASVYFDVVERAISKLCEDKGWRLDTSKNSCVRVELNSGKSHIDLPLYGVPDKEFDRLTKEMASDSLDFSQTYIYEAMKDYRSPFRIDSNQVKLATREDDWILSDPQKIHDWFNDAVRDHGEQLRDVCRLLKAWRDYNWNECKLSSISLMTVAVEAYDNAFGNPDGSRPAEDRLDIALLQTARYLADALHGAIINPVLPEEHNNLASGWSQQERGDFILKAYELVEKVDHALNAGFRKEAALGQICDVFGERVPMEVGLVEFTNGPKDEVLSTAPAYQAAPEVMEHKSG

SEQ ID NO: 2674 - protein, 332 aa, Arcobacter butzleri
MNFGTEFDNYYKIISIDSDKRTKLLENKGLLRQKIRDDFKDNGRKIPKFHIQGSMEKNTSTGINPLNGNYDIDDGVYLQNIDSSKPIEEWETAEKAHEWIYDAVVGHTKSTEDLSKCVRVNYADNEKHVDLPIYVQKDDDYYLAIKGKGWKKNNPKDIASWFNDRNTALGENFRKGSRLLKAWKDKRESENATLKLFGGFQLSILVSNHFPFYTDNTEEFFFKLIQNINQNLWQFPPLRNPKNYSQDTIEYYSQSRIDTFKSEFETLYSKVKEAYEETDCQKKYEKWKKVFGDRFPKPTDSECESKTKALGLGTALTIKEEANIENTSGRMA

SEQ ID NO: 2675 - protein, 361 aa, Pseudorhodobacter sp.
MYDFSAEVSKFHRDRVRLSEVQRGDMTRRRDLNCDRIVAGLAEMGKPALVETINQGGNAMKTMTHPPEGNEDSQYDIDMGVVFNADDTLTPRTTKGWVRDAIARNATNLKYAPEAKPKCVRVEYADGYQCDFPVFRRKLNGDRYSYEIAISDEWVASDPLAINAWFHERVRTLSPETEGSYQLRRVTRLVKYFAKVHAFRTGLKFPAGLVATALAVECYVPADGRDDESIYQTLVALSRRSEQLPVSANGVVVSGDRDVDRVRRLADAAKDAVAALAAIGDNSTPAEARKAWKKVFRHSFFDEANTSNGMRAPEVKAAGLAAPALISSAVAAMAQSERAERLQSAVDARQGAGGASQPWAR

SEQ ID NO: 2676 - protein, 369 aa, Leisingera caerulea
MYDFSKRISSFHNQQVRLSNDQRADMKRRRETNLERIEKGLEELEKPAFKETINQGGYAQKTMTQPPESDQESRYDIDLGIVFDQDDAKGPRTTRDWVRQAIARKATNMKNDPVTKKKCVRVVYADGYQCDFPVFRRRWTDAGWRYELSSGDEWVASDPAAMNQWIEREVSWKSPETSGSYQLRRIIRFGKFFSKTHAARLKRSFPGGLVATALFIECYTADDGRDDRSFRETLSSLSQRSKYTPVFANGVQVSDDKDTDRIGRLIDQAKDSVKELDKLDADDITDSDANKVWKTVFRHSFFDGASKNAANSSSAPFETKSALGGAGLAAPFLASKAAAALSDSEKQSRMESAVNARKESGSGGKPWAE

SEQ ID NO: 2677 - protein, 369 aa, Ruegeria mobilis
MYDFSKRISSFHNQHVRLSNDQRADMKRRRETNLDRIEKGLEELEKPAFKETINQGGYAQKTMTQPPESDQESRYDIDLGIVFNQDDANGPRTTRDWVRQAIARKATNMKNDPVTKKKCVRVVYADGYQCDFPVFRRRWTDVGWRYELSSGDEWVASDPAAMNQWIEREVSWKSPETSGSYQLRRIIRFGKFFSKTHAARLKRSFPGGLVATALFIECYTADDGRDDRSFRETLRSLSQRSKYTPVFANGVQVSDDKDTDRIGRLIDQAKDSVKELDKLDADDITDSDANKIWKTVFRHSFFDDASKNAANSSSAPLETKSALGGAGLAAPFLASKAAAALSDSEKQSRMESAVNARKESGSGGKPWAE

SEQ ID NO: 2678 - protein, 369 aa, Confluentimicrobium sp.
MYDFSKRISKFHQDQVRLTNGQRADMRRRRETNLERIEKGLEETNKPSLAETINQGGYAQKTMTQPPENDEESRYDIDLGVVFEEDDAAGPRTTRNWVRDAIARKATNLKNEPETKKKCVRVVYADGYQCDFPVFRRKWSEVGWKYELSSGDEWVSSDPAAMNKWIETTVSAKSPETSGSYQLRRIIRLGKFFSKTHSSRLNRKFPGGLVATALFIEAYTSVDGRDDEAFRETLRALSNRSRYSPVYANGIQVSDDKDTDRIGRLIDQAEESVKELDKLDADDATDTDANKVWKSVFRHSFFEEETKEAANSASAPLEKKSALGAAGLAAPFLASQAAAALSDSDKHSRMEAAVSARKESGSGGKPWSK

SEQ ID NO: 2679 - protein, 366 aa, Mameliella alba
MYDFSKQVRKFHEDHVRLTSGEQSDMRSRRERNLKRIEDGLEELDKPKVAETINQGGYAQRTMTQPPENDVDSRYDIDLGIVFEQDDAKTPRTTRDWVRQAIARKGSGFKNDPVTKKKCVRVVYSNGYQCDFPVFRRRWTEVGYRYELSSGDEWVASDPAAMNEWIKNKVALSPVTDGSYQLRRIIRYGKFYSKTHAHRLRASFPGGLVATAIFIECYVEVDGRDDEAIRETLRNISLRSKYTPVYANGDQVSDAKDEDRIGRLIDQAKASVEELDKLDGDVGEKEARKAWRKVFVHSFFDEPKEDASSAAKGALETKSALSSGFAAPALASGIAAALSDEARADRLRGAAEARNSEGATSKPWAK

SEQ ID NO: 2680 - protein, 345 aa, Desulfomicrobium baculatum
MTTINTHAELFAFYGGEVKLPEDKRKEMKERRKTNRNRLKNGLIKNMMPTPTHHLIQGSYAMYTMVQRPDDDYDIDDGACFSRDDLKGAQGADKTALAARQMVRDAIDDGSFKKKPECLPKCVRVHYAAGYHVDIPVYREWTDDDGTEHRELAAADWIESNPQIITNWFKKVVPEKSPEDNQPYQMRRLVCLLKAWSSSRASWNLPSGLIFSVLVDELYVPRRDRDDNAFHALLKALKCRLDRGDKTAQHPAPDLDEDFASGREAKMDNLQAKLNEWLPKLEILDDPDCTKNQALDAWNKFFNTHYFDQYIEDEEEDNPENRNCFVATGGIPKKAVDKGGDTTFG

SEQ ID NO: 2681 - protein, 345 aa, Desulfomicrobium baculatum; identical to SEQ ID NO: 2680

SEQ ID NO: 2682 - protein, 345 aa, Desulfomicrobium norvegicum
MTTVNTHAELFAFYGSEVKLPEDNRKEMKERRKTNRKRLNNGLIKNKMPTPTHHLIQGSYAMYTMVQRPNDDYDIDDGACFSRDELKGAQGADKTALAARQMVRDAIDDDSYRFKKKPECLPKCVRVHYATGYHVDIPVYREWTDDDGTEHHELAAADWIESDPQIITNWFKKVVPEKSPEDNQPYQMRRLVCLLKAWASSRESWNLPSGLIFSVLVDELYVPQRDRDDIAFHALLKTIKARLDRGDKTAQHPDPETDENFASGREAKMDSLQAKLDEWLPKLEILDDPDCTKKQALDAWNKFFNTHYFDQYIEDEDNPENRNCFVAMGGIPKKAVDKGGDTTFG

SEQ ID NO: 2683 - protein, 388 aa, Parvularcula bermudensis
MCFSAIARSVAIFLASSNMIDCHKHVVAYHNDEITLPEAERGEMRNRRNANRNRIKTRLKANEKPAPAFFASQGSYADKTMVQYPDKDYDIDDGVYFRKEDLLGPNGGEMTALLARKMVFDAINDGSFKTPPELHTNCIRVLYAAGYNVDVPVYRIVTETDIFGNETAYVELAGADWIRSDARDVSTWFDDVNQSRSPDTENGRQFRRIVRDIKKLTNSRKSWRKRILSGYGVTILAAECYVPFAGRDDYSLHATLRAMHNRLKFSLALQSPVEPYDHVADHDDARSKYFRARLDDLESCLDDIAAAETEDEALDAWSDLYGDDYFSDRKAKAQTEALETKSADGSLLGLGLAAAGIAAGAAALSAARAKPSWEPSQAVSKGGGRTNA

SEQ ID NO: 2684 - protein, 388 aa, Parvularcula bermudensis; identical to SEQ ID NO: 2683

SEQ ID NO: 2685 - protein, 365 aa, Rhodospirillaceae bacterium
MYNCHKDILAYHNDKVMLSKVEQDEMRDRRDTNRQRLRDGLKRDGEPALSGFQSQGSYAHRTMVQHPEKDYDIDDGAYFWKKDLKGPNGGDKSARDAKEMVHKALHDDRFKKPPEVRTNCVRVYYNAGYHLDVPVYRKVKTKNISGEEEIYYEIASSDWKKADPVEVTHWFNRENECQSPDTTNGRQLRRQTRLNKALARSRESWRPRIATGFMITTLIVNECYRPNAKREDRSLYDTMVAMQGHLKWNLEIEHPTVQDEKLTKGSNDACTRLLREKLDWLIDELQVLFESDCTREKALKAWDKVFNTDFFSTRLKDAEDKEKSTHDGAATADFSAGLTTAILTNRSEAREPDRPVEKQGGGRYA

SEQ ID NO: 2686 - protein, 348 aa, Methylocystis sp.
MFNCAKDVRAYHDQDVTLPKTEQDAMHDRRNSNRTRLRNGLSAAGKPAPLEFVKQGSYAMKTMVRDPDNDYDIDDGVYFRKGDLVGERGAEMTSLQARQMVRDAVDDGKFKRAPEVRPNCVRVFYEKGYHIDLPVYRRVTTSTVFGEEYHYELAASSGWKRSDARDVSDWYEDGRAKSSDGVQFRRINRDLKKYARSRYSWRSGILSGFGITVLNTECFRVNEREDRALYDTMVAIRDRLNWDLQIAHPVTPGDYITSGPDDAKARCFREKLTEAIDMLQPLFEADCTREKALKCWDKVFATTFFGERLEEEQRASVAAPAIIGSAALLSATAAASSAVSSAGGGRHA

SEQ ID NO: 2687 - protein, 348 aa, Gluconacetobacter diazotrophicus
MFDCAVDVRAYHDQDVTLPKSEQDAMRDRRDSNRRRLRNGLDKAGKPKPIEFVKQGSYAMKTMCRDPDNDYDIDDGVYFHKKDLVGDRGAEMTSLQARWMVRDAVDDGKFKRAPEVRSNCVRVFYEKGYHVDLPVYRRVVTDTVFGEEVHHELAASSGWKRSDARDVSDWYEDQRAASADGIQLRRINRDLKKYARSRYSWRGSILSGFGISVLTTEKFRANDREDRALYDTMVAIRDRLNWNLVVAHPVTPGDTITSGSDDAKARCFREKLTEAIDTLKPLFDADCTREKALNCWDKVFATTFFGERLEEEQRASVAAPAIIGSAALLSATAAAASAVSSAGGGRHA

SEQ ID NO: 2688 - protein, 348 aa, Unknown
  Description of Unknown: Shinella sequence
MFDCSKDVRAYHDQDVTLPKSEQDAMRDRRNSNRTRLRNGLDKAGKPKPIEFVKQGSYAMKTMCRDPDNDYDIDDGVYFHKKDLVGDRGAEMTSLQARWMVRDAVDDGKFKRAPEVRSNCARVFYEKGYHVDLPVYRRVVTDTVFGEEVHYELAASSGWKRSDARDVSDWYEDQRTASANGIQLRRVNRDLKKYARSRYSWRGSILSGFGISVLTTEKFRANDREDRALYDTMVAIRDRLNWDLVVAHPVTPGDTITSGSDDAKARCFREKLTEAINTLEPLFDPDCTRETALNCWDKVFATTFFSERLEEEQRASVFAPAIIGSAALLSATAAAASAVSSAGGGRHA

SEQ ID NO: 2689 - protein, 348 aa, Unknown
  Description of Unknown: alpha proteobacterium sequence
MFDCSKDVRAYHDQDVTLPKTEQDAMRDRRDSNRKRLRDGLAKAGKPKPIEFVKQGSYAMKTMCRDPDNDYDIDDGVYFHKADLVGDRGAEMTTLQARQMVRDAVDDGRFKRAPEVRSNCVRVFYEKGYHVDLPVYRRVVTETAFGEEVHYELAASSGWKRSDARDVSDWYEDERAASSDGVQLRRVNRDLKKFARSRYSWRGSILSGFGISVLTTEKFRANTSEDRALYDTMVAIRDRLDWNLQVAHPVTPGDYITSGPDDAKARCFREKLTEAIDTLAPLFDADCTREKALKCWDKVFATTFFSERLEEEQRASVAAPAIISAAALLSATAGAAQAVSSAGGGRHA

SEQ ID NO: 2690 - protein, 348 aa, Brevundimonas diminuta
MFDCSKDVRAYHDQDVTLPKTEQDAMRDRRNSNRTRLRDGLAKAGKPKPIEFVKQGSYAMKTMCRDPDNDYDIDDGVYFHKDDLAGDRGAEMTSLQARQMVRDAVDDGRFKRAPEVCSNCVRVFYEKGYHVDLPVYRRVVTETVFGDEVHYELAASSGWKRSDARDVSDWYEDERASSADGVQLRRINRDLKKFARSRYSWRGSILSGFGISVLTTEKFRAADREDRAFYDTMVAIRDRLSWNLQLAHPVTPGDYITSGPDDAKARCFREKLTEAIDTLAPLFDADCTREKALKCWDKVFATTFFSERLEEEQRASAAAPAIISAAALLNATATAAQAVSSAGGGRHA

SEQ ID NO: 2691 - protein, 348 aa, Unknown
  Description of Unknown: Rhizobiales sequence
MYDCAKDVRAYDDQEVTLPKSEQDAMRDRRDANRTRLRNGLANANKPAPLEFIKQGSYAMKTMVRDPDNDYDIDDGVYFRKEDLVGERGAEMTSLQARQMVRNAVDDGKFKRAPEVRSNCVRVIYEKGYHVDLPVYRRVVTSTAFGDEVHYELAASSGWKRSDARDVSDWYEDERAKSADGVQLRRINRDLKKYARSRYSWRGGILSGFGITVLTTERFRVNNREDRALYDTMVAIRDRLNWDLQVVHPVTPGDYITSGSDDAGARCFRDKLTEAIDTLQPLFETDCTRERALKCWDKMFATTFFSERLEEEKRAAVAAPAIIGSAALLGATAAAAAAVSSAGGGRHA

SEQ ID NO: 2692 - protein, 348 aa, Bosea sp.
MYDCAKDVRAYHDQEVTLPKTEQDAMRDRRDANRTRLRNGLANAGKPAPFEFVKQGSYAMKTMVRDPDNDYDIDDGVYFRKEDLVGERGAEMTSLQARQMVRDALDDGKFKRAPEVRSNCVRVFYEKGYHVDLPVYRRVVTSTAFGEEVHYELAASSGWKRSDARDVSDWYEDERTKSADGVQLRRINRDLKKYARSRYSWRGGILSGFGITVLTTERFRVNDREDQALYDTMVAIRDRLSWDLQIAHPVTPGDYITSGSDDARARCFRDKLTEAIDTLQPLFETGCTRERALKCWDKVFATTFFSERLEEEKRAAVAAPAIISSAALLGATTAAAAAVSSAGGGRHA

SEQ ID NO: 2693 - protein, 348 aa, Paracoccus solventivorans
MFDCAKDIRAYHDQDVTLPKTEQDAMRDRRNSNRSRLRNGLAAAGKPAPLEFVKQGSYAMKTMVRDPDNDYDIDDGVYFRKEELVGERGAEMTSLQARQMVRDAVDDGKFKRAPEVRRNCVRVFYEKGYHVDLPVYRRVVTSTVFGDEIHYELAASSGWKRSDARDVSDWYEDERARSADGVQLRRINRDLKKYARSRYSWRGGILSGFGISVLLTERYRQNEREDRALYDTMVAIRDRLNWNLQVAHPVTPGDYITSGDDDARARSFRDKLTEAIDTLQPLFEVDCTRERALKCWDKVFATTFFSERLEEERRAAVAAPAIISSAALLGSTAAAAAAVSSAGGGRHA

SEQ ID NO: 2694 - protein, 348 aa, Unknown
  Description of Unknown: Afipia sequence
MFDCSKDVRAYHDQEVNLPKNEQDAMRDRRNANRTRLRNGLADACKPAPLEFVKQGSYAMKTMTRDPDNDYDIDDGVYFRKEDLVGDRGAEMTALQARQMVRDAVDDGKFKKPPEVRSNCVRVYYEKGYHVDLPVYRRVTTSTVFGDVVHYELAASIGWKRSDARDVSDWYEDERAKSADGIQLRRINRDLKKYARSRDSWRSGILSGFGISILTVERFRHDEREDRALYDTMVAIKGRLNWDLQVKHPVTPGDYITNGSDDARARCFRDKLIEAIDDLQPLFDADCTRERALKCWDKVFATTFFSERLEEEKRAAVAAPAIITSGALLSQTAAAAAAVSSAGGGRHA

SEQ ID NO: 2695 - protein, 348 aa, Sphingomonadales bacterium
MFDCSKDVRAYHDQDVTLPKSEQDAMRDRRDSNRTRLRNGLEKAGKPNPIEFVKQGSYAMKTMCRDPDNDYDIDDGVYFEKDDLVGDRGAEMTSLQVRQMVRDAVDDGKFKRAPEVRSNCVRIFYEKGYHVDLPVYRRVVTTTTFSEDVHYELAASSGWKRSDARDVSDWYEDERTASADGIQLRRINRDLKKYARSRYSWRSAILSGFGISVLITERFRVSDREDQALYDTMVAIRDRLDCNLVVAHPVTLGDTITNGSDDAKARCFREKLTEAIDALDPLFDPNCTREKALKCWDKVFATTFFSERLEEEQRASVAAPAIIGSAALLGATSAAASAINSAGGGRHA

SEQ ID NO: 2696 - protein, 348 aa, Thioclava sp.
MFDCSKDVRAYHDQDVTLPKAEQDAMRDRRDSNRKRLQNGLEKAGKPKPTEFFKQGSYAMKTMCRDPDNDYDIDDGVYFHKEDLVGDRGAEMTSLQARWMVRDAVDDGKFKRAPEVRSNCVRIFYEKGYHVDLPVYRRVVTETIFGEDVHFELAASSGWKRSDARDVSGWYEDQRAASIDGIQLRRINRYLKKYARSRFSWRGSILSGFGISALTTEKFRANAREDQALYDTIVAIRDRLDWDLEIAHPVTPGDYITSGSDDSKSRYFREKLTSAIETLEPLFDDDCTREKALKCWDKVFATTFFSERLEEERRASVAPGAAIGSGALMSATAAAADAVSSAGGGRHA

SEQ ID NO: 2697 - protein, 348 aa, Ochrobactrum anthropi
MFDCSKDVRAYHDQDVTLPQTEQDKMRNRRDANRTRLRNGLQKADKPSPLEFVKQGSYAMKTMVRDPDNDYDIDDGVYFAEEDLVGERGAEMTSHQARSMVRDAVDDGKFKRAPEVRSNCVRIFYEAGYHVDLPVYRRVTTSTIFGDVYHYELAASSGWKRSDARDVSAWYETERSNSSDGRQLRRINRDLKKFARSRFSWRSSILSGFGITVLLTERYQYSSREDKAFYDTMVSIRNRLDWNLQIAHPVTPDSYITNGNNDARARFFRDKLNDAIDMLAPLFDADCTREKALKCWDKVFATAFFSERLEEEKRASAFAPAIIGSAALLGQAGAAAAAVSSAGGGRHA

SEQ ID NO: 2698 - protein, 348 aa, Agrobacterium rubi
MFDCSKDVRAYHDQDVTLPQTEQDKMRNRRDANRARLRNGLQKADKPSPLEFVKQGSYAMKTMVRDPDNDYDIDDGVYFAKEDLVGERGAEMTSHQARSMVRDAVDDGKFKRAPEVRSNCVRIFYEAGYHVDLPVYRRVTTSTVFGDVYHYELAASSGWKRSDARDVSAWYETERSNSSDGRQLRRINRDLKKFARSRLSWRSSILSGFGITILLTERYQYSTREDKAFYDTMVSIRNRLDWNLQIAHPVTPDSYITNGNDDARARFFRDKLNDAIDMLAPLFDADCTREKALKCWDKVFATTFFSERLEEEKRADAFAPAIIGSAALLGQAGAAAAAVSSAGGGRHA

SEQ ID NO: 2699 - protein, 348 aa, Agrobacterium vitis
MFDCSKDVRAYHDQDVTLPQTEQDKMRNRRDANRKRLRNGLQKADKPSPLEFVKQGSYAMKTMVRDPDNDYDIDDGVYFAKEDLVGERGAEMTSHQARSMVRDAVDDGKFKRAPEVRSNCVRIFYEAGYHVDLPVYRRVTTSTVFGDVYHYELAASSGWKRSDARDVSAWYETERSNSSDGRQLRRINRDLKKFARSRFSWRSPILSGFGITVLLTERYQYSTREDKSFYDTIVSIRNRLAWNLRIAHPVTPDSYITNGNDDARARFFRDKLTDAIDMLAPLFDADCTREKALKCWDKVFATTFFSERLEEEKRANAFAPAIIGSAALLGQAGAAAAAVSSTGGGRHA

SEQ ID NO: 2700 - protein, 348 aa, Ensifer aridi
MFDCSKDVRAYHDQDVTLPQTEQDKMRNRRDANRTRLRNGLQKADKPGPLEFVKQGSYAMKTMVRDPDNDYDIDDGVYFAKEELVGERGAEMTSLQARSMVRDAVDDGKFKRAPEVRSNCVRIFYEAGYHVDLPVYRRVTTSTIFGDVYHYELAASSGWKRSDARDVSAWYEAERSNSSDGRQLRRINRDLKKFARSRFSWRSSILSGFGITVVLTERYQYSTREDKSLYDTMVSIRNRLNWNLEIAHPVTPESYITNGNDDARARFFRDKLTDAIDMLAPLFDTDCTREKALKCWDKVFATTFFSERLEEEKRANAFAPAIIGSAALLGQAAAAAAAVSSAGGGRHA

SEQ ID NO: 2701 - protein, 348 aa, Ochrobactrum pseudogrignonense
MFDCSKDVRAYHDQDVTLPQTEQDKMRNRRDANRTRLRNGLQKADRPSPLEFVKQGSYAMKTMVRDSDNDYDIDDGVYFAKEDLVGDRGAEMTSLQARSMVRDAVDDGKFKRAPEVRSNCVRIFYEAGYHVDLPVYRRVTTSSIFGDVYHYELAASSGWKRSDARDVSAWYERERSNSSDGRQLRRINRDLKKFARSRFSWRSSILSGFGITVLLTERYQYSSREDKALYDTMVSIRNRLNWNLQIAHPVTPDSYITNGNDDARARCFRDKLSDAIDMLAPLFDADCTREKALKCWDKVFATTFFSERLEEEKRAGAFAPAIIGSATLLGQAAAAAAAVSSSGGGRHA

SEQ ID NO: 2702 - protein, 349 aa, Sinorhizobium meliloti
MFDCSKDVRTYHDQDVTLPQTEQNKMRNRRDANRTRLRNGLQKAGKPGPLEFVKQGSYAMKTMVRDPDNDYDIDDGVYFAKEDLVGERGAEMTSLQARWMVRDAVDDGRFKQAPEVRSNCVRIFYEAGYHVDLPVYRRVKTSSIFSDDVYHYELAASSGWKRSDARDVSAWYKDERSKSSDGRQLRRINRDLKKFAGSRFSWRSSSLSGFGITVVLTESYQYSTREDKALYDTMVSIRNRLDRNLQIAHPVTPDSYITNGNDDARARFFRDKLTDAIDMLAPLFDSDCTREKALKYWDKVFATTFFSERLEEEKRANAVAPAIIGSAILLGQAAVAAAAVNSAGGGRHA

SEQ ID NO: 2703 - protein, 345 aa, Sphingomonadales bacterium
MYDCDNDVCAYHKDKVTLPKTDQDAMRARRDANRKRLREGLKKAEKPSPSEFVKQGSYAMKTMLRDDDNDYDIDDGVYFWKEDLVTSGGGEMTSLQARNMVRDAVDDGSFKTDPEVRGNCVRIYYEKGYHVDVPVYRKYENEDGKLVNELASSSGWKRSDARDVTGWFDDQRSACSDGTQLRRLVRLIKKFAKSRSSWKGSILSGFGITVLVIECQRIDGREDKALYDTMKAVRDRLSWNLVVDHPVTPGDTITSGEEDAKARFLRDKLTQALDWMAPLFEWDCTRDKALGCWDKVYNTTYFSERGEEEARAAASYAAPLASTAALVGLESRSSAAVLSSGTRHA

SEQ ID NO: 2704 - protein, 346 aa, Sphingomonas sp.
MYDCDKDVCAYHKDEVTLPKTDQDSMRSRRDANRKRLRDGLSKANDPAPSEFVKQGSYAMKTMLRDAANDYDIDDGVYFWKEDLVGDRGAEKTSIQARWMVRDAIDDGSFKTAPEVRSNCVRVFYEKGYHVDVPVYRKSEDDDGNMVHELASSSGWKRSDARDVTQWFEDERSNSTNGTQLRRLVRLIKKYAKSRSSWKGGILSGFGITVLVTECQRIDSREDQALYDTMKAIRDRLNWNLVVKHPVTPNDTITSGDNDAKARMLRDKLTQALDWLAPLFEWDCTREKALGCWDKVFNTTYFSERGEEEARAAASYAAPIATSAALIGLESRTSASVLTSGGGRHA

SEQ ID NO: 2705 - protein, 346 aa, Sphingomonas adhaesiva
MYDCDKDVCAYHKDEVTLPKTDQDSMRSRRDANRKRLRDGLSKANDPAPSEFVKQGSYAMKTMLRDAANDYDIDDGVYFWKEDLVGDRGAEKTSIQARWMVRDAIDDGSFKTAPEVRSNCVRVFYEKGYHVDVPVYRKSEDDDGNMVHELASSSGWKRSDARDVTQWFEDERSNSTNGTQLRRLVRLIKKYAKSRSSWKGGILSGFGITVIVTECQRIDSREDQALYDTMKAIRDRLNWNLVVKHPVTPNDTITSGDNDAKARMLRDKLTQALDWLAPLFEWDCTREKALGCWDKVFNTTYFSERGEEEARAAASYAAPIATSAALIGLESRTSASVLTSGGGRHA

SEQ ID NO: 2706 - protein, 345 aa, Sphingomonas sp.
MFDCSKDVRAFHDKQVVLSQAEQTAMRDRRDANRRRLRKGLADNGNPAPIEFVKQGSYAMKTMLQHPQNDYDIDDGVYFRKDDLVGSRGAAMSALDARWMVRDALDDGSFNDAPEVRPNCVRVFYAAGFHVDVPVYRRVDTNGSYSYELASGAGWRRSDARDVTAWFDRELNASGQTYLLRRLVRHVKKFARSRSSWSGRILSGFGITVLVVENRHLDVARDDRAVHETMRAIKQRLDWNLVVSHPVTPGDTITSGDSDGKASFLRSKLDEALGWMEPLFEADCTREKALSCWDKVYNTDFFSARYKEERAAAFACRVGIGSAALMALEAPTAAAVVGAGGGRHA

SEQ ID NO: 2707 - protein, 351 aa, Bradyrhizobium sp.
MYDCSDDVLAYHDDEVTLPGAERTAMRKRRDANRERLTKGLSEAKKPAPLQFKSQGSYAMRTMTQHPDNDYDIDDGVYFAKEDLVGERGAEMIALQARQMVRDAVDDGGFKTPPEVRNNCVRVYYKAGYHVDLPVYRRVTAKDAFGNESHFYELASTDWKRSDARDVTAWFDKENDAQSPDTENGRQLRRVVREIKKYARSRSSWKAQILSGFGITKLVTECFHGVADREDKALHDTMKAIRDRLKWNLVVQHPVTPGDTITKGNEDPKAKFLREKLDEALANLAPLFDSDCDSQKALKCWDKVYATEFFSDCYKPVSKASSSVAAPALAGLFSGREPEAAVRKDGGGRYA

SEQ ID NO: 2708 - protein, 357 aa, Rhodopseudomonas pseudopalustris
MFNCHDDVLAHHDEKVTLPQSERTTMRDRRNANRDRLKKGLKEKKKPTPLEFKSQGSYAMKTMVQHPEKDYDIDDGVYFAKEDLLGERGAEMTALQARQMVRNALDDGSFKTPPEVRNNCVRVYYEAGYHVDVPVYRRVTTKDVFGTETYHYELASTDWKRSDARDVTEWFDKENTRQSPDRENGRQLRRVTRHIKKYARSRDSWSGQILSGFGITKLVTECFRSDADREDKSLHDTMKAIRDRLNINLVVQHPVTPNETITKGNDDANARFLREKLTEAVDNLAPLFEADCTRKKALGCWDKVFATNFFTDRLEKAAKAAAEASVAAPSIISAGLLSSAAAASQNAVRKEGGGRYA

SEQ ID NO: 2709 - protein, 355 aa, Rhizobiales bacterium
MYDCHKDVLAHHDKKVTLPQSERTEMRDRRNANRDRLKRGLKDKGKPAPREFKSQGSYAMKTMLQHPDNHYDIDDGVYFDKEALVGERGAEMTALQARQMVRDAIDDGGFKTPPEVHKNCVRVIYAAGYHVDLPVYRRVTTKDAFGNETYHHELASSDWKRSDARDVTEWFEKENNAQSPDTENGRQLRRITRHIKKHSRSRDSWGSQILSGFGITKLVTECFRGNAEREDAALHDTMKAIRDRLNGNLVVKHPVTPNETITKGDDDAAARFLRDRLTEAVDNLAPLFEADCTRKQALNCWDKVFNTSFFSDRLEASTKAAATVAAPSILTAGLVASAGAAARSAVRKEGGGRYA

SEQ ID NO: 2710 - protein, 353 aa, Sinorhizobium sp.
MYNCANDILAYHDDEVTLPQAERTNMRGRRDANRERLKKGLKDKDKPAPREFASQGSYAMKTMTQHPAKDYDIDDGAYFEKAVLIGERGAEMTALQARQMVRDALDDGSFKTPPEVRKNCVRVYYLAGYCVDVPVYRRVATKDIFGNESYHHELASSDWKRSDARDVSKWFEAENTKQSPDTVNGRQLRRVVREIKKYARSRESWSGQILSGFGITKLVTECFRGDMWREDRALYETMKAIRDRLNWNLVVAHPVTPDQPITKGTDDPRARFLRARLTEAIDTLAPLFEHDCTRTKALKCWDKVYATSFFSDRDASKPEKKSALLKVASVAPPAGIFTFPNAPRADDKPRGFG

SEQ ID NO: 2711 - protein, 357 aa, Stappia indica
MYDCADDVLAYHDEKVTLPQSERTAMRERRDANRERLKKGLRDQDKPAPREFKSQGSYAMKTMVQHPQKDYDIDDGVYFDKEVLVGARGAEMTALQARQMVRDAIDDGSFKTPPEVRKNCVRVYYAAGYHVDVPVYRRVTTKDVFGNETHHYELASSEWKRSDARDVTAWFDEENAAQSPDTGNGRQLRRLVREIKKYARSRGSWGSQILSGFGITKLVTECFRRNADREDKALYDTMKAMRDRLKLNLVVEHPVTPGETITKGTDDPKARFLRDKLTEAIDNLAPLFEPDCTREKALKCWDKVFNTTFFSDRLEKASELETKSATGASTILTSGLLSSAAAVAQTAVRKEGGGRYA

SEQ ID NO: 2712 - protein, 358 aa, Unknown
  Description of Unknown: Aureimonas sequence
MYDCSNDILAYHDERVTLPDPERTEMRNRRDSNRDKAWRGLEREGDPTPIEFRSQGSYAMRTMVQHPSKDYDIDDGVYFWKEDLVDEKGRELSARQVKEMVRDAVDDGNLSTPPEVRRNCVRVQYAKGYHVDIPCYRRVTTKDWLGNESHHHELAGPTWKRSDARDVTGWFKSENEAQSPDTSNGRQLRRVTREIKMFARSRAGWSGKILSGFGITKLVTETYRAHATREDVALYDTMRAMRDRLEVNLVVDHPVTPAETITTQGPDGSGDPKAAYLRDRLSEALDDLASLNEADCTRERALATWDRAFATTFFGARKEPAKVAAGVATPSVLSSGFWADREAAAASAVRKEGGGRHA

SEQ ID NO: 2713 - protein, 357 aa, Thalassospira sp.
MYNCAEDVLAHHDEEVTLLQADRDTMRERRNANRDRLKKGLAAKGKPAPREFKSQGSYAMKTMVQHPEKDYDIDDGVYFDKEVLVGDRGAEMTALQARQMVRDAVDDGSFKTPPEVRKNCVRIYYTAGYHVDMPVYRRVTTKDIFDNETYHYELASSSWKRSDARDVTAWFENENTAQSPDTKNGRQLRRITRQIKKFARSRGSWSGQIISGFGITKLVTERFRANSDREDQALYDTMKAIRDRLNYDLVVAHPVTPNETITNGDEDPKSRFLRDKLTEAINNLAPLFESDCTREKALKCWDKVFNTDFFIGREKADAGLEAKSALAAPAVLAADMVASAAAAAESAVRKEGGGRYA

SEQ ID NO: 2714 - protein, 345 aa, Geoalkalibacter ferrihydriticus
MKDCSKDVLAYHDDKVTLPQAERTNMRDRRDANRERLRKRLKERENPSPQEFVKQGSYAMLTMVQDAANDYDIDDGVYFTQASLKGSKGGDKPAMEARQMVCDALADSRFNKAPEVKRNCVRVFYNDGYHVDMPVYRIRTSDGDYELASGSDWKHSRAADVEEWFNQANQTKSPDENNGRQFRRIVRLLKKFAKSRNSWKSQTASGFSITILAEEQYVSNKDREDAALRDTMNKIYNRLLWNLEVSHPVTPGAKVTKGPDDTKMRVFRDKLKEALDNLAVLDDADCTREKALKAWDKVFNTDYFMSRYKGEEKVKDSENSAFLSSLIATKSEPVAVQKNGGGRFA

SEQ ID NO: 2715 - protein, 347 aa, Sulfurifustis variabilis
MYDNSKDVLAYHDEKVTLPQDERTVMRKRRDANRERLKTRLKDAAKPTPHEFIKQGSYAMLTMVQDPDKDYDIDDGIYFTQASLKKDDGTDMSPREAKEMVRDALRDDRFNKQPEVKKSCVRVFYEEGYHVDMPVYRIRESDGKYELASDDGWTVSRAADTEDWFNKTNKEKSPDAGTNGGQFRRCVRLMKKFGRSRRDWKKDIAPGFTITKLVEECFIANGAREDVALRDCMQRVYNRLLGSLEVQHPVAQEAMLTSGPDDPGTKLLRDKLKDALEELKVLDDSKCTATQAAKAWDKVFNTDFFSVRQAAAEKAATAQHNTNALAGFIATKSDPRLTEKRGGGRFA

SEQ ID NO: 2716 - protein, 340 aa, Alphaproteobacteria bacterium
MFDCSKDLLAFHKAEVALPKDERDNMRERRDANRKRLKDGLAKAKNAAPWDQASQGSYAMWTMVQLPDGDHDIDDGVYFLRDDLKGAQGADMTALAARQMVRDAIDDGSFAKKPEVRKNCVRIYYAEGYHVDIPVYRVTIGKDVFDKETYLYELASSDWKKSDARDVTRWFNDKNKERSPDFESTEGQMRRVVRYIKFYVKSRASWTGILSGFGITKLVTEKYWANADREDVALYETIKAIRDRLQFNLVVTHPIQGNGDITNGVDDARARKLKEKLDDALAALKPLFVHNCTRETALGCWDKVFATKFFCDRLESKKSEEAAALSASRVMTDGLLSAAA

SEQ ID NO: 2717 - protein, 345 aa, Mesorhizobium sp.
MFDCHDDMTAFHNSEVQLPKDERDTMRDRRDTNRKRLKDGLKRDEEPAPVGCRTQGSYAMRTMIQHAELDYDIDDGVYFDKDKLVGPRGGGKTAADAKEMVRKAVHDDKFKKAPEVLKNCVRIYYDLGYHVDVPVYRRVEENQEYVYELASTDWKKSDPMAVTAWFKDENKAQSPDQLNGGQMRRIVKLMKAFARSRESWRSQIAPGFMITKLVTERLSKNADHDDVSLRRTMESVHSRLEGSLEVDHPVVYGVKLTRGPDDSRAKLLRDKLKWAIDELAVLDDADCSQADARKAWDKVFKTEFFTDHGATKKAEAVVTSAAILRGDYAEAGREAVDKRGGGRYG

SEQ ID NO: 2718 - protein, 345 aa, Paracoccus sanguinis
MFNSHDDMTAFHNDKVRLPVAERDAMRDKRNTNRTRLKDGLKRDGEPKPVGCHTQGSYAMRTMIQHAAKDYDIDDGVYFDKSDLVGWGGADKSAAAAKEMVRKAVHDDKFKQAPKCLKNCVRVYYDAGFHVDIPVYRRVQKDGNEVYELASSDWKASDARAVTNWFKDANKNKSPNTDNYGQMNRVVKLMKAFARSRESWRSRIATGFMITKLIDEKYLALDDRDDQVLRDTMRAIHTRLEWSLVINHPVLDETLTKGDDDARAKFLREKLEWALGELGILDKWDCTEEQARNAWDNVFNTDFFSGRSSSKKAEASVTSASVLLAATERATAQSAFDKRGGDRYG

SEQ ID NO: 2719 - protein, 344 aa, Thalassospira lucentensis
MFDCHKLLLKYHNENVGLSTGDRKEMRERRNANRKRLKAGLKKEGKPNPLGCYSQGSYAMWTMIQDDNKDYDIDDGVYFDKAALVGPKGGDKTARDAKEMVQNAVSDDKFKKEPDCRTNCVRVYYDAGYHVDIPVYRQITNGAGEVEFELASSDWKKSDPLAVTKWFKEQVKEQSPNTVNGGQLRRVTKLLKAFARSRLSWRASMVSGFVISKLVTEVYVPNDEREDLSLRDTMQAIVDRLDYNKEVEHPVLDECLTSGPDDPKVTFFKDKLAWALGKLDSLNQQDCSASQAHKVWNLVFSTEFFPVDDEEKNATRTSSSILKDGSLAGASEAAVDRRGGDRYG

SEQ ID NO: 2720 - protein, 349 aa, Afipia sp.
MKDCNEQVKGFERTEVRMSDDGRADIYAKAKTNRRRLKSGLERDGNPKAIGQRTQGSYAMRTMIQSDRGDYDVDDGVYFTRESLQNDKGEDKSAQNARKMVCAGLQDDRFADQPDVRSNCVRVYYKNEGYHVDVPVYREIRTKNLFTGEETKSYEIAAGDDWRKSDPLANTAWFKNENKTKSPDATINGNDGQFVRVVRLVKDFARSRSGWSDKISSGFVISKLVSDNFVRSDDRDDYAFRHTLKAISAKLSWSDAVKHPVLEENIAEAGDEKTKFLKEKIDENLEHLDVLDGYWCTHEEAMQAWDAVFNTDWFSKQPDPSKKSKIEKASGPAVIKQGETRYAKENRYA

SEQ ID NO: 2721 - protein, 315 aa, Bradyrhizobium sp.
MKNCNDQVAGFERVEVRMSDDDRADIYSKAKANRKRLKSGLERNGSPKSIGSRTQGSYAMRTMIQNDRGDYDVDDGIYFTRDSLKNEQGEEKSASDARKMVCAALQDERFADQPDVRNNCVRVYYKNEGYHVDVPVYRENRTTNPFTGTETKSYEIAAGDKWRTSDPLANTTWFKDENKNKSPDATANGNDGQFVRLVRLVKAFARSRYGWSSKITSGFAISKLVSDHFVQSDRREDYAFRQTMKNISARLAWNDSIRHPVLDENIAESGDDKTKFLKEKIDENLKHLDVLDKLDCTHDEAMKAWDSLFFTDWFS

SEQ ID NO: 2722 - protein, 349 aa, Bradyrhizobium sp.
MKNCNDQVAGFERVEVRMSDDDRADIYSKAKANRKRLKSGLERNGSPKSIGSRTQGSYAMRTMIQNDRGDYDVDDGIYFTRDSLKNEQGEEKSASDARKMVCAALQDERFADQPDVRNNCVRVYYKNEGYHVDVPVYRENRTTNPFTGTETKSYEIAAGDKWRTSDPLANTTWFKDENKNKSPDATANGNDGQFVRLVRLVKAFARSRYGWSSKITSGFAISKLVSDHFVQSDRREDYAFRQTMKNISARLAWNDSIRHPVLDENIAESGDDKTKFLKEKIDENLKHLDVLDKLDCTHDEAMKAWDSLFFTDWFSKQPDPSKKSQVEKASGPAVIKQGETRYAKERRHA

SEQ ID NO: 2723 - protein, 315 aa, Bradyrhizobium elkanii
MKDCNEQMKGFERSEVRMSEDDRADIYGKAKINRDRLKNGLARNGSPKSIGSRTQGSYAMRTMIQHDRGDYDVDDGVYFSRDSLKNDEGEDKSPEDARKMVSDALQDKRFADQPEARNNCVRVYYKTEGYHVDVPVYREIRTKNPFTDEEAKSYEIAAGDKWRSSDPLANTKWFKDENKNRSSDATANGNDGQFIRVVRLAKGFARSRYGWSNKIASGFAISKLVADHFVESQDRDDYVLRQTLRSISLMLALNSAVRHPVLNENIAESGDEKTKFLKEKIDENLKHLDVLDKLDCSHEDAMKAWDKFFNTDWFS

SEQ ID NO: 2724 - protein, 343 aa, Bradyrhizobium elkanii
MKDCNEQMKGFERSEVRMSEDDRADIYGKAKINRDRLKNGLARNGSPKSIGSRTQGSYAMRTMIQHDRGDYDVDDGVYFSRDSLKNDEGEDKSPEDARKMVSDALQDKRFADQPEARNNCVRVYYKTEGYHVDVPVYREIRTKNPFTDEEAKSYEIAAGDKWRSSDPLANTKWFKDENKNRSSDATANGNDGQFIRVVRLAKGFARSRYGWSNKIASGFAISKLVADHFVESQDRDDYVLRQTLRSISLMLALNSAVRHPVLNENIAESGDEKTKFLKEKIDENLKHLDVLDKLDCSHEDAMKAWDKFFNTDWFSKQSDPSKKSQIEKASGPAVIKQGESRYA

SEQ ID NO: 2725 - protein, 336 aa, Bradyrhizobium sp.
MRGFERSEVRMSEDDRADIYGKAKINRDRLKNGLARNGSPKSIGSRTQGSYAMRTMIQHDRGDYDVDDGVYFSRDSLKNDKEEDKSPEDARKMVSDALQDKRFADQPEARNNCVRVYYKKEGYHVDVPVYREIRTKSPFTGEETKSYEIAAGDKWRSSDPLANTKWFKDENKNKSSDSTSNGNDGQFIRIVRLAKGFARSRYGWSDKIASGFAISKLVADNFAQSQERDDSVLRQTLRSISLVLALNSAVRHPVLNENIAESGDETTKFLKEKIDENLKHLDVLDKLDCSHEDAMKAWDKFFNTDWFSKQPDPSKKSQAEKASGPAVIKQGESRYA

SEQ ID NO: 2726 - protein, 325 aa, Rhizobium giardinii
MRDCHIQVAKYQRDEVRLPNESRKDIFSKAKTNRKRLKDGLAANDDPTPIGQRTQGSYAMRTMIVNTDEDYDIDDGVYFKKEDLVGPNGGDKTSLAAREMVCDALQDKRFNDAPEVLKNCVRVYYNEGYHIDVPVYRHVVVEDPWTGEEKDHYELASSVWKKSDALAVTSWFQDFNKDNCGNASKNGDNGQFVEVVRLLKAFARSRNSWKGIISNGFVISKLVADHWVEVADRDDKALRDVAKAIRDKLAWNQAVKHPVLDENIIAHGNAKAKFLHEKLDEKLKHLDVLDNPECDHATAMSAWDKFFATDWFSGQPEPDGAKSLA

SEQ ID NO: 2727 - protein, 340 aa, Mesorhizobium sp.
MRDCHLQVAKYQREEVRLPNEARKDIFARAKTNRKRLKDGLAANEDPTPIGQRTQGSYAMRTMIVEKDEDYDIDDGVYFKKDDLVGPKGGDMTPLAARDMVWDALYDKRFTIPPEVLKNCVRVYYNEGYHIDVPVYRHVIVKDAWTGKETDHYELASSNWKRSDALAVTSWFQGFNKERCANASKDGDKGQFVEVVRLLKAFARSRTSWKGKISNGFVISKLVADLWAGVADRDDKTLRNVAKAIRDKLSWSQAVKHPVLDENIIEEGNAKAKFLHDRLDEKLKHLDVLDEGDCDHEKAMSAWDNFFNTDWFSQQPDPDGAKSLTQKVGPAIKRGETRYA

SEQ ID NO: 2728 - protein, 340 aa, Mesorhizobium ciceri
MRDCHLQLAKYQRDEVRLPNDSRKGIFTKAKTNRKRLKDGLAANNDPTPIGQRTQGSYAMRTMIVEKGEDYDIDDGVYFKKEDLVGSKGADKSPLAAREMVCNALQDDRFKDSREVLKNCVRVYYHEGYHIDVPVYRHVVVKDAWTGKESDHYELASSSWKRSDALAVTSWFQDFNKNNCANASKDGDKGQFVEVVRLLKAFARSRSSWKGKISNGFVISKLVADHWAEVADHDDKTLRNIAKAIRDTLAWKQVVKHPVLDDNIIEDGNAKAKFLHDKLDENLKHLDVLDEWDCDHAKAMSAWDKFFNTDWFSQQPDPDGAKSLTQKVGPAVKRGETRYA

SEQ ID NO: 2729 - protein, 342 aa, Methylobacterium sp.
MRDTNDQVRGFHKERVRMNDDGRADILSKAKANRKRLRKGLERDDKPAPFGSQTQGSYAMRTMIQDGDGDFDIDDGCYFEKGDLIGARGGDMSALDARNMVCQALQDDLFKDKPEVRKNCVRVYYSAGYHVDVPVYRRIRTTDPWTGTVTLTYELASATWKASDALSVTKWFKQRNKDLCGDASANGDRGQFVRVVRLVKAFARSRSHWRGKIASGFALSRLVSDHFVEREGRDDEALRDVLRAIRDRLGWNSAVDHPTLNERIVEAGDSKTAFLRKKLIDKLAHLDVLDDPDCTHEEGMKAWDDFFYSDYFSMQPDPEDEKDLDRKTSGPAVIKSGGHGYA

SEQ ID NO: 2730 - protein, 342 aa, Bosea vaviloviae
MKDCNEQVRGYHQAEVKMNDFGREDIFKKAKANRTRLRNGLARDDRPTPVGSRTQGSYAMRTMIHDPAGDYDIDDGVYFKKEDLVGERDGEMSALAVRQMVCAALQDDRFTEVPEVLKNCVRVYYQQGYHVDVPAYRRVRTTDPLTGITSDKYELAGAYWKASDALSVTKWFRDQNKALCSDATGNGNNGQFVRVVRLVKAFARSRPHWNGKMASGFALTKLVAEHYREDTGRDDQALREVLRAIRDRLEYNDGVRHPTLDENIADPGSARTAFLRSKLVDKLPCLDVLDDPDCTHDQAMRAWDKFFKSEWFRIQPDPADEEDLENKTKAPAVIKSGGQGYA

SEQ ID NO: 2731 - protein, 312 aa, Novosphingobium lindaniclasticum
MFNTSKQVRRFHNEKIAIVGDERTNMRTRRNSNRNRLKAGLVRDGKPKPLGSHTQGSYAMHTMVQDDDLDYDIDDGLYFKASDLVGAQGAAMSALDVRKMVCAAVQDDKFNTPPDVRTNCVRVYYDAGYHVDIPTYRRIETTNIWTNKVEYSYELAGASWRKSDAKQVTVWFRETNKELSPESVGEGQFRRIVRYLKMFSKSRTSWKGKNPSGFALTKLASECFGSRLNRDDEALRSTMKAIADRLVYNKTVEHPVVDEYLISDDDPRPTYFMDRLNENLGHLDVLDEVDCTHEKAMKAWDKVFCTSWFSEQ

SEQ ID NO: 2732 - protein, 350 aa, Erythrobacter sp.
MYDASAELLGYQNAEVNLPSTERTNMRKRRDSNRARLKKGLADAGKPAPIGQHTQGSYAMHTMVQDENTDYDIDDGVYFRKDKLVGPNGGELSALSVRQMVCDALQDDRFNKPPEVLKNCVRIYYNEGFHVDVPSYRRIESTDPWTGKAVYSYELASSDWKTSDALAVTRWFKQRNEHHSPDFDDTDGQFCRVVRLLKAFARSRSSWKSQTATGFMITKLADDSFSASAGRDDIALRETMKAIRWRLEWNTTIAHPTIDGETIGHDNDARPGHFKDRLMENLKHLEVLDTVDCTHEVAMAAWDKVFYTEWFSQQPPPEEGSNGSGSMSASSPTRPVEKREGGRYAGPALP

SEQ ID NO: 2733 - protein, 354 aa, Klebsiella variicola
MTLINCNKEMKGYHSEKVTLSNTDQSEMRDRRDNGRKRLENGLIRLSHPLPKDFSSQGSYAMRTMVQDDLCDYDIDDGIYFNKEDLKDGDGNYLGAQDARKLVRKALKDDRLAYDAVVKTNCVRQLYPDGYHIDIPVYRSFITKDFWGDETTEYELASGDEWTKSDARKVTRWYNNAVASELKTGQADTSQLRRVTKLTKKMARSRTSWKKKTTSGICISKLVVDHFVCQAGRDDDALRETWKVIKSRLTYSQRIEHPVFADKNLAEENDEAVIFFQECLTEALNALEVLEEYNCTREKAALAWDNVFNTDYFSTEIAQDTNMSKSLMRPAVSASAYLSFPAHPVTPNKSAGFA

SEQ ID NO: 2734 - protein, 354 aa, Klebsiella pneumoniae
MTLINCNKEMKGYHSEKVTLSNTDQSEMRDRRDNGRKRLENGLIRLSHPLPKDFSSQGSYAMRTMVQDDLCDYDIDDGIYFNKEDLKDGDGNYLGAQDARKLVRKALKDDRLAYDAVVKTNCVRQLYPDGYHIDIPVYRSFITKDFWGNETTEYELASGDEWTKSDARKVTRWYNNAVASELKTGQADTSQLRRVTKLTKKMARSRTSWKKKTTSGICISKLVVDHFVCQAGRDDDALRETWKVIKSRLTYSQRIEHPVFADKNLAEENDEAVIFFQECLTEALNALEVLEEYNCTREKAALAWDNVFNTDYFSTEIAQDTNMSKSLMRPAVSASAYLSFPAHPVTPNKSAGFA

SEQ ID NO: 2735 - protein, 354 aa, Klebsiella pneumoniae; identical to SEQ ID NO: 2734

SEQ ID NO: 2736 - protein, 345 aa, Klebsiella pneumoniae
MKGYHSEKVTLSNTDQSEMRDRRDNGRKRLENGLIRLSHPLPKDFSSQGSYAMRTMVQDDLCDYDIDDGIYFNKEDLKDGDGNYLGAQDARKLVRKALKDDRLAYDAVVKTNCVRQLYPDGYHIDIPVYRSFITKDFWGNETTEYELASGDEWTKSDARKVTRWYNNAVASELKTGQADTSQLRRVTKLTKKMARSRTSWKKKTTSGICISKLVVDHFVCQAGRDDDALRETWKVIKSRLTYSQRIEHPVFADKNLAEENDEAVIFFQECLTEALNALEVLEEYNCTREKAALAWDNVFNTDYFSTEIAQDTNMSKSLMRPAVSASAYLSFPAHPVTPNKSAGFA

SEQ ID NO: 2737 - protein, 354 aa, Yersinia enterocolitica
MTLIDCNKEMKGYHSEKVTLSNTDQSEMRGRRDNGRKRLENGLTRSFHPLPKEFSSQGSYAMRTMVQDDLCDYDIDDGIYFNKEDLKDGDDNYLGAQDARKRVRKALKDDRLAYDAVVKTNCVRQLYPDGYHIDIPVYRSFITKDFWGNETTEYELASGDEWTKSDARKVTRWYNNAVASELKTGQADTSQLRRVTKLTKKMARSRTSWKKKTTSGICISKLVVDHFVCQAGRDDDALRETWKVIKSQLTYSPRIEHPVFADKNLAEENDEAVIFFQECLTEALNALEVLEEYNCTREKAALAWDKVFNTDYFSTEIAQDTNMSKSLMRPAVSASASLSFPAHPVTPNKSAGFA

SEQ ID NO: 2738 - protein, 339 aa, Pantoea ananatis
MTLIDCNKEMKGYHLEKVTLSNTDQSEMRDRRDNGRKRLENGLTRSFHPLPKEFSSQGSYAMRTMIQDDLCDYDIDDGIYFDKEDLKDGDDNYLGAQDARKRVRKALKDDRLAYDAVVKTNCVRQLYPDGYHIDIPVYRSFVTKDFWGNETTEYELASGDEWTKSDARKVTRWYNNAVASELKTGQADTSQLRRVTKLTKKMARSRTSWKKKTTSGICISKLVVDHFVCQAGRDDDALRETWKVIKSQLTYSQRIGHPVFADKNLAEENDEAVIFFQECLTEVLNALEVLDEYNCTREKAALAWDKVFNTDYFSTEIAQDNNMSKSLLRPAVSASVSLS

SEQ ID NO: 2739 - protein, 354 aa, Pantoea ananatis
MTLIDCNKEMKGYHLEKVTLSNTDQSEMRDRRDNGRKRLENGLTRSFHPLPKEFSSQGSYAMRTMIQDDLCDYDIDDGIYFDKEDLKDGDDNYLGAQDARKRVRKALKDDRLAYDAVVKTNCVRQLYPDGYHIDIPVYRSFVTKDFWGNETTEYELASGDEWTKSDARKVTRWYNNAVASELKTGQADTSQLRRVTKLTKKMARSRTSWKKKTTSGICISKLVVDHFVCQAGRDDDALRETWKVIKSQLTYSQRIGHPVFADKNLAEENDEAVIFFQECLTEVLNALEVLDEYNCTREKAALAWDKVFNTDYFSTEIAQDNNMSKSLLRPAVSASVSLSFPAHPVTPNKSAGFA

SEQ ID NO: 2740 - protein, 199 aa, Enterobacter cloacae
MTLIDCNKEMKGYHSEKVTLSNTDQSEMRERRNNGRKRLENGLTRLSHPLPKDFSSQGSYAMRTMVQDDLCDYDIDDGIYFNKEDLKDGDGNYLGAQDARKRVRKALKDDRLAYDAVVMTNCVRQLYPDGYHIDIPVYRSFITKDFWGNETTEYELASGDEWTKSDARKVTRWYNNAVASELKTGQADTSQLRRVTKLT

SEQ ID NO: 2741 - protein, 351 aa, Unknown
  Description of Unknown: Enterobacteriaceae sequence
MTIIDCNKEMKGYHSEEVNLSNAEQAEMRSRRDNGRTRLQNGLTKAGHPLPKKFSSQGSYAMRTMVQDDACDYDIDDGAYFDKEDLKNAEGDYLSALDVRKRVKKALKDDRLAYDAVVKTNCVRQEYPDGYHIDIPIYRTTCSKDIWGNDVIEYELASGDEWTKSDARKVTSWYNDAVGNELKTGESDTSQMRRITKLTKKMARSRNAWKKKTTSGICISKLVVDNFIACPNRDDDALRDTWQAIKLQLDVSQRIAHPVFTDKNLAEEDDECVIFFRGCLGDALEVLKVLDEHDCTSKKAGEAWDEVFNTTYFSAQFTTTSKSLLRPAVAASTTLSFPSHPVQPNKSSGFA

SEQ ID NO: 2742 - protein, 351 aa, Enterobacter cloacae
MTIIDCNKEMKGYHSEEVNLSNAEQAEMRSRRDNGRTRLQNGLTKAGHPLPKKFSSQGSYAMRTMVQDDACDYDIDDGAYFDKEDLKNAEGDYLSALDVRKRVKKALKDDRLAYDAVVKTNCVRQEYPDGYHIDIPIYRTTCSKDIWGNDVIEYELASGDEWTKSDARKVTSWYNDAVGNELKTGESDTSQMRRITKLTKKMARSRNAWKKKTTSGICISKLVVDNFIACPNRDDDALRDTWKAIKLQLDVSQRIAHPVFTDKNLAEEDDECVIFFRGCLGDALEVLKVLDEHDCTSKKAGEAWDEVFNTTYFSAQFTTTSKSLLRPAVAASTTLSFPSHPVQPNKSSGFA

SEQ ID NO: 2743 - protein, 352 aa, Enterobacter sp.
MTIIDCNKEMKGYHSEEVNLSNAEQAEMRSRRDNGRTRLQNGLTKAGHPLPKKFSSQGSYAMRTMVQDDACDYDIDDGAYFDKEDLKNAEGDYLSALDVRKRVKKALKDDRLAYDAVVKTNCVRQEYPDGYHIDIPIYRTTCSKDIWGNDVIEYELASGDEWTKSDARKVTSWYNDAVGNELKTGESDTSQMRRITKLTKKMARSRNAWKKKTTSGICISKLVVDNFIACPNRDDDALRDTWKAIKLQLDVSQRISHPVFTDKNLAEEDDECVIFFRGCLGDALEVLKVLDEQDCTSKKAGDAWDEVFNTTYFSAQFTTTSKSLLRPAVAASTTLSFPSHPVQPNKSSGFAS

SEQ ID NO: 2744 - protein, 351 aa, Enterobacter cloacae
MTIIDCNKEMKGYHSEEVNLSNAEQAEMRSRRDNGRTRLQNGLTKAGHPLPKKFSSQGSYAMRTMVQDDACDYDIDDGAYFDKEDLKNAEGDYLSALDVRKRVKKALKDDRLAYDAIVKTNCVRQEYPDGYHIDIPIYRTTCSKDIWGNDVIEYELASGDEWTKSDARKVTSWYNDAVGNELKTGESDTSQMRRITKLTKKMARSRNAWKKKTTSGICISKLVVDNFIACPNRDDDALRDTWQAIKLQLDVSQRIAHPVFTDKNLAEEDDECVIFFRGCLGDALEVLKVLDEHDCTSKKAGEAWDEVFNTTYFSAQFTTTSKSLLRPAVAASTTLSFPSHPVQPNKSSGFA

SEQ ID NO: 2745 - protein, 354 aa, Klebsiella oxytoca
MTIIDCNKEMRGYHSEEVNLSNAEQAEMRGRRDNGRTRLRNGLTKAGHPLPKEFSSQGSYAMRTMVQDDACDYDIDDGAYFDKEDLKNSEGDYLSALDVRKRVRKALKDDRLAYDAVVKTNCVRQMYPDGYHIDIPIYRTTCSKDIWDNDIIEHELASGDEWTKSDARKVTSWYNDAVGNELKAGESDTSQIRRITKLTKKMARSRNTWKKKTTSGICISKLVVDNFVARSNRDDDALRDTWKAIKLQLEVSQRITHPVFTDKNLAEEGDECVIFFRECLGEVLETLKVLDEHDCTSKKAGDAWDEVFNTTYFSAQCTTDNTTSKSLLRPAVAATASLSFPSYPVQPNKSSGFA

SEQ ID NO: 2746 - protein, 353 aa, Gallionellales bacterium
MSSIDCNKEMKGYHVDHVNLSNQDQIEMRSRRDNGRTRLNNGLAKAKYPQPKEFSSQGSYAMRTMVEDDQCDYDIDDGVYFEKDELKDAEGNHLGARDAHTRIRNALKDERLAYDAVVKTNCVRQKYPDGYHIDIPVYRITRRKDLWGNEIIEYEHASGNEWVTSDARAVTRWYNDAVGEELKAGENDSSQLRRLTKLTKKMARSRIEWKAKTTSGICISKLIVDYFSAKTGRDDDALHATWKEIKTKLDISLQIDHPVLTGKKLAEWNDESISFFHNCLADSLKKLEVLDEPGCTREKALKVWDNVFNTNYFGEQFSTNQATAKSLLQPAAVASGLTFPSKPVIPNKPSGFA

SEQ ID NO: 2747 - protein, 345 aa, Hydrogenophilales bacterium
MKGYHADEVILSNADQGAMRKRRDNGRTRLESGLTKAKHPLPKYFSSQGSYAMRTMVEDDQCDYDIDDGVYFEKSDLTDAGGNYLGARDARLRIRNALKDERLAYDAEVKTNCVRQNYPDGYHIDIPVYRILRTKNIWGDEVVEYELASGNEWVKSDARAVTRWYNDAVGEELKAGDTDKSQLRRVTKLTKKMARSRSAWKGKTTSGICLSKLVVDYFVGITSRDDDALRETWKAVKSRLDVTFEIDHPVLQGKKLSTWDDDGVSFFRDCLVDSLKSLEVLDEDECSREKVRKAWDGVFNTTYFSDRKSIKQEEAASLLQPAVVATGLSFPGKAVTPNKSSGFAR

SEQ ID NO: 2748 - protein, 352 aa, Nitrosomonas sp.
MANIDCNSEIKKYHSNKVVLSKTQQDEMRGRRDNGRTRLENGLIKANHPLPYLIASQGSYAMRTMAQDDENDYDIDDGVYFEYDDLLDNNGNELEPKAARKRVKNALYDERLAFDAQVKNNCVRQYYPAGYHIDLPVYRTTWSQDILGNEIVKHELASGDEWVVSDARAVTKWFNDHVTQELKSGDVDTSQLRRVVRLTKKMARSRKAWKNKTTSGICITKLVVDHMVYVTDRDDGALRSTWQAIRDVLAISRTVRHPVQPKNLAEWDDEGVGFFKDCLSENLKHLEVLDKSDCNHEMAMKAWNKVFDTDYFNDFITDKKSAASLLQPATVVAAGLSFPDKAIVPNKSSGFA

SEQ ID NO: 2749 - protein, 358 aa, Hydrogenophaga intermedia
MADIDCHSEMTNFHRDNVTLSNKQQGEMRTRRDAGRTRLENGLNEAKKPQPKEVRSQGSYQMRTMVQDDDNDYDIDDGAYFASADLKDWIGFALTPKEARQRVCDALVWDGRLKQEATVKRNCVRQVYAAGYHIDIPVYRIVTTKDENGDPVEHYELASGDEWTRSDARAVTRWFNGLVGELNAGESDGSQMRRITKLTKKFARRADWKNETTSGISITKLVVDHFQYSADRDDKALRETWKAIDKKLQKSTEIDHPVLATKLASAGDDAVTFFRDCLSGALKTLEALEKSDCTRKQAREAWDGVFDTDYFSKQPDNKDDDGGGGGGNGGNGGGNKGSAMAVTSVETARRNDGGGRFG

SEQ ID NO: 2750 - protein, 347 aa, Bordetella bronchiseptica
MADIDCHSEMTNFHRDKVTLSNKQQGEMRTRRDAGRTRLENGLNEAKKPQPNEVRSQGSYQMRTMVQDDANDYDIDDGAYFASDDLKDDAGVALTPKAARERVCNALVWDGRLKQEATVKRNCVRQVYAAGYHIDIPVYRIITTNDENNDPVEHYELASGDEWTRSDARAVTRWFNGLVGELNSGESDGSQMRRVTKLTKKFARRSSWKDETTSGICITKLVVDHFQYSADRDDKALRETWKAIDKKLQKSTEIDHPVLATKLAQAGDAAVTFFHTCLSDALKTLEVLDTSDCTRKKAREAWDDVFDIDFFSMQPDNKDDGGGGKGSAMSVTSVETARRNDGGGRFG

SEQ ID NO: 2751 - protein, 347 aa, Methyloterricola oryzae
MADIDCHSEMRGFHRDQVTLSNKQQGEMRTRRDAGRTRLENGLNEAKKPQPKEVQSQGSYQMRTMVQDDDNDYDIDDGAYFASDDLKDDAGVALTPLAARQRVCDALVWDGRLKQEATVKRNCVRQVYAAGYHIDIPVYRIVTTKDENDEPVEHYELASGDDWTRSDARAVTRWFNGLVGELNAGESDGSQMRRITKLTKKFARRAGWKNKTTSGICITKLVVDHFHYSADRDDKALRETWNAIEKKLQKSTEIDHPVLDTKLAPTGDDAVTFFHDCLSSALKTLEVLDNSDCTRKQVREAWDEVFDTDFFSRQPDNNGDDGGGKGSAMKVTSVETARRNDGGGRFG

SEQ ID NO: 2752 - protein, 347 aa, Betaproteobacteria bacterium
MTDIDCHSEMTGFHRDKVTLSNKQQGEMRTRRNAGRTRLENGLNEAKKPQPKEVQSQGSYQMRTMVQDDDNDYDIDDGAYFASDDLKDDVGVTLTPLAARRRVCDALVWDGRLKQEATIKRNCVRQVYAAGYHIDIPVYRIVTTKDENDEPVEHYELASGDEWTRSDARAVTRWFNSLVGDLNAGESDGSQMRRITKLTKKFARRADWKNKTTSGISITKLVVDHFQHSADRDDKALRETWKAIDKKLQKSTEIDHPVLDTKLASAGDDAVVFFRDCLSSAIKTLEVLDKSDCTRMQAREAWDDVFDTDFFTKQPDNNGDDSGGKGTAIKVTSVETARRNDGGGRFG

SEQ ID NO: 2753 - protein, 347 aa, Pseudomonas aeruginosa
MADIDCHSEMTNFHRDNVTLSNKQQSEMRTRRDAGRTRLENGLNEAKKPQPKEVRSQGSYQMRTMVQDDDNDYDIDDGAYFASDDLKDDAGVALTPKAARQRVCDALAWDGRLKQEATVKRNCVRQVYAAGYHIDIPVYRIVVTRDKNDDPVEHYELASGDEWTRSDARAVTRWFNGLVGELNAGESDGSQMRRITKLSKKFARRVGWKNKTTSGISITKLVVDHFQFSADRDDKALRETWKAIDKKLQKSVEIDHPVLANKLAQVGDEAVTFFRDCLSGALKTLEVLDESDCSRKQAREAWDDVFDTDFFTKQPDNNGDSSDGKGSAMAITSIETARRNDGGGRFG

SEQ ID NO: 2754 - protein, 347 aa, Pseudomonas aeruginosa
MAEIDCHSEMTNFHRDNVTLSKKQQSEMRTRRDAGRTRLENGLNEAKKPQPKEVRSQGSYQMRTMVQDDDNDYDIDDGAYFASDDLKDDAGVALTPKAARQRVCDALVWDGRLKQEATVKRNCVRQVYAAGYHIDIPVYRIVTTRDKNDDPVEHYELASGDEWTRSDARAVTRWFNGLVGELNAGESDGSQMRRVTKLSKKFARRVDWKNKTTSGISITKLVVDHFQFSADRDDKALRETWKAIDKKLQKSVEIDHPVLANKLAQAGDEAVTFFRDCLSGALKTLEVLDKSDCSRKQAREAWDDVFDTDFFTKQPDNNGDSSDGKGSAMAITSIETARRNDGGGRFG

SEQ ID NO: 2755 - protein, 347 aa, Nitrosovibrio sp.
MAEIDCHSEMTNFHRDNVTLSKKQQSEMRTRRDAGRTRLENGLNEAKRPQPKEVRSQGSYQMRTMVQDDDNDYDIDDGAYFASDDLKDDAGVALTPKAARQRVCDALVWDGRLKQEATVKRNCVRQVYAAGYHIDIPVYRIVTTRDKNDDPVEHYELASGDEWTRSDARAVTRWFNGLVGELNAGESDGSQMRRVTKLSKKFARRVDWKNKTTSGISITKLVVDHFQFSADRDDKALRETWKAIDKKLQKSVEIDHPVLANKLAQAGDEAVTFFRDCLSGALKTLEVLDKSDCSRKQAREAWDDVFDTDFFTKQPDNNGDSSDGKGSAMAITSIETARRNDGGGRFG

SEQ ID NO: 2756 - protein, 346 aa, Betaproteobacteria bacterium
MSDIDCHSEMVNFHRDSVTLSSKQQGEMRDRRNAGRTRLESGLTEAKKSQPKEICSQGSYQMRTMVQDDQNEYDIDDGVYFLSDDLKDGYDVGLTPLAARTRVCDALKWDGRLKHEATIKRNCVRQEYPEGYHIDIPVYRIVTTKDGNGNPVESYELASGDEWTKSDARAVTRWFNGLVGELNSGEMDGSQMRRITKLTKKFAHRTQWKNQTTSGICITKLVVDNFKANANRDDKSLRDTWKAIDDQLQKSTEIKHPVLSSYLASAGDEEVGFFRDCLHDALNTLEVLDNGDCTRAQAREAWGEVFDTTFFSDEPDDGDDKQAKGAAMAVTSVQTARRNDGGGRFG

SEQ ID NO: 2757 - protein, 354 aa, Burkholderiales bacterium
MTDIDCHSEMKAFHKEEVTLSSAQQKDMRERRDNGRTRLENGLDEAKQPKPREVRSQGSYQMRTMVQDPDNDYDIDDGAYFEKDDLQDSSGAALTPFAARQRVCDALKWDGRFKREAEVRSNCVRQEYSAGYHIDVPVYRIVATTAANGDETEHFELASNDEWVTSDARGVTRWFNNIVGELNQGESDGSQMRRVTKLSKKFARRPDWKEKTTSGICITKLVVDHFAFSEDRDDLALRNTWKAIDTKLQSSTALEHPVNTANLAEEGDEKLTFFRDCLNNALKTLEGLDEVDVTRQEVRQAWDEVFHTGFFSNQPDSNGGNGSSGGDGPTGQGPAISVTTGETARRNDGGGRFG

SEQ ID NO: 2758 - protein, 354 aa, Hydrogenophaga sp.
MTDIDCHSEMSAFHKEEVTLSSAQQKDMRERRNNGRTRLANGLDEADHPQPREVASQGSYQMRTMVQDPENDYDIDDGAYFQRDDLQDATGAPLTPLDARQRVCNALKWDGRFKREAEVRSNCVRQEYSAGYHIDVPVYRVVTTVAANGGETEHFELASGDDWVNSDARGVTRWFNTKVGELNQGESDGSQMRRVTKLSKKFARRSDWKEKTTSGICITKLVVDHFVSSENRDDLALRSTWKAIDTKLQSSTALEHPVNTSNLAEEGDKKLTFFRDCLSGALKTLDELDKADVTRKEVRQAWDEIFDTEFFSDRPDDDGGDGGSSGDGPKGQGPAISVTTGETARRNDGGGRFG

SEQ ID NO: 2759 - protein, 347 aa, Variovorax sp.
MADIDCHGEMTAFHRDEVTLSSAQQKDMRERRDNGRTRLQNGLTVADHPQPREVKSQGSYQMRTMVQDSGNDYDIDDGTYFEQDDLKDSNGTALSPVAARQRVCDALKWDGRFKQEATVKSNCVRQEYAVGYHIDVPVYRVVKTVNGSGESVEHYELASGDDWVKSDARAVTRWFNDLVGELNQGESDGSQMRRVTKLTKKFARRESWKDETTSGICITKLVVDHFVHKETRDDLALRETWKAIESKLLASTEVKHPVNSANLAEHGDEEVVFFRDCLSSALKTLQVLDSAETTRKKAREAWDEVFDTTFFTDRPDNDVDGGNGKGSAITVTTVETARRSDGGGRFG

SEQ ID NO: 2760 - protein, 348 aa, Unknown
  Description of Unknown: Pseudomonas sequence
MADIDCHGEMTNFHREKVTLSSAQQGDMRKRRDAGRTRLKNGLDTAEKPQPKEIRSQGSYQMRTMVQDNDNDYDIDDGAYFRSEDLTDDDGEPLAPKAARQRVCNALKWDGRFKQEATVKRNCVRQVYAEGYHIDVPVYRIVKATSLFGKEEERFELASGDEWVESDARAVTRWFNGLVGELNAGEADGSQMRRVTKLSKKFARRAKWKSKTTSGIAITKLVVDHFVTKAERDDLSLRETWKKIHSKLLWSTEIKHPVVTSNIAEAGDGQVEFFRDCLGEALDTLKVLDKHDCARKEAREAWDEVFDTSFFTDQPDDGDEGRSKASNAALSVTSVETARRNDGGGRFG

SEQ ID NO: 2761 - protein, 348 aa, Azonexus hydrophilus
MTDINCDADMTGYHRDEVTLALSQQKDMRGRRNNGRDRLRKGLDTAGKPQPREVHSQGSYQMRTMVQDPDNDYDIDDGAYFWSEDLKDDDGVELTPLEARQRVCDALKWDGRFKQEAEVKNNCVRQAYAAGYHIDVPVYRIVTEKDWAGNDVEKYELASGNSWLISDARAVTKWFNDQVGELNSGQADGSQMRRITKLTKKFARRADWKANTTSGITISKLVIDHFVANAGRDDKALRQTWQMIHSALTWSTQVAHPVVTKNLAEQGDAQVTYFRDCLKAALDTLKVLDRDDCTRAIAREAWDSVFDTKFFSNRPDPDTANKGSSLGSVMTVTSVETARREDGGGRFG

SEQ ID NO: 2762 - protein, 343 aa, Thiothrix nivea
MSDIDCNSEMTTFHRDEVTLSQKQQGNMRRRRDAGRTRLNNGLDQNSHPHPKEIVSQGSYQMRTMVQDENKEYDIDDGSYFKKIDLVDSNGKPLTPLAARERVRDALKWDGRLKQEAVVKRNCVRQEYPEGYHIDVPVYRIMIREDKDGNNIEYYELASGDEWVESDARAVTRWYNGLVGELNAGESDGSQMRRITKLTKKFSRRTDWKDKTTSGICITRLVVDHFVSVENRDDKSLRQTWKAIHEKLETSTEIKHPVLDSNLAEKDDDELKFFDDCLADALKALEGLDNHDCDRQKARAVWDEVFDTSFFTNQPDKKDKENSAFVITSQETARRNDGGGRFG

SEQ ID NO: 2763 - protein, 347 aa, Unknown
  Description of Unknown: Xanthomonas sequence
MTVFDCGEDMEKFHGDKINLSTDERNEMRERRNTGRRRLEIGLDEEEHPQPKITCTQGSYEMHTMVQDPDCDYDIDDGIYFAEDDLVDKLGLPLTPQEAKERVCAALSRDNRFANPAEVFPKCVRQVYSEGYHIDMPVYRIRKEDDGQGGKREVFELAGDGSWDASDARATTWWFRKEVSTRNETNDEEGEQMRRITRLTKGQARSREDWKDETTSGIVITKLVVDNFVSSAGRDDEALLETWKKIHAQLSESTEVAHPVNASNLAELGNAKVGFFRDKLGEALEELAILEKGCTRSEARKAWDGVFDSGYFHKLPDPTVKEDARKAFFIATSDKSDVRNDGNGRFG

SEQ ID NO: 2764 - protein, 347 aa, Xanthomonas campestris
MAVFDCGEDMEKFHDNKINLSTDERNEMRERRNTGRRRLEIGLDEEEHPQPKITCTQGSYEMHTMVQDPDCDYDIDDGIYFAEDDLVDKLGLPLTPQEAKERVCAALSRDNRFANPAEVFPKCVRQVYSEGYHIDMPVYRIRKEGDGQGGKREVFELAGDGSWDASDARATTWWFRKEVSTRNETNDDEGEQMRRITRLTKGQARSREDWKDETTSGIVITKLVVDNFVSSAGRDDEALLETWKKIHAQLSESTEVAHPVNASNLAESGNAKVGFFRDKLGEALEELAILEKGCTRSEARKAWDGVFDSGYFQKLPDPTAKEDAKKAFFIATSDKSDVRNDGNGRFG

SEQ ID NO: 2765 - protein, 324 aa, Xanthomonas perforans
MAVFDCGEDMEKFHDNKINLSTDERNEMRERRNTGRRRLEIGLDEEEHPQPKITCTQGSYEMHTMVQDPNCDYDIDDGIYFAEDDLVDKLGLPLTPQEAKERVCAALSRDNRFANPAEVFPKCVRQVYSEGYHIDMPVYRIRKEDNGQSGKREVFELAGDGSWDASDARATTWWFRKEVSTRNEAHEDEGEQMRRITRLTKGQARSRENWKDETTSGIVITKLVVDNFVPSAGRDDEALLETWKKIQVQLSESTEVEHPVNASNLAELGNAKVGFFRDKLGEALEELAILEKGCTRSEARKAWDGVFDSGYFQKLPDPTAKENA

SEQ ID NO: 2766 - protein, 347 aa, Xanthomonas perforans
MAVFDCGEDMEKFHDNKINLSTDERNEMRERRNTGRRRLEIGLDEEEHPQPKITCTQGSYEMHTMVQDPNCDYDIDDGIYFAEDDLVDKLGLPLTPQEAKERVCAALSRDNRFANPAEVFPKCVRQVYSEGYHIDMPVYRIRKEDNGQSGKREVFELAGDGSWDASDARATTWWFRKEVSTRNEAHEDEGEQMRRITRLTKGQARSRENWKDETTSGIVITKLVVDNFVPSAGRDDEALLETWKKIQVQLSESTEVEHPVNASNLAELGNAKVGFFRDKLGEALEELAILEKGCTRSEARKAWDGVFDSGYFQKLPDPTAKENAKKAFFIATSDKSDVRNDGNGRFG

SEQ ID NO: 2767 - protein, 338 aa, Xanthomonas vasicola
MEKFHDNKINLSTDERNEMRERRNTGRRRLEIGLDEEEHPQPKITCTQGSYEMHTMVQDPNCDYDIDDGIYFAEDDLVDKLGLPLTPQEAKERVCAALSRDNRFANPAEVFPKCVRQVYSEGYHIDMPVYRIRKEDNGQSGKREVFELAGDGSWDASDARATTWWFRKEVSTRNEAHEDEGEQMRRITRLTKGQARSRENWKDETTSGIVITKLVVDNFVPSAGRDDEALLETWKKIQVQLSESTEVEHPVNASNLAELGNAKVGFFRDKLGEALEELAILEKGCTRSEARKAWDGVFDSGYFQKLPDPTAKENAKKAFFIATSDKSDVRNDGNGRFG

SEQ ID NO: 2768 - protein, 347 aa, Stenotrophomonas maltophilia
MSVFDCGSDMGKFHADEVTLSNDERAEMRERRDTGRRRLEIGLDEEEHPQPKMVCTQGSYAMHTMVQDPDFDYDIDDGVYFDEEALVDQHGFALTPLEAKERVCAALSRDKRFANPAEVFPKCVRQAYHQGYHIDMPVYRIRKEDNGWGDTREVFELAGDGSWDPSDARATTRWFKQQVADRNGESAGAGDQMRRVIRLTKLYARSRSDWKDETTSGIVITKLVSDHFVGFDDRDDEALLETWKAIKAQLDWSTEVAHPVNASKLAEEGNAKVRFFRDKLGWAIEQLAVLEDDCTRSEAREAWDEVYASRYFQALPEPVQKAEASRGFFIAAEARSDVRNDGNGRFG

SEQ ID NO: 2769 - protein, 347 aa, Stenotrophomonas maltophilia
MSVFDCGSDMSKFHADEVTLSNDERTEMRERRDTGRRRLEIGLDEEEHAQPKMVCTQGSYAMHTMVQDPDFDYDIDDGVYFDEAALVDQHGFALTPLEAKERVCTALSRDRRFANPAQVFPKCVRQAYHQGYHIDMPVYRIRKEHDGWGGTREVFELAGDGSWDPSDARATTRWFKQQVADRNGESAGAGDQMRRVIRLTKLYARSRSDWKDETTSGIVITKLVSDHFVGFDGRDDEALLETWKAIKAQLDWSTEVAHPVNASKLAEAGNAKVRFFRDKLSWAIEQLAVLEDDCTRSEAREAWDEVYASSYFQALPEPVQKAEASRGFFIAAEARSDVRNDGNGRFG

SEQ ID NO: 2770 - protein, 322 aa, Halomonas sp.
MSVFDCSSEMSKYHGEKVTLRDKDRKDMRERRDNGRIRLKNGLNNNDHAQPKIVSSQGSYQMRTMIQDEDCDYDIDDGVYFLPNDLKNGDGVDLTPLQARQRVCDALSYDLRFASPAEVHNNCVRQEYQAGYHIDMPVYRIQVQDEGMDKEKEIYELASGNMWQVSDARAVTQWFRNAISQLNGEDGVDGLQMRHVVRLTKAFARSRKEWKNKTASGIALTRLVVDEFRPFKNRDDQALLETWKVINSRLATSTKVEHPVNATELAKEGDEKVTFFRNCMSDALEILATLEKDDCTRNEARDAWDSVFNTTYFGNLPDPRNS

SEQ ID NO: 2771 - protein, 351 aa, Halomonas daqiaonensis
MSVFDCSSEMSKYHGEKVTLRDKDRKDMRERRDNGRIRLKNGLNNNDHAQPKIVCSQGSYQMRTMIQDEDCDYDIDDGVYFLPNDLKNGDGVDLTPLQARQRVCDALSYDLRFASPAEVHNNCVRQEYQAGYHIDMPVYRIQVQNEGMDNEKEIYELASGNMWQVSDARAVTQWFRNAISQLNGEDGVDGLQMRHVVRLTKAFARSRKEWKNKTASGITLTRLVVDEFRPFKNRDDQALLETWKVINSRLATSTKVEHPVNATELAKEGDEKVTFFRNCMSDALEILATLEKDDCTRNEARDAWDSVFNTTYFGNLPDPRNSGSDAKTFFVATESKTDTRDDGNGRYGWGS

SEQ ID NO: 2772 - protein, 351 aa, Unknown
  Description of Unknown: Halomonas sequence
MRVFDCSSEMSKYHGEKVTLRDKDRKDMRERRDNGRTRLKNGLNDNGHAQPKIVCSQGSYQMRTMIQDEDCDYDIDDGVYFLPNDLKNGDGVDLTPLQARQRVCDALSYDLRFASPAEVHNNCVRQEYRAGYHIDVPVYRIQVQNEGMDNEKEIYELASGDMWQVSDARAVTQWFRNAISQLNGEHGVDGLQMRHVVRLTKAFARSRKEWKNKTTSGITLTRLVVDEFRPFKNRDDQALLETWKVINSRLATSTKVEHPVNETELAKEGDGKVTFFRNCLSDALEILATLEKDDCTRNEARDAWDRVFNTTYFGNLPDPRNSGTDAKTFFVATESKTDTRDDGNGRYGWGS

SEQ ID NO: 2773 - protein, 335 aa, Burkholderia ubonensis
MSSFHGEEVTLTQTQRNEMRERRNNGRTRLESGLERDGHPLPDHHSQGSYAMHTMVQDDDNEYDIDDGAYFKEGDLVDANGNSLTPREAKDRVRDALAQDKRLANDAEVHRNCVRQPYPQGYHIDIPVYRTIVEAGANGKPTEKYELASESAWEVSDAREVTRWFKDQVSKAGDNAKQLRKVVRLTKFYARSRKDWKEKTGSGITISALVCDEFAAVTDRDDQSLRDTWKRIHARLIRSLRVEHPVGETPLAKEGDEKAAFLRDKLKEALDDLLVLDNDPTRGEARAAWDKVFDTDFFCKQPSPSNDGEGGEKKSRFVVVDDRRDQRDDGGRRYG

SEQ ID NO: 2774 - protein, 342 aa, Burkholderia ubonensis
MFDCHKEMSSFHGEEVTLTQTQRNEMRERRNNGRTRLESGLERDGHPLPDHHSQGSYAMHTMVQDDDNEYDIDDGAYFKEGDLVDANGNSLTPREAKDRVRDALAQDKRLANDAEVHRNCVRQPYPQGYHIDIPVYRTIVEAGANGKPTEKYELASESAWEVSDAREVTRWFKDQVSKAGDNAKQLRKVVRLTKFYARSRKDWKEKTGSGITISALVCDEFAAVTDRDDQSLRDTWKRIHARLIRSLRVEHPVGETPLAKEGDEKAAFLRDKLKEALDDLLVLDNDPTRGEARAAWDKVFDTDFFCKQPSPSNDGEGGEKKSRFVVVDDRRDQRDDGGRRYG

SEQ ID NO: 2775 - protein, 335 aa, Rhodanobacter sp.
MFDCNKEMRNFHGDKVTLSIDTQDEMRERRNNGRTRLDNGLERDGHKTPSYFVQGSYAMHTMVQDDAKEFDIDDGAYFSFAALTDADDVELTTMQAKERVRDAIRQDQRLKEPADIHDNCVRQVYPAGYHIDIPVYRVKTSKDASNNTVETYELATKDTWEPSDAREVTRWFFRQIDAAGDKDDRAQLRRVVRLTKSFARSRDGWSEKTGSGIALTRLVCDEFAKAPGRDDEALRKTWQAIEARLLKSCIVVHPVSAKNLADEGDEKVGFFLDKLSDALKELEVLDTNCTRREAREAWDTTFDTTYFTRQPTPDKRLDVDESKADHRNDGGGVYG

SEQ ID NO: 2776 - protein, 238 aa, Thiotrichaceae bacterium
MFNCAKEMNKFHQEKVTLSEKEQGEMRDRRDTNRNRLKTGLADNRKPVAKGCYSQGSYRMRTMVQDDQGDYDIDDGVYFTRRSLQDSKGDDESSENVRKMVHDAVARDQRLPDMKSKCVRVYYNEGYHIDLPVYRMTEEGDNEIYELATKDGWEQSDARQLTIWFNQHFGKDLKKGEEDPQQMRRVVRLTKKFARSRITDEDNWKEKMPSGICITKLVVNHYVLMSLSMKHGAKLFRH

SEQ ID NO: 2777 - protein, 347 aa, Burkholderia vietnamiensis
MANVNKQLLAFFKSEVALTETTKSDMRKRRRSCEERLERGLERNKKPKVDRYVKQGSYAMHTMVQSNSITSDIDNGVVFHEDKLVGDRGGEFSAYDAKCMVRDALNYDNSFERAPEVLKNCVRVYYKDGFTIDMPVYRETGEGDNAQYELAAANWKHSDPEAVTEWFQDNVVQKSPDTVDGRQMRRMVRLLKAWSKSRSSWALPSGFVLSILTNEVYPRGGYPDREDHALFQTVQAIRNRLHYNKTVYRPVPQYEAVTKTASDPNMVSLHEKLNEAVDRLAPLNDSRATDLEALKALKWFFCTEFFDDEIEELEKEEKEKADARFVSTESRQPAGPVVKSGGEGRYA

SEQ ID NO: 2778 - protein, 345 aa, Burkholderia sp.
MANVNKQLLAFFKSEVALTEATKSDMRNRRRSCEERLQRGLERNEDPEVDRFVKQGSYAMHTMVQSNSITSDIDNGVVFHEDKLVGDRGGKFSAYDAKCMVRDALNYDKAFEREPEVLKNCVRVFYKDGFTIDMPVYREIGNGDDVKYELAAADWKHSDPEAVTEWFQNNVTQKSPDTVDGRQMRRMVRLLKAWSKSRASWSLPSGFVLSILTNEVYPHGGYPDREDLALFQTVQKMRNRLVWNLTVSRPVPEYENVTKSNSDANMVSLRDKLNEAVDRLAPLADAHAADLEALKALKWFFCTEYFDEEIESLEEAAKASAKFVSTESRQPSGPVVKSGGEGRYA

SEQ ID NO: 2779 - protein, 345 aa, Burkholderia ubonensis
MANVNKQLLAFFKSEVALTEATKSDMRNRRRSCEERLERGLERNEDPEVDRFVKQGSYAMHTMVQSNSITSDIDNGVVFHEDKLVGDRGGKFSAYDAKCMVRDALNYDKAFEREPEVLKNCVRVFYKDGFTIDMPVYREIGTGDDAKYELAAADWKHSDPEAVTEWFQNNVTQKSPDTVDGRQMRRMARLLKAWSKSRASWSLPSGFVLSILTNEVYPHGGYPDREDLALFQTVQKMRNRLLWNLTVSRPVPEYENVTKSNSDANMVSLRDKLNEAVDRLAPLADAHAADLEALKALKWFFCTEYFDEEIESLEEAAKASAKFVSTESRQPSGPVVKSGGEGRYA

SEQ ID NO: 2780 - protein, 345 aa, Burkholderia multivorans
MANVNKQLLAFFKSEVALTEAKKSDMRNRRRSCEERLQRGLERNEDPEVDRFVKQGSYAMHTMVQSNSITSDIDNGVVFHEDKLVGDRGGKFNAYDAKCMVRDALNYDKAFEREPEVLKNCVRVFYKDGFTIDMPVYREIGNGDDVKYELAAGDWKHSDPEAVTEWFQNNVTQKSPDTVDGRQMRRMVRLLKAWSKSRASWSLPSGFVLSILTNEVYPHGGYPDREDLALFQTVQKMRNRLLWNLTVSRPVPEYENVTKSNSDANMVSLRDKLNEAVDRLAPLADTHAADLEALKALKWFFCTEYFDEEIESLEEAAKASAKFVSTESRQPSGPVVKSGGEGRYA

SEQ ID NO: 2781 - protein, 348 aa, Ralstonia sp.
MANVHKHLLNYFLERVALKEDQKDLMRKRRTSNETRLKDGLKAQKKPSPLRFVKQGSYAMHTMVQANAATSDIDDGVVFAKGDLVGERGGEFNPLQAKNMVCDALNEKKDFKTPPEVRTNCVRVYYADGFTIDMPVYREVELNGKTVYELAAAEWKESDPEAVTEWFVGATKKSPDETNGRQLRRMVRLLKAWSKSRISWTLPSGFVLSILTNEKYPQGGWKDRDDLALYNLVCDIHARLQWNLTVTRPVKPYDSVTKTNDDADMRNLRDKLADAKTTLAPLGDSNATELEALQALKSFFNTDYFDEAIEDLKNTEKSQAVGATGFIRSGSQEPQTQFFKDGGEGRYA

SEQ ID NO: 2782 - protein, 353 aa, Deltaproteobacteria bacterium
MFNCHAHLKAFHDDRVTLTETMKQEMRSRRDANQKRLSKGLEKSEKPKPIEHVKQGSYAMHTMVQSEYAASDIDDGAVFAKADLVGSRGGEYTPLDAKNMVRDAIDDGSFTKAPEVRSNCVRISYKDGFTIDIPVYRKIEKDDDTYFELANADWRRSDPEGVNNWFKNQVKEKSPDSTNGRQMRRIVRLLKAWSKSRKSWNMPSGFILSKLTDEQYYKDMSLLGRDDKALLQVMEGIHARLQWDLVVKHPVVDGENITKSNEDANMVELRDRLGKAIDTLSILRKSDCAELNALKALRDLFATDYFDQRIDKLEEEKKNSENDSRSSAAYILGGGTAPHSPVIKQGGERQGYA

SEQ ID NO: 2783 - protein, 340 aa, Nitrospira sp.
MFDCSREIRAFHDEKVRLSEAVQDKLRGHRDANRERVTNGLKASHGLTPISFLIQGSYDMQTIIQQPKNDYDIDDGVIFKADDLHGPQGGQWTPLQVRQVVCQAVQDPRFKKAPEVRTNCVRVYYEEGHNVDIPVYRQRSSILGGTYLELASVEWRQSNPKAVTEWFDTQVQTHSPDEEGTKQQMRRQVRLLKAFAKSRESWNMPSGFILSVLASEKYHALAGREDVSFYETIRGIHSRLEWDLTVRHPVVDEALTKTAEDASMVELKTQLKQALESLVILHDRDCTKKAALQAWGKVFNTDFFDKFLDDEGKGRGPTILTTSGKQPQFPVKKEGGGRYG

SEQ ID NO: 2784 - protein, 340 aa, Desulfospira joergensenii
MFNCSSEITEFYNKHARLAKAQVDDLAGYRAKNITRLEKGLEKNEDPIPTRHINQGSYAMRTINQHPDNDYDIDIGVIFNKDDLVGRQGADKTALSTRKMVLEAVKDERFNKEPELKKNCVRVFYNEGYHIDMPAYRESINQFGEKKIELASSDWIESDPEAVTKWFNQKVIDVSPDKTNGRQMRRVVRLLKFWAKSRKSWNMPSGFIISKLVSEKYCPIDGRDDESLYYTMDGIKNRLLLDKDVYHPILTSSKLSDGNETAIDEFLERLKTALDDLSILFEDECTNQGALKAWKKIFNHSYFSDKLKSLSTLKAAAGATVISKGEPSKPVKRKGEARFA

SEQ ID NO: 2785 - protein, 362 aa, Desulfotignum balticum
MYDYSDQINSFHGDKVVLSKKLSGNLTSHRTANENRLIKRLPELKNGVKVSRSSFKSQGSFAMRTIIQTKFSDEEYDIDDGLVLWRSDIEDEDGNDMTSSDAKELIREALKDSRFKQQPKTKTNCVRVFYADEDEEKHHVDFPVYRKWETAVSDDVTTHRELAGGDGWVESDPTRVNSWFENEISSRNSAAAESGTQMRQCLRLLKRFCRSRSYWDMPNGMKLTMLTVECFESGERIDSVFRDLLDSLHSRLLDNLEVENLADEDFPRQKLTRTSSDENMIELRDRLEEALGKLEVLDDDDCTKKKARQAWDWVFKSDGYFDDYDGDDDDDDGSGESSGTKKGIATSTPNKAVDPKGGGRFG

SEQ ID NO: 2786 - protein, 463 aa, Sinorhizobium fredii
MTFMIWMYDISADLQKFYDDHVRLGVDRRKDLANKRDLNLERLYGGLDDLQAETGLARPHPYTWYNQGSYAMHTLNQDPAGDNDFDIDVGLIFNKEDLPSDPLAARQRMADALSKRCTNFTQEPTAKKNAVRVAYADGYHIDFAVYRTHTDILGIKHTEHASTTWKPRDPMAINTWFTKCVNDKSPKALPVLGYYPKVKEGQFRRIVRFLKWFARSRPSWSLPGGLIISALVAEVYVSDDDRDDWALFETINALAVRLNSNTQVFNPVSGTEFTESDEIHNQVKRLKTQVNMAVSKLSPLFNQAGCTHAKARSAWDWVFNHPFWADQQKVVKAAFEDAGQALALPYYLKIKCELASKQGGATYRAYPSGSGVLQKNVHLKFSITETNVPQPYLINWEVKNSGDEASEEDALSHATGPGSDNVHWTSTAYKGNHQMICKIIRDGKVLAQAIHIVRIAPGKWWRR

SEQ ID NO: 2787 - protein, 463 aa, Sinorhizobium fredii; identical to SEQ ID NO: 2786

SEQ ID NO: 2788 - protein, 462 aa, Unknown
  Description of Unknown: Methylobacterium sequence
MWMYDISSDLQTFYDTHVRLGKVLRDDLAAKRDLNLNRLYGGLDDLAAESGFSRPHPYTWHNQGSYAMHTLNQDPADLNDYDIDVGLMFNKDDLPSDSQKARQRIADALTKRCTNFTQAPAAKKNAVRVAYADGYHIDFAVYRTYTDATGTLRTEHASTEWKPRDPTAINKWFSDCVTNKIPTAWPAIGYYPKVKDGQFRRIVRFLKWFSRSRPSWSLPGGLIISALVAEVYASDSNRDDRALYDTIVALANRLNGNTKVYNPVTQAEFTENSEIQSQVNRLKTQINMAVAKLAPLFDQQNCTRDKARSAWDWVFNHQFWAGKEKVQKAALDEELNASALAPYYVKIKCELSGTYGGKTYREYASGGGVLQKNTYLKFTVLGTNVPSPYLITWETRNSGDEASDDNALLSITQPSHGYSYWTGTAYKGNHQMVCKITRNGIVVAQTSHLVRVAAGKWWSRSR

SEQ ID NO: 2789 - protein, 460 aa, Methylobacterium sp.
MWMFDLKADFQVFYDTHVRLGTTRRNDLAAKRDLNLNRLNAGLNDLTAETGLPRPYPTTWYNQGSYAMHTLNQDPSDTNDFDIDVGLIFNKDDLPSDPLKARQRIADALAKRCTNFTQEPTAKKNAVRVAYADGYHIDFAIYRTYTDATGTLHTEHASTSWKPRDPMAVNTWFNKCVTEKSPKAMPVLGYYPKVKDGQFRRIVRFLKWFSRSRASWSLPGGLIVSTLVAEVYVPNDTRDDRALYDTIIALKNRLDIHTKVYNPVSGNEFTENTEIQSQVNRLKKQINAAAAKLSPLFDQENCTRDKARSAWDWVFNHSFWADKEKVIKAALDEEITASALMPYFVKIKCELAGRQGGRPYRTYASGGGVLQKNVHLKFTVEGTNVPHPFLVTWEIRNSGDEASDDNALKHSSPPSNDYTHWTSTAYKGNHQMICTITKGGAIVAQTAHLVRIAPGKWWRR

SEQ ID NO: 2790 - protein, 467 aa, Nostoc punctiforme
MFMYDISNDLQYFYDHHVRLGGELRQQLAGYRDLNITRLKNGLDDLKKETNCLHPHPYDSKNQGGYAMHTLNKDPNNDNDYDIDIALIFHRDEIPENPLKARQRVRDALYKRCTNFTKEPEARTNAVTVWYAEGYHIDFAIYRTYIDEFGIKRIEHASTEWKRRDPMQINNWFAECVDTFSPKANFILGYYPKVKEGQMRRIVRFLKWFCRSRISWSLPGGMIVSTLIAESGVYKPNGERDDIALYDTMVALHNRLTVSCKVYNPVDKSQELTGKTEILNQVIRLRDNLKVAIDKLEVLFNHSCTREKARSAWDWVFNHQFWVAKESKKVIDFGDVIAIARYNLTIRCDLAKYENGPTYKHYLSGSSILPKGVALKFTVVSTNVPQPYSVRWIVNNEGDEAQEAEQLCWESSDSATTKWTSTAYKGNHRMTCQIEKNGQVMAETIHIVKIKASGNTRNSSSSNRGFG

SEQ ID NO: 2791 - protein, 468 aa, Oscillatoria nigro-viridis
MYDISDDLQIFYDTHVRLGTIRRQQLATYRDLNITRLKNGLNDLAKETGRPHSHPYDWKNQGGYAMHTLNQDPKGDNDYDIDVSLIFHKDEIPEDPLKARQRVRDALCKRCTNFTKEPESRTNAVTIWYAEGYHIDFAIYRTYIDNLGIKRIEHASTEWKRRDPMEVNDWFSKCVATLSPKASQTLGYYPKVEDGQMRRIVRFLKRFCRSRTSWSLPGGMIVSALVAESGIYTANSERDDLALYNTMVALRNRLKASCHVYNPVDTSQELTGKTEVLNQVTRLRDRLDTAISKLSVLFDESKCTREKARFAWDWIFNHEFWAKKESTKGTIKAELSAVTGYSVTVRCDLAKRENGPIYEQYLSGSSVLPKGVALKFSVISTNVPPLPLYSVQWIVDNEGDEAGEAKQLYWESSDSGTTIWTSTAFKGTHRMTCQIKKEGRVMAQAVHIVKITASGNSRISGSSNRGFG

SEQ ID NO: 2792 - protein, 452 aa, Stenotrophomonas maltophilia
MFDVTALLQQFYDEHVRLGGDRRNRLQQVRDLNLAKLNRGLDDLALESGRAKPHFVEAITQGGFAMHTLNQDPAGLNEYDIDVAVIFNSDDLPVSSLAARQRVRDALGKRTEHMKEAPDLRTNAVTLWYQEGYHVDFAVFRRRTEPSGRTVLEHASTDWVERDPNAVNRWFNQSVSLLSPKNESGQPDIRVRPNQFRRIVRFIKWFCKSRESWSLPGGMVVSSLAAECYQFDRFRDDVSLYNTLVSIVQRLQRSLEIENPVSAGVWLTGREENRNQVARLKAQLELIIPKLNILFEPSCTVEKARGAWDWVFNHQYWGEVREEALAASVREDVEAPQIYQLRIRCELARGGEHGEIYGQYRTAQYPLPKGVGLKFTVAATNVPQPYEIAWHIQNSGDEASAAGQLTWDRYNQAECWTSTKYKGLHRMTCEIRRHGAVVAKAHHVVRVRGMWR

SEQ ID NO: 2793 - protein, 452 aa, Stenotrophomonas maltophilia
MFDVTALLQQFYDEHVRLGGDRRNRLQQVRDLNLAKLNRGLDDLALESGRAKPHFVEAITQGGFAMHTLNQDPAGLNEYDIDVAVIFNSDDLPVSSLAARQRVRDALGKRTEHMKEAPDLRTNAVTLWYQEGYHVDFAVFRRRTEPSGRTVLEHASTDWVERDPNAVNRWFNQSVSLLSPKNESGQPDIRVRPNQFRRIVRFIKWFCKSRESWSLPGGVVVSSLAAECYQFDRFRDDVSLYNTLVSIVQRLQRSLEIENPVSAGVWLTGREENRNQVARLKAQLELIIPKLNILFEPSCTVEKARGAWDWVFNHQYWGEVREEALAASVREDVEAPQIYQLRIRCELARGGEHGEIYGQYRTAQYPLPKGVGLKFTVAATNVPQPYEIAWHIQNSGDEASAAGQLTWDRYNQAECWTSTKYKGLHRMTCEIRRHGAVVAKAHHVVRVRGMWR

SEQ ID NO: 2794 - protein, 449 aa, Erythrobacter sp.
MFNMAADILSFHDQHVKLDSASEKRLAEVRTTNLDRIRNGLGDLNKPIFKAWRNQGGYAMGTVVNDPAGESNHDIDVALIFEKDELPSGALSARQRVRDALCKRGTSFLHDPEARTNAVTVWYADGYHLDFAIYRRSSNILGTVTHEHASTDWVERDPAEVTTWFIDEVENKSPKTDDWGNAPTVRVNQLRRMVRLVKWFCRSRTSWNLPGGMITTALVVECYRPDRSRDDVALYDTLVAINARLRTDCRVWHPNGGGRELTGKAEYLNQVTLLRDKLSANLPKLAVLYEDRCTREKARSAWDWVFNHAFWAAKEVLCEAALAKADLSDGSYWVRISCDLAKSERGKIISRYRGQVVPKNLGLRFFVEDTNVPPPFSIRYDVENEGDDARQAKQLTWSGDASSEDPQWWTSTAYKGIHTMTCNVIKDGLPVASATLTVKIVGGIFRGRR

SEQ ID NO: 2795 - protein, 448 aa, Burkholderia gladioli
MYDASNELAAFYENHVRLGTQLRNDLGGYRDLNLDRLTAGLKSLGDKRNAVYKTFVDSKNQGSYAMHTLNQSEHIDYDIDVAVIFEASDLPDKAADARARVRDALLEKCSNFTKEPEARKNAVTVWYSDGYHIDFAVYRRRTDWFGNQTIEHAGGDEWTARDPMAYTNWFSKQVDSKSPPTYLEVLLGTRVNVAKGQLRRIVRFVKAFARSRSGWALPGGIIITTLVCEVYRPHPTRDDVALVQTLKALLARLQANVDVQNPVQQTAWFTSSDRRKREVERLRDTLADKLPNLDVLHQPLCTPAQAYKAWDAIFYHDYWTGARKAVAQSAANGLTIECALARASKGKVYKAHVSDSSALPKGIHLRFMATPVGVELPYSVRWTVRNEGDEAREEGQLTHNSLLGPAEPYWTSTAFKGRHTMVCEIVKNGQTVRQAEHIVRIGPGTRCL

SEQ ID NO: 2796 - protein, 452 aa, Oryzisolibacter propanilivorax
MFDASNELKTYYENHLRLGTQLRNDLAGYRDLNLQRITDGLKLLGEKNSVTYRTWADYKNQGSYAMHTLNQCEHTDYDIDVAIIFEKDDLPANAADARIRIRDALQEKTKGTNFSKDPDARKNAVTVWYSDGYHIDFAVYRRRTDWLGKTVIEHAGGDEWTERDPMAYTNWFTGQVDSKSPPTMLQSALGMTVTLPKGQLRRIVRFVKAFARSRSAWALPGGITITTLVCEVYKQHATRDDVALVDTLQALLARLKGSVQVENPVQPGVYFTSSDRRRREVERLRDELEAKLPSLDVLYQADCTRKQAMGAWDAIFWHDYWSDVKKEAACSALGSTGLAIECWLSKKSQGPVYKQHKSDSTALPKGVHLRFTAVPDGVAPPYDVRWAVRNEGHEAKEDRALEHDTMKSVNEPYWTSTAYKGRHKMICEVIKDGITVRRGEHLVRIGPGRRFF

SEQ ID NO: 2797 - protein, 442 aa, Caballeronia fortuita
MFNLHTELNVFYNEHVRLPQKLRNDLAGYRDLNVKRLKEGLDELTAQTGVRHAHPVDVQNQGSYAMHTLNQSDSAGYDIDVALVFDEKDLPSDAAMARARVEAALLKRCSNFTQPPEARKNAVTVWYAENYHIDFAVYRKRSDWIGIETVEHAGADGWSPRKPADFASWFDKQLESHDRGDLFRALLGITVEKHQLRRVVRLVKAFARSRSGWSLPGGIVLTTLVCEVYRSDANRDDVALYNTLVALRGRLRASREVLCPVPNHKSLVGSERRQKEMDRLLKCVDSALTSLAPLFTADCTRERALSAWKSVFNHRYWGTQIQEARVAQNASALLLECGLAKRDKGTPYGTYSSGSSILPKGVHLRFRLKQTSVLPPFQVRWTVENEGDEATDDNQVTWTRYTSNHEALWTNTKYRGRQRMKCEVLKDGKVLESTTHIVRISE

SEQ ID NO: 2798 - protein, 442 aa, Spongiibacter marinus
MPITLQEALMPQYNMHNELNAFYEDHVRLKEEMNRLRSLRDTNLTRLSDGLKELGHPVYVKNLLQGSIAMHTANKSSNNDYDIDIAVIFEKDDLPASPLEARKRVAEAINLKSSGFVKDPEARTNAVTIWYAEGYHVDIAVYRRSEGWLGDIIEHAGASWTERDPKAITSWFTEEVTEQSPSETFFGKPSVGPQQMRRIVRWIKAFTKAREGWNLPGGFIISALVAECYKPDKDRDDIALLNTLCAINTRLESSCDVYNPVDATQKLTDKQKFITQVNSLKKHLNSVTKELDVLMEDECTEEKAKKAWNYMFQHQFWEISTESISKNAANDQSYNVKLTMGISKKDGGFLTARNIQSGRIVPKMKHLKFEAKTNVPAPFTVKWRVVNSGDEAEAANDMGHLATSDNLTIWRRTAYRGRHEMICEIVKAGEVVASAVHIVNIR

SEQ ID NO: 2799 - protein, 435 aa, Marinimicrobium agarilyticum
MPQYNMHSELNTFYENHVRLKDEFDRLRFLRDTNLKRLTDGLQEMGRPTFAKSLLQGSIAMHTANKSTNNDYDIDIAVIFEEGDLPASPLEARKRVAEAIKRKANGFSRDPEARTNAVTIWYSLGYHVDIAVYRRRENWLGQETIEHAGADWTPRDPKTVTDWFIGEVSTQSPEKGLFVTPQVAPKQMRRIVRWIKAFTKGREGWNLPGGFIISALVCECYRPHNDRDDIALYNTLEAIESRLKLDCRVFNPVDSSQELTDKPKFLKQVKNLRRRLGSVLSKLDVLFDDNCNNGKANKAWHYMFQHTYWTPQASANASQSQANHYPYDLELTMAIAGSKGGFIKSGNVRSGRFLPKRVHLRFKAQTNAPPPYTVMWEAINSGDEAEAANDMGHQATSNDLMHWEHTSYRGRHELICRIVKAGEVQATAKHVVNIR

SEQ ID NO: 2800 - protein, 465 aa, Poribacteria bacterium
MYNLHAKVNEYYKDYVRLSTDERKKLAGYRDTNLDRLKSGLEKLGEEHDKVYAYYDYYRNQGSYAMFTLNQHPDNEYDIDIAIVFRKVDLPSAALGARQRIADAFNKVAGHFSQDPEPRPNAVTVWYAEGYHIDFAVYRTFEDEYGNTQIEHAGPDWTERDPMGVTNWFNDSVNSSSPSKDYGATVDDYQMRRTVQLLKAFAKSRASWNLPGGLIISVLVDECYRPDYYRDDAALYYTMVAIRDRLVLNTEVNSPTSTLESLTNRDKYKKQVERFRDKLDSAIKKIDPVFADDCTGDEAMKAWNSVFNHPFWAEEVVEDESAAPDDSDIDERALASVRAPKPVLGVSTHQKGIPWEFQKTYGVKIQAYIYLGKKIKLGGLSSDSRTIKSGYDLKYEVKTNAGGQYQVFWQVVNTGRHAEQVGNKRGEVFQSESSNPLVHWEKTEYTGKHWIESFIVKDDICVARS

SEQ ID NO: 2801 - protein, 426 aa, Sandaracinus amylolyticus
MYDASKLLNRFYNEKLRLGRDGRARLAKLRDTNLDRLKSGLEKLGPIRGASKATFESHLDQGSYAMHTLNQHPDDDYDIDTGVIFDESVLPASALDSRKRVAEALLQSGATFLRDPEARTNAVTVWYAEGHHVDLAVYRRTAKGLEHAGADWTARDPSEVTQWFTDRVNALSPFWLIDVERGQLRRIVRFVKRFCASRRSWSLPGGMIATTLVTEVYQHDPSRDDVSLRKTLIALRDRLVKNQRVFSPVDAAQELTGKPQTEAQVRRLQKRLDDLLPKLDVLDDRNCDEATARTAWNSVFRHDFFVTEQDTKTDATTAVNLTIRVAQHENGPLREASYRSSQPPLPKGMWLRFEVAHELKRDDVVRWTVKNEGDEAEAAADLGHTREGRDLVTWRHTRFRGDHTMRCEIVRNGRVIATANRKVRVA

SEQ ID NO: 2802 - protein, 435 aa, Archangium gephyra
MNAMFNCHTALNVFYQQDVRLGPKLRTRLKVSRKACLGHVKEGLRRLGHPVYERVCIQGSYVMHTLNQHPNGEFDIDVAVIFKKEDLPKSPLRARQRVAAAMRASGVRFATMPLARLNAVTVWYSDHHHVDLAVYRESTSFWGKPVLEHASSEWTVRDPVEVTRWFKKEDKRLSPKLDDGAIVEPGQFRRVVRLIKMFTRSRLYWDLPGGLIISTLVAEVYEPAPERDDVALYNTLVRLQKRLRGSYDVKSPVDASSLTRRDKNERQVRDLLARLDDILPRLAILFDPLCMEPRALRAWWFVFRHDYWLKRARTAELASLNQSQNLRIQVGVGDSSSGPFTLYHPSHGPIPKGAHVRFALRKRLGVESPFTCHWKVQNRGSEAQAARDLAHDAVGPEPFFLQEAKYTGRHTVSFELIKDGRVVARGARNLSVAAP

SEQ ID NO: 2803 - protein, 437 aa, Sphingobacterium lactis
MFNYNSKLNQFYNNRVRLKDIDKTLIRDYKNKNIQRIIKGIEKINKEENKLFPIPSFIEQGSIAMNTTNQSEDKDYDIDVAVIFPTDSISNNPLDARKLIAKAINKNNANFSKPAEARTNAVTVWYTEGYHVDFAIYRTFEEFNQTKFEHASTEWLDRNPKAITEWFIERVSTLSPNGFFTNVEKAQLRKIVRLLKRFCKSRLNWNLPGGFILSILAIECYSPNSTRDDISFIETLSNICNRLKYNRTIYNPIRAQIELTSKKSLQHQITRLSEKLDRFVSKSEVLYKNDCTEKKATEFYNWVFNIQEEAKNFSSIKEQSLIENSSISVSVHRDKSLGPILSNIPKQLRVHKKLWLRFTLNTKISPPFDVKWIVENDGDEARAIPDLGHETWEYNCNRQINFHWERAAYKGIHKLKAEIYKNNIKVDSQNFEVRIIK

SEQ ID NO: 2804 - protein, 445 aa, Polaribacter sp.
MYNLNNKLGSFYNEVVRLKEADRNKLREYKKLNLERLNSGIDSINAKENKSYPYPTILEQGSIAMHTANRHDDNDYDIDVAVIFPKDQLPTSALNSRKLVEKFLREKTGNFSKQPEARTNAVTIWYNEGYHVDFAIYRQSIDFFGNTIYEHAGSNWKNRNPQDITNWFSNFVITKSPNKNFGATVENNQFRRIVRLLKKFTRSRENWSLPGGLVISILASECYVPDYYRDDISLVKTINSIYNRLKYNNQVYNPTDKSSELTEKSKYKNEVNRLKEKLKQAVKKLDILNSPECDEDKANEAWKWIFNSDFWKIEIETNSSLNKSFSLPSNLISLNASLHISKNGFRLNSNVTNGNFKIPKKMWLKFNASTNISVPFDVKWIVENKGDEAEAKPDLGHETLDQNIYSSSFSHWEQTAYKGKHKLICQIIKNSQVVATEKFEVIIKK

SEQ ID NO: 2805 - protein, 445 aa, Lacinutrix algicola
MYNLNNKLGSFYNEVVRLKEADRNKLREYKKLNLERLNSGIDSINTKESKSYPYPTILEQGSIAMHTANRHDDNDYDIDVAVIFPKDQLPTSALNSRRLVEKFLREKTGNFSKQPEARTNAVTIWYSEGYHVDFAIYRQSIDFLGNTIYEHAGSNWKNRNPQDITNWFSNFVITKSPNKNFGATVENNQFRRIVRLLKKFTRSRENWSLPGGLVISILASECYFPDYYRDDISLVKTINSIYNRLKYNNQVYNPTDRSSELTEKSKYKNEVNRLKEKLKQAVKKLEILNSPECDEDKANEAWKWVFNSDFWKTEIKTNNASNKSFSLPSNLISLNASLHISKNGFRLNSNVTNGNFKIPKKMWLKFNASTNISVPFDVKWIVENKGDEAEAKPDLGHETLDQNIYSSSFSHWEQTAYKGKHKLICQIIKNSQVVASEKFEVVIKK

SEQ ID NO: 2806 - protein, 454 aa, Bacillus thuringiensis
MYDLNNKLMTFYKKHVVLQGKEKNRLFKLRTSNLDRLKDGLKEYNEEKKTNYSIVDTVVQGSVAMSTVVQNESKDYDIDVAIIFDKDNLPEGTTATKNMVVTALKKKCKQFKEPPTAKTNCVRIVYEEGYHIDFAIYRRYKDEYGEYKYEHCGSEWRPRDPRSITKWFNNENKKKNYNLRIVARLLKMFCKSRPKWEMPGGLVQSVLLNECFQAETRIDEMFYHTLVAVRDRLTIDKEVNNPTDEEQSLKLIQKDDVRLDRLERRLTTYLGKLEVLFEEGCTPEQAIKAWQEFFNHEYWEKQLEQEKETNSAVSKSYASTESRLYNESEEFIEYMFPVNIQYHLSLDCRITQDGFRPYFLNDWLERGLHLPISKQLDFYIKDNYVTKPYHVYWKVKNRGDVAKERNCVRGQIIKTNSETLKECTSFNGEHFVECYIVKQGVCVARAKIDVPIQV

SEQ ID NO: 2807 - protein, 456 aa, Bacillus thuringiensis
MLMYDLNNKLMTFYKKHVVLQGKEKNRLFKLRTSNLDRLKDGLKEYNEEKKTNYSIVDTVVQGSVAMSTVVQNESKDYDIDVAIIFDKDNLPEGTTATKNMVVTALKKKCKQFKEPPTAKTNCVRIVYEEGYHIDFAIYRRYKDEYGEYKYEHCGSEWRPRDPRSITKWFNNENKKKNYNLRIVARLLKMFCKSRPKWEMPGGLVQSVLLNECFQAETRIDEMFYHTLVAVRDRLTIDKEVNNPTDEEQSLKLIQKDDVRLDRLERRLTTYLGKLEVLFEEGCTPEQAIKAWQEFFNHEYWEKQLEQEKETNSAVSKSYASTESRLYNESEEFIEYMFPVNIQYHLSLDCRITQDGFRPYFLNDWLERGLHLPISKQLDFYIKDNYVTKPYHVYWKVKNRGDVAKERNCVRGQIIKTNSETLKECTSFNGEHFVECYIVKQGVCVARAKIDVPIQV

SEQ ID NO: 2808 - protein, 456 aa, Bacillus thuringiensis; identical to SEQ ID NO: 2807

SEQ ID NO: 2809 - protein, 454 aa, Bacillus cereus
MYDLNNKLMTFYKKDVVLQGKEKNQLFKFRTLNLDRLKDGLKEYNEEKKTNYSIVDTVVQGSVAMSTVVQNESNDYDIDVAIIFDKDNLPEGTTATKNMVVTALKKKCKQFKEPPTAKTNCVRIVYEEGYHIDFAIYRRYKDEYGEYKYEHCGSEWRPRDPRSITKWFNNENKKKNYNLRIVARLLKMFCKSRPKWEMPGGLVQSVLLNECFQSETRIDEMFYHTLVAVRDRLTIDKEVNNPTDEEQSLKLIQKDDVRLDRLERRLTTYLGKLDVLFDAGCTSEQAIKAWQEFFNHEYWEKQLEQEKETNSAVSKSYASTESRLYNESEEFIEYMFPVNIQYHLSLDCRITQDGFRPYFLNDWLKRGLHLPISKQLDFYIKDNYVTKPYHVYWKVKNRGDVAKERNCVRGQIIKTNSETLKECTSFNGEHFVECYIVKQGVCVARAKIDVPIQV

SEQ ID NO: 2810 - protein, 456 aa, Bacillus cereus
MLMYDLNNKLMTFYKKDVVLQGKEKNQLFKFRTLNLDRLKDGLKEYNEEKKTNYSIVDTVVQGSVAMSTVVQNESNDYDIDVAIIFDKDNLPEGTTATKNMVVTALKKKCKQFKEPPTAKTNCVRIVYEEGYHIDFAIYRRYKDEYGEYKYEHCGSEWRPRDPRSITKWFNNENKKKNYNLRIVARLLKMFCKSRPKWEMPGGLVQSVLLNECFQSETRIDEMFYHTLVAVRDRLTIDKEVNNPTDEEQSLKLIQKDDVRLDRLERRLTTYLGKLDVLFDAGCTSEQAIKAWQEFFNHEYWEKQLEQEKETNSAVSKSYASTESRLYNESEEFIEYMFPVNIQYHLSLDCRITQDGFRPYFLNDWLKRGLHLPISKQLDFYIKDNYVTKPYHVYWKVKNRGDVAKERNCVRGQIIKTNSETLKECTSFNGEHFVECYIVKQGVCVARAKIDVPIQV

SEQ ID NO: 2811 - protein, 456 aa, Bacillus cereus
MLMYDLNNKLKTFYKKDVVLQGKEKNQLFKFRTLNLDRLKDGLKEYNEEKKTNYSIVDTVVQGSVAMSTVVQNESNDYDIDVAIIFDKDNLPEGTTATKNMVVTALKKKCKQFKEPPTAKTNCVRIVYEEGYHIDFAIYRRYKDEYGEYKYEHCGSEWRPRDPRSITKWFNNENKKKNYNLRIVARLLKMFCKSRPKWEMPGGLVQSVLLNECFQSETRIDEMFYHTLVAVRDRLTIDKEVNNPTDEEQSLKLIQKDDVRLDRLERRLTTYLGKLDVLFDAGCTSEQAIKAWQEFFNHEYWEKQLEQEKETNSAVSKSYASTESRLYNESEEFIEYMFPVNIQYHLSLDCRITQDGFRPYFLNDWLKRGLHLPISKQLDFYIKDNYVTKPYHVYWKVKNRGDVAKERNCVRGQIIKTNSETLKECTSFNGEHFVECYIVKQGVCVARAKIDVPIQV

SEQ ID NO: 2812 - protein, 456 aa, Unknown
  Description of Unknown: Bacillus cereus group sequence
MLMYDLNNKLKTFYKKDVVLQGKEKNQLFKFRTLNLDRLKDGLKEYNEEKKTNYSIVDTVVQGSVAMSTVVQNESNDYDIDVAIIFDKDNLPEGTTATKNMVVTALKKKCKQFKEPPTAKTNCVRIVYEEGYHIDFAIYRRYKDECGEYKYEHCGSEWRPRDPRSITKWFNNENKKKNYNLRIVARLLKMFCKSRPKWEMPGGLVQSVLLNECFQSETRIDEMFYHTLVAVRDRLTIDKEVNNPTDEEQSLKLIQKDDVRLDRLERRLTTYLGKLDVLFDAGCTSEQAIKAWQEFFNHEYWEKQLEQEKETNSAVSKSYASTESRLYNESEEFIEYMFPVNIQYHLSLDCRITQDGFRPYFLNDWLKRGLHLPISKQLDFYIKDNYVTKPYHVYWKVKNRGDVAKERNCVRGQIIKTNSETLKECTSFNGEHFVECYIVKQGVCVARAKIDVPIQV

SEQ ID NO: 2813 - protein, 456 aa, Bacillus cereus
MLMYDLNNKLKTFYKKDVVLQGKEKNQLFKFRTLNLDRLKDGLKEYNEEKKTNYSIVDTVVQGSVAMSTVVQNESNDYDIDVAIIFDKDNLPEGTTATKNMVVTALKKKCKQFKEPPTAKTNCVRIVYEEGYHIDFAIYRRYKDECGEYKYEHCGSEWRPRDPRSITKWFNNENKKKNYNLRIVARLLKMFCKSRPKWEMPGGLVQSVLLNECFQSETRIDEMLYHTLVAVRDRLTIDKEVNNPTDEEQSLKLIQKDDVRLDRLERRLTTYLGKLDVLFDAGCTSEQAIKAWQEFFNHEYWEKQLEQEKETNSAVSKSYASTESRLYNESEEFIEYMFPVNIQYHLSLDCRITQDGFRPYFLNDWLKRGLHLPISKQLDFYIKDNYVTKPYHVYWKVKNRGDVAKERNCVRGQIIKTNSETLKECTSFNGEHFVECYIVKQGVCVARAKIDVPIQV

SEQ ID NO: 2814 - protein, 456 aa, Bacillus thuringiensis
MSMYDLNNKLMTFYKKDVVLQGKEKNQLFKFRTLNLDRLKDGLKEYNEEKKTNYSIVDTVVQGSVAMSTVVQNESNDYDIDVAIIFDKDNLPEGTTATKNMVVTALKKKCKQFKEPPTAKTNCVRIVYEEGYHIDFAIYRRYKDEYGEYKYEHCGSEWRPRDPRSITKWFNNENKKKNYNLRIVARLLKMFCKSRPKWEMPGGLVQSVLLNECFQAETRIDEMFYHTLVAVRDRLSINKEVNNPTDEEQSLKLIQKDDVRLDRLERRLTTYLGKLDVLFDAGCTPEQAIKAWQEFFNHEYWEQQLEQETETNSAVSKSYASTESRLYNESEEFIEYMFPVNIQYHLSLDCRITQDGFRPYFLNDWLERGLHIPISKQLDFYIKDNYVAKPYHVYWKVKNRGDVAKERNCVRGQIIKTNSETLKECTSFNGEHFVECYIVKQGVCVARAKIDVPIQV

SEQ ID NO: 2815 - protein, 456 aa, Bacillus cereus
MLMYDLNNKFMTFYKKHVVLQGKEKIRLFKLRTLNIDRLKDGLKEYNEENKTNYAVEDTVVQGSVAMSTVVQNESKDYDIDVAIIFDKDNLPEGTTATKNMVVTALKKKCKQFKEPPTAKTNCVRIVYEEGYHIDFAIYRRYKDECGEYKYEHCGSEWRPRDPRSITKWFNNENKKKNYNLRIVARLLKMFCKSRPKWEMPGGLVQSVLLNECFQSETRIDEMFYHTLVAVRDRLTIDKEVNNPTDEEQSLKLIQKDDVRLDRLERRLTTYLGKLDVLFDAGCTSEQAIKAWQEFFNHEYWEKQLEQEKETNSAVSKSYASTESRLYNESEEFIEYMFPVNIQYHLSLDCRITQDGFRPYFLNDWLKRGLHLPISKQLDFYIKDNYVTKPYHVYWKVKNRGDVAKERNCVRGQIIKTNSETLKECTSFNGEHFVECYIVKQGVCVARAKIDVPIQV

SEQ ID NO: 2816 - protein, 454 aa, Bacillus cereus
MYDLNNKLMTFYKDHVVLSRKEKSRLFKLKNLNLDRLKDGLKEYNVENKTNYAVEDTVVQGSVAMSTVVQNESNDYDIDVAIIFDKDDLPEGTLATKNMVANALKKKCTQFKEPPTAKTNCVRIVYEEGYHIDFAIYRRYKDEYGEYKYEHCGSEWRPRDPRSITKWFNNENKEKNYNLRIVARLLKMFCKSRPKWEMPGGLVQSVLLNECFQAETRIDEMFYHTLVAVRDRLTIDKEVNNPTDEEQSLKLIQKDDVRLDRLERRLTTYLGKLDVLFDAGCTSEQAIKAWQEFFNHEYWEKQLEKEKETNSAVSKSYASTESRLYNESEEFIEYMFPVNIQYHLSLDCRITQDGFRPYFLNDWLKRGLHLPISKQLDFYIKDNYVTKPYHVYWKVKNRGDVAKERNCVRGQIIKTNSETLKECTSFNGEHFVECYIVKQGVCVARAKIDVPIQV

SEQ ID NO: 2817 - protein, 456 aa, Bacillus cereus
MRMYDLNNKLMTFYKDHVVLSRKEKSRLFKLKNLNLDRLKDGLKEYNVENKTNYAVEDTVVQGSVAMSTVVQNESNDYDIDVAIIFDKDDLPEGTLATKNMVANALKKKCTQFKEPPTAKTNCVRIVYEEGYHIDFAIYRRYKDEYGEYKYEHCGSEWRPRDPRSITKWFNNENKEKNYNLRIVARLLKMFCKSRPKWEMPGGLVQSVLLNECFQAETRIDEMFYHTLVAVRDRLTIDKEVNNPTDEEQSLKLIQKDDVRLDRLERRLTTYLGKLDVLFDAGCTSEQAIKAWQEFFNHEYWEKQLEKEKETNSAVSKSYASTESRLYNESEEFIEYMFPVNIQYHLSLDCRITQDGFRPYFLNDWLKRGLHLPISKQLDFYIKDNYVTKPYHVYWKVKNRGDVAKERNCVRGQIIKTNSETLKECTSFNGEHFVECYIVKQGVCVARAKIDVPIQV

SEQ ID NO: 2818 - protein, 456 aa, Bacillus toyonensis
MRMYDLSNKFNTFYKKYVVLSRQQKSRLFKLKNLNLDRLKDGLKEYNEENKKNYEIVDTVIQGSVAMSTVVQNESNDYDIDVAIIFDKDNLPEGTAATKNIVVNALKKKCTQFKEPPTAKTNCVRIVYEEGYHIDFAIYRRFKDNHDEYQYEHCGSEWRPRDPRSITRWFINENKEKNYNLRVVARLLKMFCKSREKWEMPGGLVQSVLLNECFQNDTRIDEMFYNTLTAVRDRLTMNKEINNPTDEEQSLKLIQKDDVRLDNLEKRLTNYLGKLDILFDENCTIKQAIEAWKDFFNHSYWEKQLEQAKETSATVSKSYAAIESRLYNESEEFIEYMFPVNIQYFLSLECRVTHDGFQPYYLNEWLKKGWNLPISRQLDFYIKNNHVPKPYQVYWKVKNRGDVAKEKNCVRGQIIKTNSETHKECTSFKGEHFVECYIIKKGVCVARAKIDVPIEL

SEQ ID NO: 2819 - protein, 452 aa, Alicyclobacillus acidiphilus
MYDLSTKFNTFYQNYVVLPKTEKTKLFRLKNLNVSRLKDGLKEYNEENSTNYRIVDTVVQGSVAMSTVTQNENKDYDIDVAIIFDKDNIPSGTTAVKNIVVNALKKKTKQFNTEPVAKTNCVRIVYADGYHIDFAIYRRYKDEDGNYHYEHCGSDWRPRDPRAVTKWFNEASKSWNHKLRIVVRLLKMFSKSRDYWVMPGGVILSVLTNENFRSLYRIDEMFYETLTAIKNRLAIDKEVLNPVDEDQSLKLIQKDDVRIENLYNRLNSYLASLDVLFRSDCTESQAVEAWGKFFNHDYWNEQVIAEDGQTFMKSISASNVMYDETEEFIEYLFPVDLKYNLKIDCRVSQDGWRTELLSAILRKKGKLRIRKKLNFFIVMNDVPKPYSIYWKVKNRGDVAKRKNQVRGQIVKTNKTEHYEETHFQGEHFVECYIVKDQVCVAMDRIDVPIDTQ

SEQ ID NO: 2820 - protein, 456 aa, Bacillus toyonensis
MHDVSIEFNRFYKKHVILPRKEQKKLFEKKNLNLDRLVDGLIEYNEENKTNYVMVDSVVQGSVAMSTVTQNEENDYDIDVAIIFDKDNIPSGTTKMKNIIVNALKKKCKQFKVEPEAKTNCVRIVYSDGYHIDFAIYRRFKDDKDEYKYEHCGSEWRARDPRTITKWFIEQNKEKSHNLRTVVRLMKMFCKSRSDWKMPGGLIQSVLANEQFQSNERIDEMFYYTLKAIRDRLSVNKAVYNPTDENQDLKLIKTDEAKMNNLCSRLTIYLTKLDILFTDDCTDKQAMEAWNTFFNHSYWSDEIEKLAEATILVNKSFANELDESDYNYRETEEFIEYMFLVEERYQLHIDCQITQDGFRPAYLRDFLRKKNWLSPQKKLDFYIRTDTPKPYDIYWKIKNKGIVANQKDCIRGQIVKTNSPSHQEYTAFKGEHFVECYIVKNGVCVAWDRIDVPIST

SEQ ID NO: 2821 - protein, 472 aa, Clostridium formicaceticum
MYNIDKEMRKFYRTKVVLAQSEQKSLIEKKDLNLDRLKGGLKEYNEENDTNYKIVDSMVQGSVAMQTVVQAEENNYDIDVGIVFNKSNLPAPKSSENNTTTVKNIVHDALLKKSSFFKTPPEKRTNCIRIQYANGYHIDFAIYRREKNEQGEYIYQHCGADWNYRNPRSITKWFKERDRVHSFNLKRIVRLLKAYLKQDSSWSVPGGLIQSVLADECIQISDRLDKMLYDTIIEIINRLDIDTEAYNPVDTDDNGNKITLLTTESHKDKMTKMKNYLDKGIKKLSVLFDESCTKEQAFTAWADFFNHNYWTELAENSVQKSLSETFSKFAGIEDDIYDFDETEEFIEDLYPISSTQYSLKIECKVEQKGYRIDSLQNFLRFNKFLNPHKKLHFKIIENTVPYPYKIFWKVLNRGKDAERRNEIRGQIIKGNSGDDVRIENTKFSGNHIVYCYIVKDGECVAKDSIIVPIEAN

SEQ ID NO: 2822 - protein, 474 aa, Clostridium formicaceticum
MSMYNIDKEMRKFYRTKVVLAQSEQKSLIEKKDLNLDRLKGGLKEYNEENDTNYKIVDSMVQGSVAMQTVVQAEENNYDIDVGIVFNKSNLPAPKSSENNTTTVKNIVHDALLKKSSFFKTPPEKRTNCIRIQYANGYHIDFAIYRREKNEQGEYIYQHCGADWNYRNPRSITKWFKERDRVHSFNLKRIVRLLKAYLKQDSSWSVPGGLIQSVLADECIQISDRLDKMLYDTIIEIINRLDIDTEAYNPVDTDDNGNKITLLTTESHKDKMTKMKNYLDKGIKKLSVLFDESCTKEQAFTAWADFFNHNYWTELAENSVQKSLSETFSKFAGIEDDIYDFDETEEFIEDLYPISSTQYSLKIECKVEQKGYRIDSLQNFLRFNKFLNPHKKLHFKIIENTVPYPYKIFWKVLNRGKDAERRNEIRGQIIKGNSGDDVRIENTKFSGNHIVYCYIVKDGECVAKDSIIVPIEAN

SEQ ID NO: 2823 - protein, 469 aa, Clostridium botulinum
MYNLDKEIRSFYRKKVVLSSEKQKSLIEKKDLNLDRLKAGLKEYNEENGTDYKIVDTIIQGSVAMQTVIQAEDNNYDIDVGIAFNKDNLPQPITSENNTQKVKNIVHSALLKKATVFKFKPEKRTNCIRVIYSDGYHIDFAIYRRYKDENDEYIYEHCGADWVYRNPRTITKWFKSRDKAYNYNLKRIVRLLKAYLKQDSSWSVPGGLIQSVLADECFKSSSRLDEMLYNTIEAIVNRLEENTEVNNPVDKDSEGKEIPLLRTQEHKDKVIKMKNYIKKGLNKLSILFDGNECTEEKALRAWGDFFNNDYWTELADEISNTSIAESINKSFSALNQDVYDYNETEEFIEELYPINEKYNIDIECKVQQSGYTVDTLRNFLRFNKYLKPNKKLYFEVKNNTVPRPYKIYWKVLNAGNEAMKRNEIRGQIVKGDRTHTEDTLFSGNHKVYCYIVKNEECVAMNDIDVPIYI

SEQ ID NO: 2824 - protein, 458 aa, Parageobacillus thermoglucosidasius
MYDLNNKFNTFYRKHVVLPKEKKNDLFQKKNLNISRLKKGLEEYNEEHGTDYQLIDHVVQGSVAMSTVVQNEDNDYDIDVAIIFDKDKLPEGTRATKNIIVDALKRKCTGFKKEPEAKTNCVRIEYSEGYHIDFAIYRRYKDDNENYVYEHGGSEWRRRDPWAITKWFLNRNKENDYKLREVVRLLKMFVKSRDHWVNMPGGLVLSVLAEEQCQSIYERMDERFYYTAKAIRDRLNYSKEVYNPTDPTQSLILTKKDEEKLENLRKRLDENLQKLDVLFNSDCTEEEALEAWEQFFNHHYWTEQKEKAKEKNEVAKSYYFFNEADETWFYDDTEEYIENYFPLDLKYKVELDCKVKKNGKFVDWLSDMRKKKIPLLPNRELYFYASTDAPKPYQVYWKVRNRGEEAKKRNCLRGQIIHTDELIQYEESCFKGDHYVECYIVKNGICVARGRIDVPIKA

SEQ ID NO: 2825 - protein, 456 aa, Paenibacillus polymyxa
MYNLNTKFKTFYHSEVVLPKAEKQKLFNKKNINIKRLKEGLEEYNAENGTNHNSAETPIVQGSVAMSTVVQNEENDYDIDVAIVFDKSNLPEGTTKTKNVIVNALTRKCSQFNVEPEAKTNCVRIVYAENYHIDFAIYRRFTDENGEYKYEHCGSEWRERNPRAITKWFLDQNKDKEYKLREIVRLMKMFSKSRSGWANMPGGLIQSVLADEKFQSYDRTDERFYYTMVSIRDRLAVDKEVYNPTDTTKSLKLVSSDSTKMDNLYNRLNDKLIKLDILFDSDCTYKQAVEAWENFFNHSYWTDLKQEERAQLTKSYSQLSESQVYYDYRETEEYISNMFPVNLKFNLELDCVVSKNDKRVGWLQAMLQRRELLLPEHGLNFRAQTDAPMPYEVYWKVRNRGDIAKQKDCIRGQIKRTDSLYHVEETSFKGDHYVECYIIKSGECVAKGKVDVPIRV

SEQ ID NO: 2826 - protein, 456 aa, Gorillibacterium sp.
MYNMHSKFKAFYQRNVVLSNKEKQSLFNKKNINVQRLKDGLKEYNEEKGTDYKLAETPIVQGSVAMSTVVQNEDNDYDIDVAIVFDKSNLPDGTTATKNIIVNALKKKCSQFNVEPEAKTNCVRIVYAENYHIDFAIYRRYVDEDGNYKYEHCGSEWRERDPRKITKWFLDQNKGREYKLREVVRLIKMFSKSRSAWANMPGGLIQSVLVDEKFQSCDRADERFYHTMVAIRDRLADHKEVYNPADPTKSLKLVSSDSVKMENLYNRLKDKLGKLDILFDSDCTYNQAIEAWEEFFNHSYWTDLKQVERALMTKSYSQLSESEVYYDYRETEEYIDTLFPVNLRYVVNLDCKVKKDERVVGWLSEMRKQHKLLLPGYNLYFEASTDAPRPFQVYWKVKNRGPMALEQDCIRGQIERTDKLTQVEPTSFRGDHYVECYIIKGAECVAKARIDVPIRV

SEQ ID NO: 2827 - protein, 462 aa, Bacillus sp.
MFNLENKFKTFYGTHVVLPKVEKQQLYGKKNLNISRLKEGLKEYNEEHGTSYKLAEEPIIQGSVAMSTVIQNEMSHYDIDVAIVFEKDNIPSGTIATKNMVVNALKRKCKQFKIEPTAKTNCVRIEYSEGYHIDFAIYRRYKNENDVYQYEHCGSQWRERNPRSITKWFNDENKVKDYQLRDIVRLLKMFCKSRSFWINMPGGLIQSVLSVEKFQSYDRLDERFYYTINAIKNRLAIDKEVYNPTDSTKSLKLVSKDSIKMTNLYNRLNDKIAKLDILFNDTCTWNQAVEAWGDFFNHEYWYKLKEEDNQKVAKALRTFSESVTLFRESEEYYDYRDTEEFIEDTFPINLQYSMDLDCKVSRSGKPTKWLNTMLGKNEPLLTGYGLDFIAAVKIPQPYDVYWKIKNQGLIAKQNNDIRGEVLKTDKLTHYEVASFQGNHFVECFIIKRGECVARKKISVLIT

SEQ ID NO: 2828 - protein, 461 aa, Solibacillus isronensis
MKNLNGKFNTFYGKHVVLPKKEKDSLFEKKNLNINRLKEGLKEYNQEKGTSYKLSEEAIVQGSMAMATVTQNESNDYDIDVAIVFEKDQLPPGTTATKNMIVNALKRKCKNFKKEPTAKTNCVRIEYQEGYHIDFAIYRRYKKNESDDTYTYEHCGSEWRERNPRAITKWFLDANTEKNYQLREVVRLLKMFSKSRDGWVNMPGGLIQSVLADEKFQSYERMDECFYYTIKAIRDRLLWNKEVVNPTDPTKSLKLVSKDDTKMDNLYNRLNEKLSKLEILFDDTCTDLQAIEAWEAFFNHSYWTTQKEEISKALESYSSFNEAEEEFVRFRETEEFIQNLLPVNYQSQYELNLDCKVVKNEKTLGWLQIMRLKREVLLPKCQLYFQAKTNVPAPYNVYWKVRNRGIIAKREDSIRGEIQQTDKLTHYEETQFKGNHYVECYIVKNGVCVAKKRIDVEIKLS

SEQ ID NO: 2829 - protein, 455 aa, Paenibacillus odorifer
MYDMSKKFNTFYKKFVILQKSEKDTLFQKKKLNIKRLNEGLADYNAENGTEIKLAENIVQGSVAMSTVTQNENNEYDIDVAIIFEKDKLPEGTIATKNIIVKALKKKCTNFKVEPFAKTNCVRIVYNDGYHIDFAIYRRFKDEEDNYKYEHCGSDWRPRDPKAITKWFLDQNKHHNYHLREVVRLLKMFSKSRETWVNMPGGLIQSVLADEKIQTAYSRVDERFYYSIVEIRNRLEDHTEVDNPTDSQHSLKLVGSDNQKMKNLCSRLTNKIKDLDILFDSKCDEKQAFKAWYDFFNHSYWTNLIQEDAVAKSLSTFAAEDELYDFRETEEFVDNIFSIDIRYQLDLNCKVKNRDSFVGWLDNILSRRDLLLPGYQLYFSGSTNTPAPYNIYWKVKNQGDLAKKNDCVRGQIIQTDKLTHYEETNFRGNHFVECYIIKDGICVARKKIMVPIRVS

SEQ ID NO: 2830 - protein, 462 aa, Bacillus sp.
MYDLNGKFNTFYSSKVVLKREQKRELHDKKNLNIDRLKDGLIEYNEEFGTDYKLAEEPVVQGSVAMHTVTQNETNDYDIDVAIVFEKDNLPEGTLASKRIVEKALLKKCTGFTIPPKAHTNCVRIVYQDGYHIDFAIYRRFKKDENNDEYTYEHCGSEWRERNPRSITKWFVDQNKVHNHRLREIARLLKMFSKSRGSSWDMPGGLIQSVLADEKCESTYTRLDERFYYTIKAIKDRLAFNKEVYNPTDPAKSLTLVQKDSTKMTNLYNRLSTNISKLDILFDSNCTKEQALTAWEGFFKHEYWSEQLTENRSTFELSKSSMHESESFYDFRETEEFIDYILPINLKFDLQLDCNIVKGDKEIGKLSSYLRDGKALDKGLSLYFNASTNVTPPYDVYWKTRNRGRLAKIQDDIRGQITPSTIGENKLFHHETTSFSGNHYVECYIVKRGVCVARKKIDVPIK

SEQ ID NO: 2831 - protein, 464 aa, Bacillus sp.
MLMYDLNGKFNTFYSSKVVLKREQKRELHDKKNLNIDRLKDGLIEYNEEFGTDYKLAEEPVVQGSVAMHTVTQNETNDYDIDVAIVFEKDNLPEGTLASKRIVEKALLKKCTGFTIPPKAHTNCVRIVYQDGYHIDFAIYRRFKKDENNDEYTYEHCGSEWRERNPRSITKWFVDQNKVHNHRLREIARLLKMFSKSRGSSWDMPGGLIQSVLADEKCESTYTRLDERFYYTIKAIKDRLAFNKEVYNPTDPAKSLTLVQKDSTKMTNLYNRLSTNISKLDILFDSNCTKEQALTAWEGFFKHEYWSEQLTENRSTFELSKSSMHESESFYDFRETEEFIDYILPINLKFDLQLDCNIVKGDKEIGKLSSYLRDGKALDKGLSLYFNASTNVTPPYDVYWKTRNRGRLAKIQDDIRGQITPSTIGENKLFHHETTSFSGNHYVECYIVKRGVCVARKKIDVPIK

SEQ ID NO: 2832 - protein, 464 aa, Bacillus megaterium
MLMYNLNGKFNTFYSSKVVLKKEQKRELHDKKNLNIDRLKDGLIEYNEEFGTDYKLAEEPVVQGSVAMHTVTQNETNDYDIDVAIVFEKDNLPEGTLSSKRVVEKALLKKCTGFTIPPKAHTNCVRIVYQDGYHIDFAIYRRFKKDENNDEYTYEHCGSEWRERNPRSITKWFVDQNKVHNHRLREIVRLLKMFSKSRGNSWDMPGGLIQSVLADEKCESTYTRLDERFYYTIKAIKDRLAFNKEVYNPTDPTKSLALVQKDSTKMTNLYNRLSTNISDLDILFDSDCTKEQALTAWEGFFKHEYWSEQLTENRSAFELSKSSMHGSGSFYDFRETEEFIDYILPINLKFDLQLDCNIVKGDKRIGTLSSYLRDGKALDKGLDLYFNASTNVTPPYDVYWKTRNRGRLAKIQDDIRGQITPSTIGENKLFHHETTSFSGNHYVECYIVKRGVCVARKKIDVPIK

SEQ ID NO: 2833 - protein, 464 aa, Bacillus cereus
MSMYDLSGKFNTFYSTHVVLKKDQKNELYEKKKLNIQRLKAGLIAYNEEFGTDYKMAEEPVIQGSVAMHTVTQNESNDYDIDVAIVFEKDNFPDSTILAKRVIEKALLKKCSGFTIAPKAHTNCVRIVYKDGYHIDFAIYRRFKKDEQDNEYTYEHCGSKWRERNPRSITKWFMEQNKNHNSRLRETVRLMKMFSKSREKWEMPGGLIQSVLADEKCESTYTRLDERFYYTIKSIKERLDNDKEVFNPTDKSQSLTLVQKDITKIGNLHTRLTTYLSKLDILFQSTCTEAQAIAAWNDFFQHSYWDDLQENRSLSEVSKSYTLAPEPYYNFRETEEFIEYVAAINLKNELHLECNIVKGDKFLGKLSDVLEQNQTLNRGLGLYFTANTNALPPYTVYWKVKNRGNVAKSKDMIRGELTPSRIPENALFHYEETEFNGDHFVECFIIKNGVCIARNKIKVPIRVK

SEQ ID NO: 2834 - protein, 467 aa, Bacillus cereus
MSMYDLSGKFNTFYSTHVVLKKDQKNELYEKKKLNIQRLKAGLIAYNEEFGTDYKMAEEPVIQGSVAMHTVTQNESNDYDIDVAIVFEKDNFPDTTLLAKRVIEKALLKKCSGFTIAPKAHTNCVRIVYKDGYHIDFAIYRRFKKDEQDNEYTYEHCGSKWRERNPRSITKWFMEQNKNHNSRLREIVRLMKMFSKSREKWEMPGGLIQSVLADEKCESTYTRLDERFYYTIKSIKERLDNDKEVFNPTDKSQSLTLVQKDITKIGNLHTRLTTYLSKLDILFQSTCTEAQAIAAWNDFFQHSYWNDLQENRSLSEVSKSYTLAPEPYYNFRETEEFIEYVAAINLKNELHLECNIVKGDKFLGKLSDVLKQNQTLDRGLGLYFTANTNALPPYTVYWKVKNRGNVAKSKDMIRGELTPSRIPENALFHYEETEFNGDHFVECFIIKNGVCIARNKIKVPIRVKQKI

SEQ ID NO: 2835 - protein, 464 aa, Bacillus thuringiensis
MSMYDLSGKFNTFYSTHVVLKKDQKNELYEKKKLNIQRLKAGLIAYNEEFGTDYKMAEEPVIQGSVAMHTVTQNESNDYDIDVAIVFEKDNFPDSTISAKRVVEKALLKKCSGFTIAPKAHTNCVRIVYKDGYHIDFAIYRRFKKDEQDNEYTYEHCGSKWRERNPRSITKWFMEQNKTHNSRLREIVRLMKMFSKSREKWEMPGGLVQSVLADEKCESTYMRLDERFYYTIKSVKERLDNDKEVFNPTDKSQSLTLVQKDITKIGNLHTRLTTYLSKLDILFQSTCTEGQAIAAWNDFFQHPYWNDLEENRTLSEVSKSYTLAPEPYYNFRETEEFIEYVAAINLKNELHLECNIVKGDKFLGKLSDVLEQNQTLNRGLGLYFTANTNALPPYTVYWKVKNRGNIAKSKDMIRGELTPSRIPENALFHYEETEFNGDHFVECFIIKNGVCIARNKIKVPIRVK

SEQ ID NO: 2836 - protein, 464 aa, Sporosarcina sp.
MGMYNMNGMFNTFYNNYVVLKKTQKNELHEKKKTNIERLKNGLIAYNQENSTDYKMAEEPVTQGSVAMHTVTQNESNDYDIDVAIVFEKDNFPESTTIAKRVIEQALLKKCTGFKIAPKAHTNCVRVVYKDGYHIDFAIYRRFKESENDDEYTYEHCGSQWRVRNPRSITHWFIKQNKIHDSRLREVVRLLKMFTKSRKDWEMPGGLIQSVLTDEKCQSTYTRLDERFYYTLDHIKNRLESTMEVLNPTDATQSLMLVQHDITKMTNLLNRISSHLKKLNVLFESNCEESQAISAWNDFFNHHYWENLKEDRSISELAKSQSNKFESFYDFRETEEFIEYITPINLKNTLKLDCNIVSGNKTIGKLSDVLKNNQTLDSGLGLYFIATTNASPPYKVYWKVKNRGDVAKRNDVIRGELTSGIIKENQLFHYEETEFNGNHFVECYIVKKGICIARGKIKVPIKVK

SEQ ID NO: 2837 - protein, 465 aa, Bacillus amyloliquefaciens
MYDLSGKFNTFYNNHVVLKREQKTDLHEKKDINIKRLKDGLQAYNDENGTDYKLAEDPVVQGSVTMHTVTQNDSNDYDIDVAIVFEKDGIPDGTIAAKRVVEKALLKKCTGFKEEPKAHTNCVRVVYKDGYHIDFAVYRRYKENESDTEYIYEHCGSEWRERDPRKITKWFISQNRDVHDLKLREIVRLLKMFCKSRSSWSMPGGLIQSVLADESCFSDYARMDERFYYTLYAIKNRLKENKEVYNPTDTSKSLTYTEKDESKVQNLYNRLTTYLEKLSVLFDDKCSKKDALKAWCDFFDHSYWAGELNSENVRSVYGVSKSYTAADEVQPYNVFRETEEFIEHQFPINIKFETKLGAAIVKNDKQIGILDDYLKREEKLDKNLSLYFKVRTSASEPYEVYWKVKNRGDAAERVDQIRGEIFKGLYPEKTFHQESTSFSGNHYVECYIIKNGECVGKSRIKVPIV

SEQ ID NO: 2838 - protein, 451 aa, Staphylococcus hominis
MFNLEEEFKYFYTQKVQISDKKVEELLEKKEININRLKTGLKEYNNTNQTNHKLLEHIIQGSVSMKTIIQHEDNNYDIDVAIVFDKDSIPDSTIAVKNIVVNALRKKCKQFNVEPEFKTNCVRINYQDGYHIDFAIYRKRYKDNNDFIYEHCGSEWRSRDPKAISKWFYKENKRHGNTSIERVRLLKAFCKSREGWANMPGGLIQSVLINETNANFERMDERFYYTLKSIQNRLFQNKEVYNPTDPSQNLKLVKSDDSKMNNLCRRLNNNLKKLDILFDSNCTKKQALTAWGNFFNEDFIDLSQKSFNKSNLSIKKESNNISEMFIKELFPEKIIYNLTLDCQIYNMKQKGKYIGMLRSFLKQKQVLLPNYKLRFVAQTNVPEPYDVYWKVKNNGLEAEKRNCLRGEIFKNNSLHHIENTLFKGKHFIECYIVKDGVCVAKNRIYVPIKFQ

SEQ ID NO: 2839 - protein, 448 aa, Clostridium sp.
MYDLSKEFKNFYENKVVLPAAEKTKLRDKKKLNIDRLESGLDEYNEENNQSYEVVETREQGSVAMSTVTQNDSNDYDIDVAVVFDKDNIDGIGHREIKNIVVDALKRKCTNFKKEPEALKNCVRIEYNDGYHIDFAIYRKSVDDDGNISYEHAGSTQWQERNPAAINDWFSTEISEKGTGLREVVRLSKMFCKSRSSWQMPGGLIQSVICDEKFQDYDRMDEMFYQTMCAVRDRLNDSIEVYNPTDSTKSLLLKQKDRDEMDNWKNRLTDKLDKLEILFDEENCSEKKAKDAWYDFFQHDFWKTSSEAKQCYSEVSCVYYNNTEQDIRDMFPVKKYYNLELECIIEADGFRPTYLSSFLKIYKWLPHNKTLKFSIKSTNAPSDCDIYWKVCNVGEEAKRRNCIRGQIIKTNKTTQIEHTNFRGEHFVECYLVKYDEVVAMARVDVPIE

SEQ ID NO: 2840 - protein, 835 aa, Desulfonispora thiosulfatigenes
MNYYAVVIITIVLCVLLAFLVLKIKNVNKEQTTGGMLVGTGLGLITSSFPSLTDRIFDFGEKFLTNTNTVSSSEVNLISLICGFILILLGIYYNKNIKDRFFVLNILSKDRRLISDRKTVKDLNISDFKLKEHQIDVVRMFNDANNITQSSCKYIVEEIEEKAKNFINQSGDFKKAFTGMFSIPFTILAGTYLSATEIDEYLEYNRNKGKYSSLGLKKWYQKKISYPDLNITTQNTNKQSKEIVVAVSITKNITDEDLVQFRGKDTLNIGLQNPKDNVIELRKQLEDYVKSIIDNIENLKTVYPNLEIVHLVGAIPSCLSIELGRKISLNRNRLPLIMSYHFKFGNTPKYNFGIIVTEKDKGKLIKNRENIGIMYDLSSDFKKFYYNEVVLPKEETNNLREKKKLNIQRLKDGLDEYNTKNNTNYKVAETLEQGSVAMSTVTQNEKNDYDIDVAIVFDDTNLNGLGHRCVKNVIVDRKCNNFKTPPEALTNCVRIVYSDNYHIDFAIYKRIKNDDGSYNYEHAGAEKWNSRNPRAINNWFKDEIKIHGEKLRQAVRLSKMFCKSRSDWKMPGGLIQSVLCDEKILDYDRIDEMFYYTIKEIKNRLENDIEVYNPTDFEQSLLLKESDRDKMNNLANRLKDRLSKLDILFDNNCTFKEAIEAWNEFFKHEFWAYDEENEKRLCSLSETVSLMKSLNISLTEYDDTEEFIENIMPIEDRYLVKLDCKVADYEIENGDIQIKQIIKLSTLRNEGKKIPLNRILEFYLDINKVPYPFQVYWKVKNNGKKAIENNCIRGEIFKIKEEQFDRLIEESSFEGDHYVECYIVKNGVCVAKDRI

SEQ ID NO: 2841 - protein, 462 aa, Desulfonispora thiosulfatigenes
MYDLSSDFKKFYYNEVVLPKEETNNLREKKKLNIQRLKDGLDEYNTKNNTNYKVAETLEQGSVAMSTVTQNEKNDYDIDVAIVFDDTNLNGLGHRCVKNVIVDRKCNNFKTPPEALTNCVRIVYSDNYHIDFAIYKRIKNDDGSYNYEHAGAEKWNSRNPRAINNWFKDEIKIHGEKLRQAVRLSKMFCKSRSDWKMPGGLIQSVLCDEKILDYDRIDEMFYYTIKEIKNRLENDIEVYNPTDFEQSLLLKESDRDKMNNLANRLKDRLSKLDILFDNNCTFKEAIEAWNEFFKHEFWAYDEENEKRLCSLSETVSLMKSLNISLTEYDDTEEFIENIMPIEDRYLVKLDCKVADYEIENGDIQIKQIIKLSTLRNEGKKIPLNRILEFYLDINKVPYPFQVYWKVKNNGKKAIENNCIRGEIFKIKEEQFDRLIEESSFEGDHYVECYIVKNGVCVAKDRI

SEQ ID NO: 2842 - protein, 453 aa, Clostridioides difficile
MFDLSIELKKFYYNEVVLSSEETKNLREKKKLNIKRLREGLSDYNADYNTNYAIAETLEQGSVAMSTVTQNEKNDYDIDVAIIFDKSNLNGLGPIAVKNVVADALKRKCTNFKTQPESKTNCVRIIYSDNYHIDFAIYRRIRNDDGSYNYEHAGSEWRPRDPRAINKWFRDEIKEHTEDLRKVVRLLKMFSKSRELWKMPGGLIQSVLSEEKIQNYKRMDELFFYTIREISVRLKKSIEVYNPTDDTQSLLLKQSDYKKMSNLCNRLENKLSALDILFDNECTKKDAVQAWYEIFNHDYWTYKEDENNMKFESFNKSFDTFEYDDTEEYIRNIVPVSNKYKITLDCRVIDKNGTIKKLSTIYNNGKSIPLNRKLLFYLDENRVPKPYDIYWKVKNEGVEAIERNCIRGQIFKNADPCFETIEERSDFVGNHYVECYIIKNGVCVAKDRIDVNI

SEQ ID NO: 2843 - protein, 453 aa, Peptoclostridium difficile; identical to SEQ ID NO: 2842

SEQ ID NO: 2844 - protein, 453 aa, Clostridioides difficile
MFDLSIELKKFYYNEVVLSSEETKNLREKKKLNIKRLREGLSDYNADYNTNYAIAETLEQGSVAMSTVTQNEKNDYDIDVAIIFDESNLNGLGPIAVKNVVADALKRKCTNFKTQPESKTNCVRIIYSDNYHIDFAIYRRIRNDDGSYNYEHAGSEWRPRDPRAINKWFRDEIKEHTEDLRKVVRLLKMFSKSRELWKMPGGLIQSVLSEEKIQNYKRMDELFFYTIREISVRLKKSIEVYNPTDDTQSLLLKQSDYKKMSNLCNRLENKLSALDILFDNECTKKDAVQAWYEIFNHDYWTYKEDENNMKFESFNKSFDTFEYDDTEEYIRNIVPVSNKYKITLDCRVIDKNGTIKKLSTIYNNGKSIPLNRKLLFYLDENRVPKPYDIYWKVKNEGVEAIERNCIRGQIFKNADPCFETIEERSDFVGNHYVECYIIKNGVCVAKDRIDVNI

SEQ ID NO: 2845 - protein, 453 aa, Clostridioides difficile
MFDLSIELKKFYYNEVVLSSEETKNLREKKKLNIKRLREGLSDYNADYNTNYAIAETLEQGSVAMSTVTQNEKNDYDIDVAIIFDESNLNGLGPIAVKNVVADALKRKCTNFKTQPESKTNCVRIVYSDNYHIDFAIYRRIRNDDGSYNYEHAGSEWRPRDPRAINKWFRDEIKEHTEDLRKVVRLLKMFSKSRELWKMPGGLIQSVLSEEKIQNYKRMDELFFYTIREISVRLKKSIEVYNPTDDTQSLLLKQSDYKKMSNLCNRLENKLSALDILFDNECTKKDAVQAWYEIFNHDYWTYKEDENNMKFESFNKSFDKFEYDDTEEYIRNIVPVSNKYKITLDCRVIDKNGTIKKLSTIYNNGKSIPLNRKLLFYLDENRVPKPYDIYWKVKNEGVEAIERNCIRGQIFKNADPSFETIEERSDFVGNHYVECYIIKNGVCVAKDRIDVNI

SEQ ID NO: 2846 - protein, 444 aa, Clostridiaceae bacterium
MYSLGNDFIRFYWNHVVLSAQETKNLREKYQININRVKNGLSEYNEENKTSYELLEHVVQGSVSMATITQNDDQNYDIDVAVVFDTDELPEGTTATKNIIVDSLKRKCKSFNTEPEFKTNCIRIQYEDGYHIDFAVYRRSEKNFFGRYEYEHCGSQFRRRDPRAINRWYLGADAEKGGYLNPIVRLLKMFTKSRSSWNMPGGLILSVLAYECFGNGETIEEVYVETLKNIYNRLFWNTEVLNPVDTSTSLLLTEADNIRIDNLKKRLETYLEKLEVLENWGCSRKEAIDAWEVFFNHSYFIDLKNDEVNHEIILHDEEKYINELFYISNEKSLELDCYVINNDSGTVERLSNILSKGKKIPLKRELEFFINETNVSYPYKVYWKVRNSGDVALSKNMLRGDISTTGNDTRSKEESSFAGNHYVECYLIKNDVCVATDIISVPIG

SEQ ID NO: 2847 - protein, 440 aa, Aerococcus viridans
MYDLSEELINFYNEHVKLPQDRIDELFEKKDINISRLEKGLEKYNEKNNTSYVVKESYVQGSVGMGTVTQNEEKDYDIDVGILVDGNGLDSIGSDKIKNVILSAFNQQNLNFKTPPEKHTNCIRFTYYDGYQIDFAVYRDIDVVEHAGSVWRERSPEAIQSWFDTQKLYKGNSLPVIIKLIKIFNRSRGHWKMPGGLITTILVEESLATEHNTLDKILYYTIENIINRLDIDGNITSPVYPYQSILYNEKDKQKVESLKKRLKSHKEKLEILNNPNCTRLDAIEAWQTLFNHTFWDKLYSEEEQKVNDSSKVENYREQYIEELFPVLLKYPLEIDASIEISGFRPSTLSNILKKRHFIPKNKEIKFFIQSIAVPKPYDIYWKVRNVGPKAYERNQIRGQIFKTNNNTQTETSDFRGKHFVECYIVKDGVCIARDRIYVPI

SEQ ID NO: 2848 - protein, 431 aa, Bacillus thuringiensis
MYNLSSKFNTFYNNHVVLQGEKQSELGKKKNTNIDRLKDGLKEYNDEHDTNYKLVDNVIQGSVAMHTVTQNDENEYDIDVAIIFDKSSIPDSTTRVKNIMVDALKRKCSGFRTEPEAKTNCIRIEYASGYHIDFAIYRRFLNDDGEYEYEHCGSEWRSRDPWAITNWFNTENTASNNDLRSVVRLLKMFCKSRDGWSMPGGLIQSVLASESVSSDARLDVTFYNTICNIRDRLGQDQEVYNPTNADLTLLYTVKDKQKVKNLHSRLTSYINKLSVLFEDDCTKEKAIEAWNDFFSHSYWAEQLPKNEERIQKTIDMFAEMTSAIGTQKETVTVQVFTELVSGQRIPLNAFKGKLPKGKPVTFIAEPSFTDYTDIKWFVNNTGDESVNNRSYDTNGKESTHETKYRGKHTVTCKVYRNQQVVCQTVKRVSVR

SEQ ID NO: 2849 - protein, 433 aa, Bacillus thuringiensis
MDMYNLSSKFNTFYNNHVVLQGEKQSELGKKKNTNIDRLKDGLKEYNDEHDTNYKLVDNVIQGSVAMHTVTQNDENEYDIDVAIIFDKSSIPDSTTRVKNIMVDALKRKCSGFRTEPEAKTNCIRIEYASGYHIDFAIYRRFLNDDGEYEYEHCGSEWRSRDPWAITNWFNTENTASNNDLRSVVRLLKMFCKSRDGWSMPGGLIQSVLASESVSSDARLDVTFYNTICNIRDRLGQDQEVYNPTNADLTLLYTVKDKQKVKNLHSRLTSYINKLSVLFEDDCTKEKAIEAWNDFFSHSYWAEQLPKNEERIQKTIDMFAEMTSAIGTQKETVTVQVFTELVSGQRIPLNAFKGKLPKGKPVTFIAEPSFTDYTDIKWFVNNTGDESVNNRSYDTNGKESTHETKYRGKHTVTCKVYRNQQVVCQTVKRVSVR

SEQ ID NO: 2850 - protein, 433 aa, Bacillus thuringiensis; identical to SEQ ID NO: 2849

SEQ ID NO: 2851 - protein, 431 aa, Bacillus cereus
MYNLSSKFNTFYNSHVVLQGEKQSELVKKKNTNIDRLKDGLKEYNDEHDTTYKVVDDAIQGSVAMHTVTQNDENEYDIDVAIIFDKSNIPDSTTRVKNIMVDALKRKCSGFRTEPEAKTNCIRIEYASGYHIDFAIYRRFLNDDGKYEYEHCGSEWRSRDPWAITNWFNTENTASNSNLRSVVRLLKMFCKSRDGWSMPGGLIQSVLASESVSSDERLDVTFYDTICNIRDRLGQDQEVYNPTNADLTLLYTVKDKQKVKNLHSRLTSYINKLSVLFEDDCTKEKAIEAWNDFFNHSYWAEQLPKNEERIQKTIDMFAEMTSAIGTQKEIVTVQVFTELVSGQRIPLNAFKGKLPKGKPVTFIAEPNFTDYTDIKWVVNNTGDESVHNRSYDASGKESTHETKYRGKHTVTCKVYRNQQVVCQTVKSVSVR

SEQ ID NO: 2852 - protein, 433 aa, Bacillus cereus
MDMYNLSSKFNTFYNSHVVLQGEKQSELVKKKNTNIDRLKDGLKEYNDEHDTTYKVVDDAIQGSVAMHTVTQNDENEYDIDVAIIFDKSNIPDSTTRVKNIMVDALKRKCSGFRTEPEAKTNCIRIEYASGYHIDFAIYRRFLNDDGKYEYEHCGSEWRSRDPWAITNWFNTENTASNSNLRSVVRLLKMFCKSRDGWSMPGGLIQSVLASESVSSDERLDVTFYDTICNIRDRLGQDQEVYNPTNADLTLLYTVKDKQKVKNLHSRLTSYINKLSVLFEDDCTKEKAIEAWNDFFNHSYWAEQLPKNEERIQKTIDMFAEMTSAIGTQKEIVTVQVFTELVSGQRIPLNAFKGKLPKGKPVTFIAEPNFTDYTDIKWVVNNTGDESVHNRSYDASGKESTHETKYRGKHTVTCKVYRNQQVVCQTVKSVSVR

SEQ ID NO: 2853 - protein, 433 aa, Unknown
  Description of Unknown: Bacillus cereus group sequence
MDMYNLSSKFNTFYNSHVVLQGEKQSELVKKKNTNIDRLKDGLKEYNDEHDTTYKVVDDAIQGSVAMHTVTQNDENEYDIDVAIIFDKSNIPDSTTRVKNIMVDALKRKCSGFRTEPEAKTNCIRIEYASGYHIDFAIYRRFLNDDGKYEYEHCGSEWRSRNPWAITNWFNTENTASNSNLRSVVRLLKMFCKSRDGWSMPGGLIQSVLASESVSSDERLDVTFYNTICNIRDRLGQDQEVYNPTNADLTLLYTVKDKQKVKNLHSRLTSYINKLSVLFEDDCTKEKAIEAWNDFFNHSYWAEQLPKNEERIQKTIDMFAEMTSAIGTQKETVTVQVFTELVSGQRIPLNAFKGKLPKGKPVTFIAEPNFTDYTDIKWVVNNTGDESVHNRSYDASGKESTHETKYRGKHTVTCKVYRNQQVVCQTVKSVSVR

SEQ ID NO: 2854 - protein, 422 aa, Bacillus thuringiensis
MYNLSSKFNTFYKNHVVLQQTKQDELKDKMEKNIERLNDGLSEYNAEYGTDYALMDYEVQGSVAMHTVTQNDENEYDIDVAIIFDKDKIPDSTKRVKNFVVNALKRKCTRFRTEPEKKTNCIRIEYASGYHIDFAIYRRFKNDNGEYEYEHCGSEWRSRNPWAITNWFNKENKASESNLRSVVRLLKMFCKSNDGWSMPGGLIQSVLASEAISSNERLDVTFYDSICGIRDRLAKDKEVYNPSDKTLTLMYTAKDYQKVKNLHTRLESYIKKLDILFDGKCTEQDAINAWKNFFNHSYWGGLVQENESIEKSARFMNSKEQVDVEMRILFAPGVEINFNEYKGKIPKGRQLKFIAHPNFTDYTQIQWTVMNQGDECGDDITHQRIGKTAIERTSYRGVHRMLCRVYRNDRLMCEKVIRVPIR

SEQ ID NO: 2855 - protein, 326 aa, Brevibacillus agri
MIMYNLSSKFNTFYNDHVVLSRDEQNNLRDKKDLNISRLKSGLQEYNTENETSYSVVEIIEQGSMAMSTITQNDQSEYDIDVAIVFDKDSIPERTTSVKNIVVDALKRKCKQFKTEPEALTNAVRVEYADGYHVDFAIYRRYKNEEDEYEYEHCGSQWRLRNPRSITDWFNTKNTESDGNIRKVVRLLKMFCKSRSGWLMPGGLVQSVLVEECIQSKDRLDETFYYTIKEIRDRLNTDKSVNNPTDTSTSLLLTAKDEQKVKNLSVRLTNYIKKLDVLFEDECTEDQAISAWNDFFDHSYWGGLLRKPPKIVLLQKVQALNIVLTS

SEQ ID NO: 2856 - protein, 424 aa, Bacillus sp.
MIMYNLSSKFNTFYNDHVVLSRDEQNNLRDKKDLNISRLKSGLQEYNTENETSYSVVEIIEQGSMAMSTITQNDQSEYDIDVAIVFDKDSIPERTTSVKNIVVDALKRKCKQFKTEPEALTNAVRVEYADGYHVDFAIYRRYKNEEDEYEYEHCGSQWRLRNPRSITDWFNTKNTESDGNIRKVVRLLKMFCKSRSGWLMPGGLVQSVLVEECIQSKDRLDETFYYTIKEIRDRLNTDKSVNNPTDTSTSLLLTAKDEQKVKNLSVRLTNYIKKLDVLFEDECTEDQAISAWNDFFDHSYWGGLVTETAESRSLAKSASSQYRVDIVAVVEWKPSIRINLKTIGGRVPKNRTIYFNAVPNFHDFDAVLWEVVNTGDECGLDKGHTQTGLNVQETTLYRGTHKMICRVYRRGTLLCSDEVKVVIK

SEQ ID NO: 2857 - protein, 422 aa, Bacillus sp.
MYNLSSKFNTFYNDHVVLSRDEQNNLRDKKDLNISRLKSGLQEYNTENETSYSVVEIIEQGSMAMSTITQNDQSEYDIDVAIVFDKDSIPERTTSVKNIVVDALKRKCKQFKTEPEALTNAVRVEYADGYHVDFAIYRRYKNEEDEYEYEHCGSQWRLRNPRSITDWFNTKNTESDGNIRKVVRLLKMFCKSRSGWLMPGGLVQSVLVEECIQSKDRLDETFYYTIKEIRDRLNTDKSVNNPTDTSTSLLLTAKDEQKVKNLSVRLTNYIKKLDVLFEDECTEDQAISAWNDFFDHSYWGGLVTETAESRSLAKSASSQYRVDIVAVVEWKPSIRINLKTIGGRVPKNRTIYFNAVPNFHDFDAVLWEVVNTGDECGLDKGHTQTGLNVQETTLYRGTHKMICRVYRRGTLLCSDEVKVVIK

SEQ ID NO: 2858 - protein, 429 aa, Cohnella sp.
MSTSMYNVSSKFNTFYTGHVVLSATEQTNLRQKKDLNIERLESGLSEYNTDYNTNYKLIDHKVQGSMAMSTIIQNEENEYDIDVAIIFNKDNLPDGTIATKNMVADALKRKCKRFKTEPEAKTNCVRVDYADGYHIDFAVYRKSQDEDGNDVYEHCGSNWRKRDPEVITNWFNKSNKDNDGNIRTVVRLLKMFCKSRSGWSMPGGLIQSVLAEECIQSKDRIDETFYYTIKKIRDRLEENKEVYNPKDTETSLLLNAKDHQKVKNLHTRLKSYISKLDVLFNSDCNENQALSAWKEFFNHSYWGELVTESTENRTILAKSMYGNYSVEIVTMVEWHPDEYIPLNEVLGPIPKGKRIRFTAKSNFFDFSKIEWEVSNNGDECVEVDDRGHFSEGVSVIENTAYRGVHKMTCRVYRQGVIVCEDDVRIQIK

SEQ ID NO: 2859 - protein, 425 aa, Cohnella sp.
MYNVSSKFNTFYTGHVVLSATEQTNLRQKKDLNIERLESGLSEYNTDYNTNYKLIDHKVQGSMAMSTIIQNEENEYDIDVAIIFNKDNLPDGTIATKNMVADALKRKCKRFKTEPEAKTNCVRVDYADGYHIDFAVYRKSQDEDGNDVYEHCGSNWRKRDPEVITNWFNKSNKDNDGNIRTVVRLLKMFCKSRSGWSMPGGLIQSVLAEECIQSKDRIDETFYYTIKKIRDRLEENKEVYNPKDTETSLLLNAKDHQKVKNLHTRLKSYISKLDVLFNSDCNENQALSAWKEFFNHSYWGELVTESTENRTILAKSMYGNYSVEIVTMVEWHPDEYIPLNEVLGPIPKGKRIRFTAKSNFFDFSKIEWEVSNNGDECVEVDDRGHFSEGVSVIENTAYRGVHKMTCRVYRQGVIVCEDDVRIQIK

SEQ ID NO: 2860 - protein, 427 aa, Bacillus pseudomycoides
MFDLNTKFNTFYTKHVVLSQKEKDKLHDKKELNIKRLKDGLAEHNEENDTQYKLVDTIVQGSVAMANVTQNDENEYDIDVAVIFDKDNIPTSTSAIKKIVADSLKRKTKQFKVEPQINKNAVTIEYAEGYHIDFAIYRRFKNDIDEYEYEHCGTSWAPRNPRSITEWFNEQNTESNNNLRKVVRLLKMFCKSRNGWSMPGGLMQSVLANECLKTDNRLDLTFYETIYAIRNRLVINKEVNNPADESLSLIFTEKDKKKLENLYNRLNKWIKKLELLFQVDCTEQEALAVWKNFFNHSYWGDLEEQKVENSLYKSSDLYNVSISVDVLMGESDDSVISLSHFKGKLPKEKWVRFSAKPTFNYSRIEWEVINSGDEAGEDKNHKQDGTVAYETTLYRGTHHMICRVYKKDYAYANEKLVYLKRVPISIK

SEQ ID NO: 2861 - protein, 429 aa, Bacillus pseudomycoides
MFDLNTKFNTFYTKHVVLSQKEKDKLHDKKELNIKRLKDGLAEHNEENDTQYKLVDTIVQGSVAMANVTQNDENEYDIDVAVIFDKDNIPTSTSAIKKIVADSLKRKTKQFKVEPQINKNAVTIEYAEGYHIDFAIYRRFKNDIDEYEYEYEHCGTSWAPRNPRSITEWFNEQNTESNNNLRKVVRLLKMFCKSRNGWSMPGGLMQSVLANECLKTDNRLDLTFYETIYAIRNRLVINKEVNNPADESLSLIFTEKDKKKLENLYNRLNKWIKKLELLFQVDCTEQEALAVWKNFFNHSYWGDLEEQKVENSLYKSSDLYNVSISVDVLMGESDDSVISLSHFKGKLPKEKWVRFSAKPTFNYSRIEWEVINSGDEAGEDKNHKQDGTVAYETTLYRGTHHMICRVYKKDYAYANEKLVYLKRVPISIK

SEQ ID NO: 2862 - protein, 425 aa, Bacillus weihenstephanensis
MSTITMYNLNAEFTSFYEEYVRLSEGEINSLREKKRLNVDRLKEGLKEYNDEHGTDYKVVEDIEQGSVAMRTVTQHDKKEYDIDIAVVFDKSSIPEKTKDIKAIVEDALQRKCSRFKASPVAKTNAVTVDYASGYHIDFAVYRRTPNLYGEGYLYEHGGSEWRERDPRAIKEWFKGANDASDNNIRKVARLLKVFCKSNPGWLMPGGLVQSILIAEKIQCKDRLDETFYETIKAIKERLDYDKEVYNPTLPLHSILYNEKDKQKVKNLCTRLENGLKKLEVLFDENCTSEKAKNAWKEFFNHSFWGEDIQKSFAQNLSESKSEQLLKLKVDVMVNNRLRVPLNEFEGRLPKGCSLLFSVDPLVKFTRVEWTVNNYGDEAEAHKYHKQDGRVVKETTLYRGNHTMTCKLYEGDRIIAQKIIPINIR

SEQ ID NO: 2863 - protein, 422 aa, Bacillus mycoides
MTMYNLNAEFTSFYEEYVRLSEGEINSLREKKRLNVDRLKEGLKEYNDEHGTDYKVVEDIEQGSVAMRTVTQHDKKEYDIDIAVVFDKSSIPEKTKDIKAIVEDALQRKCSRFKASPVAKTNAVTVDYASGYHIDFAVYRRTPNLYGEGYLYEHGGSEWRERDPRAIKEWFKGANDASDNNIRKVARLLKVFCKSNPGWLMPGGLVQSILIAEKIQCKDRLDETFYETIKAIKERLDYDKEVYNPTLPLHSILYNEKDKQKVKNLCTRLENGLKKLEVLFDENCTSEKAKNAWKEFFNHSFWGEDIQKSFAQNLSESKSEQLLKLKVDVMVNNRLRVPLNEFEGRLPKGCSLLFSVDPLVKFTRVEWTVNNYGDEAEAHKYHKQDGRVVKETTLYRGNHTMTCKLYEGDRIIAQKIIPINIR

SEQ ID NO: 2864 - protein, 420 aa, Bacillus weihenstephanensis
MYDLNAEFTTFYENHVRLSETDICSLREKKRLNIDRLKEGLQEYNEEFGTNYKVVEDIEQGSVAMRTVTQHDEKEYDIDVAIVFDKNNIPEGTKDVKAIVEDALQRKCSRFKADPKAKTNAVTVEYASGYHIDFAVYRRTPNLYGDGYVYEHCGSEWRERDPRAINEWFTEVNTASDNNIRKVVRILKVFCKSNPGWLMPGGLLQSILIAEQIKNRDRLDETFYETIKAIKERLDYNKEVYNPTLYLQSILYTAKDKQKVKNLCTRLGNGLKKLEVLFDEECTEEKAQNAWKEFFNHSFWGADIQKSFARSTLESKNEQLLRLKVDVLINKKVRVPLNEFEGRLPKGSTLLFKVDPLVKFTRVEWIVHNNGDEAEKDNYHKQDGKSIEENTLYRGNHTMTCKLYEGERVIAQQVIPINIK

SEQ ID NO: 2865 - protein, 422 aa, Bacillus mycoides
MTMYDLNAEFTTFYENHVRLSETDICSLREKKRLNIDRLKEGLQEYNEEFGTNYKVVEDIEQGSVAMRTVTQHDEKEYDIDVAIVFDKNNIPEGTKDVKAIVEDALQRKCSRFKADPKAKTNAVTVEYASGYHIDFAVYRRTPNLYGDGYVYEHCGSEWRERDPRAINEWFTEVNTASDNNIRKVVRILKVFCKSNPGWLMPGGLLQSILIAEQIKNRDRLDETFYETIKAIKERLDYNKEVYNPTLYLQSILYTAKDKQKVKNLCTRLGNGLKKLEVLFDEECTEEKAQNAWKEFFNHSFWGADIQKSFARSTLESKNEQLLRLKVDVLINKKVRVPLNEFEGRLPKGSTLLFKVDPLVKFTRVEWIVHNNGDEAEKDNYHKQDGKSIEENTLYRGNHTMTCKLYEGERVIAQQVIPINIK

SEQ ID NO: 2866 - protein, 424 aa, Bacillus sp.
MSTLTMYDLRAKFESFYTDCVKLSDAEINSLREKKRMNVERLKEGLAEYNAEHNTNYKVVEDIEQGSVAMRTVTQHDKKEYDIDVAVVFDSTNIPEIPKDVKAIVEDALKRKCTRFKAAPQAKTNAVTVEYASGYHIDFAIYRRKPNLFGGYVYEHCGSEWRERDPRAINNWFKENNDASNNNIRKVVRILKMFCKSNPGWLMPGGLVQSILVAEQIQNRERLDEMFYETIKAIKNRLDYYKDVYNPTLGQTILYNKKDEQKVKNLWNRIGTGMDKLQFLFQEGCTEEEAMNAWKRFFNHSFWGTDIQKSAATYAVLEARNVPLIGLNVNVYINDKVSVPFEEFEGRIPKGCTIRFSAEPRVPYTKVEWIVHNYGDEAEVDTYHKKEGKSVVETTKYRGDHTMTCKIYEGERIIAQEVIPVSIR

SEQ ID NO: 2867 - protein, 419 aa, Bacillus sp.
MYDLRAKFESFYTDCVKLSDAEINSLREKKRMNVERLKEGLAEYNAEHNTNYKVVEDIEQGSVAMRTVTQHDKKEYDIDVAVVFDSTNIPEIPKDVKAIVEDALKRKCTRFKAAPQAKTNAVTVEYASGYHIDFAIYRRKPNLFGGYVYEHCGSEWRERDPRAINNWFKENNDASNNNIRKVVRILKMFCKSNPGWLMPGGLVQSILVAEQIQNRERLDEMFYETIKAIKNRLDYYKDVYNPTLGQTILYNKKDEQKVKNLWNRIGTGMDKLQFLFQEGCTEEEAMNAWKRFFNHSFWGTDIQKSAATYAVLEARNVPLIGLNVNVYINDKVSVPFEEFEGRIPKGCTIRFSAEPRVPYTKVEWIVHNYGDEAEVDTYHKKEGKSVVETTKYRGDHTMTCKIYEGERIIAQEVIPVSIR

SEQ ID NO: 2868 - protein, 420 aa, Bacillus aquimaris
MFDLEKKFTSFYTDCVKLSDQEINSLREKKRKNIDRLKEGLSEYNDENDTEYKIMDVIEQGSVAMRTVTQHDKKEYDIDVAVVFNSSNIPDDTKKVKSIIEDALQRKCKQFKASPKAKTNAVTLEYASGYHIDFAIYRRTMNFYDRNFEYEHCGSEWRSRDPKAINNWFKEVNDASDKNIRRVVRLLKMFCKSNPGWLMPGGLVQSILVAERIQIRDRLDEMFYETIKSIKERLDYNKEILNPVTGQSILYNKKDEQKVKNLCTRLSNGIEKLAVLFDDICTEDDAMNAWKNFFNHKFWGEDIQKSFSENAMLEARNEELLRLTALVNMGTGDSYSLEEFEGRLPKGCSIYFQVDPLVPYTKVEWIVHNYGDEAEGDLYHKKEGRTVVEHTKYRGNHTMTCKVYEGGRVVAQKVVPVNIR

SEQ ID NO: 2869 - protein, 422 aa, Bacillus aquimaris
MTMFDLEKKFTSFYTDCVKLSDQEINSLREKKRKNIDRLKEGLSEYNDENDTEYKIMDVIEQGSVAMRTVTQHDKKEYDIDVAVVFNSSNIPDDTKKVKSIIEDALQRKCKQFKASPKAKTNAVTLEYASGYHIDFAIYRRTMNFYDRNFEYEHCGSEWRSRDPKAINNWFKEVNDASDKNIRRVVRLLKMFCKSNPGWLMPGGLVQSILVAERIQIRDRLDEMFYETIKSIKERLDYNKEILNPVTGQSILYNKKDEQKVKNLCTRLSNGIEKLAVLFDDICTEDDAMNAWKNFFNHKFWGEDIQKSFSENAMLEARNEELLRLTALVNMGTGDSYSLEEFEGRLPKGCSIYFQVDPLVPYTKVEWIVHNYGDEAEGDLYHKKEGRTVVEHTKYRGNHTMTCKVYEGGRVVAQKVVPVNIR

SEQ ID NO: 2870 - protein, 422 aa, Bacillus paralicheniformis
MFDLETKFNEFYKNKVSLFDEDISELRKKKRLNLDRLRDGLKEYNEENETDYKLVDDIEQGSVAMRTVIQLDENEYDIDVAIVFDKDNIPESTQKVKTIIEDALQRKCTQFKAAPEAKTNAVRLDYASGYHIDFAIYRRMENQLGEFEFEHCGSEWRERDPRAINKWFNTENDCSDKNIRKVIRLLKAFCKQNSGWLMPGGLILTILVAEKIRVEDRFDKTFYETVKAIKERLDTNKEVCNPTLNGNHSILYKKKDHQKIKNLHTRLEIRLKKLDVLFENDCDEAKAMAAWKEFFGHSFWGEDIQKSAFVQEFSLESKNERLLNLNADVLINNKVKIPLSDYKGKLPKGCKIFFSASPLVKYSHIEWVVNNTGDEAINDTYHKKTGRAVEENTLYRGRHTMTCKVYEGTRLIAQKVIPVNIK

SEQ ID NO: 2871 - protein, 449 aa, Lysinibacillus sphaericus
MYNLHNEMVKFHNNHVTLSGKETKELLRFKKINIKRLTDGLAEINTENNKSYSIADNVVQGSVAMFTVTQNDECDYDIDVAVIFDKDNIPSKALDCRKLVEDAIGRKAKNFVNPPKAGTNAVRVQYQEGYHIDFAVYRRFKNENDEFEYEHAGSDWAKRHPRSIRNWFNERVKTLSPDKANEDVSVENNQLRRIVKLLKMFCRSRRDWSLPGGVILTTLAVECYKPHNTRDDQAFCDTLVAIKNRIFLSDEVKNPTDSALSLTPKANHRKRVTKLNECIEEKLKCLEPLFEVGCIEADAKKAWKAFFKHDFWNTTLQKSAAYTESLDHVVQHPEVHPLEIRYTLYDATKINRLSYKKNRRGIQVNPKHCWLMFEAIHNTAAPYEVIWEVHNSGDEAKDANHLYHQTKKYWYEGTYHWESTSYKGTHTMTATVMKNGQTVAKKTINVEIL

SEQ ID NO: 2872 - protein, 451 aa, Bacillus sp.
MLNLHNEMKAFHDNEVRLSGAEANKLRKLKKTNINRLKNGLLEINEEKNKKYVLVDNIVQGSIAISTVTQNDENDYDIDVAVIFDKNNLPASALDSRKLIEDALCRKCTNFVIAPTAGKNAIRVQYQAGYHIDFAVYRRYKEKDEDQDFIFEHAGPSWNLRHPRGIRDYFNQQIREESPKESDEGVYVKKNQMRRITRLLKMFARSRSNWSLPGGVILTTLVDECYVPNNERDDKSFYDTIVAIKNRIVLSNNVNNPTERSLSLTPKENHKRKVTRLKDYLEDKLTNLDVLFEHGCTGEKGKKAWKKFFNHDYWAPEEVSKSAEREFYAERAQYPVAYRLDVRYELYNRNKSNKLSYKTNRRNERINPKYCSLFFEANHNVPAPYEIVWEVNNKGDEAHDINDLEHSTSYKHYEGNYHWEGTSYKGTHSMNVSIIKDSRVVAKKEVLVTII

SEQ ID NO: 2873 - protein, 312 aa, Bacillus subtilis
MNLSFLKFVKQNVEANEYEKTCLIKKMEKEILNLQKGIEYFNSMNNSSYKLLEEPFVQGSIAMETTVNGLFSKNDIDISLVFDKDEIDKSPVKAKKALLSMLRPFVNQSETHIDCHTNCIRCVYRDGSHVDLAVYRRYKLNLSDADYIYEHGGSKWRFWEPRKIVEWFHLKNEESGGQLRIIVKLLKMFCKSRRHWRMPGGIILTILAVENYRAVDRIDEAFYIVMRNIIERLKRNKEILNPLNQGQSLIRKKEEEVKVENLYKRLFIYVTKLDDLFKESCTCELANTLWGEFFNHPYWDQTQDNKMLAAKY

SEQ ID NO: 2874 - protein, 313 aa, Bacillus subtilis
MFNMNLSFLKFVKQNVEANEYEKTCLIKKMEKEILNLQKGIEYFNSMNNSSYKLLEEPFVQGSISMETTVNGLFSKNDIDISLVFDKDEIDKSPVKAKKALLSMLRPFVNQSETHIDYHTNCIRCVYRDGSHVDLAVYRRYKLNLSDADYIYEHGGSKWRFWEPRKIVEWFHLKNSGGQLRIIVKLLKMFCKSRRHWRMPGGIILTILAVENYRAVDRIDVAFYIVMRNIIERLKRNKEILNPLNQGQSLIRKKEEEVKVENLYKRLFIYVTKLDDLFKESCTCELANTLWGEFFNHPYWDQTQDNKMLAAKY

SEQ ID NO: 2875 - protein, 313 aa, Bacillus subtilis
MFNMNLSFLKFVKQNVEANEYEKTCLIKKMEKEILNLQKGIEYFNSMNNSSYKLLEEPFVQGSIAMETTVNGLFSKNDIDISLVFDKDEIDKSPVKAKKALLSMLRPFVNQSETHIDYHTNCIRCVYRDGSHVDLAVYRRYKLNLSDADYIYEHGGSKWRFWEPRKIVEWFHLKNSGGQLRIIVKLLKMFCKSRRHWRMPGGIILTILAVENYRAVDRIDVAFYIVMRNIIERLKRNKEILNPLNQGQSLIRKKEEEVKVENLYKRLFIYVTKLDDLFKESCTCELANTLWGEFFNHPYWDQTQDNKMLAAKY

SEQ ID NO: 2876 - protein, 315 aa, Bacillus subtilis
MFNMNLSFLKFVKQNVEANEYEKTCLIKKMEKEILNLQKGIEYFNSMNNSSYKLLEEPFVQGSIAMETTVNGLFSKNDIDISLVFDKDEIDKSPVKAKKALLSMLRPFVNQSETHIDCHTNCIRCVYRDGSHVDLAVYRRYKLNLSDADYIYEHGGSKWRFWEPRKIVEWFHLKNEESGGQLRIIVKLLKMFCKSRRHWRMPGGIILTILAVENYRAVDRIDEAFYIVMRNIIERLKRNKEILNPLNQGQSLIRKKEEEVKVENLYKRLFIYVTKLDDLFKESCTCELANTLWGEFFNHPYWDQTQDNKMLAAKY

SEQ ID NO: 2877 - protein, 315 aa, Bacillus subtilis
MFNMNLSFLKFVKQNVDANEYEKTCLIKKIEKEILNLQKGIEYFNSMNKSSYKLLEEPFVQGSIAMETTVNGLFSKNDIDISLVFDKDEIDKSPVKAKKALLSMLRPFVNQSETNIDYHTNCIRCVYRDGSHADLAVYRRYKLNLGDADYIYEHGGSKWRFWEPRKIVEWFHLKNEESGGQLRIIVKLLKMFCKSRRHWRMPGGIILTILAVENYRAVDRIDEAFYIVIRNIIERLKRNKEISNPLNQGQSLIRKKEEEVKVENLYKRLLIYVTKLDDLFKENCTCELANTLWGEFFNHPYWNQTQDNKMLAAKF

SEQ ID NO: 2878 - protein, 312 aa, Bacillus subtilis
MNLSFLKFVKQNVDANEYEITCLIKKMEKEILNLQKGIEYFNSMNNSSYKLLEEPFVQGSIAMETTVNGLFSKNDIDISLVFDKDEIDKSPVKAKKALLSMLRPFVNQSETNIDYHTNCIRCVYRDGSHADLAVYRRYKLNLGDADYIYEHGGSKWRFWEPRKIVEWFHLKNEESGGQLRIIVKLLKMFCKSRKHWRMPGGIILTILAVENYRAVERIDEAFYIVIRNIIERLKRNKEISNPLNQGHSLIRKKEEVVKVENLYKRLFIYVAKLEDLFKENCTCELANTLWGEFFNHPYWNQTQNNKMLAKKI

SEQ ID NO: 2879 - protein, 315 aa, Bacillus subtilis
MFNMNLSFLKFVKQNVDANEYEITCLIKKMEKEILNLQKGIEYFNSMNNSSYKLLEEPFVQGSIAMETTVNGLFSKNDIDISLVFDKDEIDKSPVKAKKALLSMLRPFVNQSETNIDYHTNCIRCVYRDGSHADLAVYRRYKLNLGDADYIYEHGGSKWRFWEPRKIVEWFHLKNEESGGQLRIIVKLLKMFCKSRKHWRMPGGIILTILAVENYRAVERIDEAFYIVIRNIIERLKRNKEISNPLNQGHSLIRKKEEVVKVENLYKRLFIYVAKLEDLFKENCTCELANTLWGEFFNHPYWNQTQNNKMLAKKI

SEQ ID NO: 2880 - protein, 452 aa, Lactobacillus brevis
MYDCSRNFNEFYHTKVILPEKSQNELRKKRKTNIKRLKSGLSEYNSENNTDFRISEERIQGSMAMHTVVQNDENDYDIDVGIVFESDNLDEIGPHAIKNILENALKRKMGQFAVEPLVKTSCVRMEYSNGYHVDFAIFKRSKIYLENEYTYEHAGAKWSTRHIKALEEWFNTETSKTNDNLRKIVRLSKMFCKSRKTWKNMPSGLIQTVLCDEAITNDYSRTDELFYYTMKKIVDRLNVNLEVNAPVDNERKLVIRDIDYTRVQNWKNRLENELTKLDVLFNPDCTFAEAVDAWGLFFNHSYWKELNMHETRKSLREDTQEVFNNTEEHIEDKYLVNEYYDVSINCKISGNGIRPMPIEKYLDSYFAKFIPHNFSVTCKIDHADCPPFDKVLWKVLNVGKESVKRNDIRGQILDRGEKITENTIFRGQHYIECYLIKNDICIAIGHVDIPIG

SEQ ID NO: 2881 - protein, 452 aa, Lactobacillus plantarum
MYDCSRNFNEFYHTKVILPEKSQNELRKKRKTNIKRLKSGLSEYNSENNTGFRISEERIQGSMAMHTVVQNDENDYDIDVGIVFESDNLDEIGPHAIKNILENALKRKMGQFAVEPLVKTSCVRMEYSNGYHVDFAIFKRSKIYLENEYTYEHAGAKWSTRHIKALEEWFNTETSKTNDNLRKIVRLSKMFCKSRKTWKNMPSGLIQTVLCDEAITNDYSRTDELFYYTMKKIVDRLNVNLEVNAPVDNERKLVIRDIDYTRVQNWKNRLENELTKLDVLFNPDCTFAEAVDAWGLFFNHSYWKELNMHETRKSLREDTQEVFNNTEEHIEDKYLVNEYYDVSINCKISGNGIRPMPIEKYLDSYFAKFIPHNFSVTCKIDHADCPPFDKVLWKVLNVGKESVKRNDIRGQILDRGEKITENTIFRGQHYIECYLIKNDICIAIGHVDIPIG

SEQ ID NO: 2882 - protein, 452 aa, Lactobacillus backii
MYDCSRNFNEFYHTKVILPEKSQNELRKKRKTNIKRLKSGLSEYNSENNTGFRISEERIQGSMAMHTVVQNDENDYDIDVGIVFESDNLDEIGPHAIKNILENALKRKMGQFAVEPLVKTSCVRMEYSNGYHVDFAIFKRSKIYLENEYTYEHAGAKWSTRHIKALEEWFNTETSKTNDNLRKIVRLSKMFCKSRKTWKNMPSGLIQTVLCDEAITNDYSRTDELFYYTMKKIVDRLNVNLEVNAPVDNERKLVIRDIDYTRVQNWKNRLENELTKLDVLFNPDCTFAEAVDAWGLFFNHSYWKELNMHETRKSLREDTQEVFNNTEEHIEDKYLVNEHYDVSINCKISGNGIRPMPIEKYLDSYFAKFIPHNFSVTCKIDHADCPPFDKVLWKVLNVGKESVKRNDIRGQILDRGEKITENTIFRGQHYIECYLIKNDICIAIGHVDIPIG

SEQ ID NO: 2883 - protein, 452 aa, Lactobacillus plantarum
MYDCSRNFNEFYHTKVILPEKSQNELRKKRKTNIKRLKSGLSEYNSENNTGFRISEERIQGSMAMHTVVQNDENDYDIDVGIVFESDNLDEIGPHAIKNILENALKRKMGQFAVEPLVKTSCVRMEYSNGYHVDFAIFKRSKIYLENEYTYEHAGAKWSTRHIKALEEWFNTETSKTNDNLRKIVRLSKMFCKSRKTWKNMPSGLIQTVLCDEAITNDYSRTDELFYYTMKKIVDRLNVNLEVNAPVDNERKLVIRDIDYTRVQNWKNRLENELTKLDVLFNPDCTFAEAVDAWGLFFNHSYWKELNMHETRKSLREDTQEVFNNTEEHIEDKYLVNEYYDVSINCKISGNGIRPMPIEKYLDSYFAKFIPHNFSVTCKIDHADCPPFDKVLWKVLNVGEESVKRNDIRGQILDRGEKITENTIFRGQHYIECYLIKNDICIAIGHVDIPIG

SEQ ID NO: 2884 - protein, 454 aa, Lactobacillus xiangfangensis
MYDCSRKFNEFYHTKIILPEKSQNELRQKRKTNIKRLKSGLSEYNAENKTGFRISEERIQGSMAMHTVVQNDENDYDIDVGIVFESDNLDEIGPYAIKNILENALKRKMGQFAVEPLVKTSCVRMEYSNGYHVDFAIFKRSKIHLGNEYTYEHAGAKWSTRHIKALEEWFNTEASKTNDNLRKIVRLSKMFCKSRESWKNMPSGLIQTVLCDEAITNNYSRTDELFYYTMKKIVARLNTNLEVNAPVDNGRRLVTREIDYTRVRNWKNHLENELKKLDVLFDPDCTFAEAVDAWGLFFNHSYWKELNMQETRKSLGEDTKRVFNNTEEFIEDKYLVNEYYDVSINCKLSGNGIRPMPIAKYLNSHFAKYIPHNFSVTCKIAHTNCPSFDKILWKVLNVGEESVKRNDIRGQIVDRGEKITENTIFRGQHYIECYLIKNNICVAIGHVDIPIGKE

SEQ ID NO: 2885 - protein, 452 aa, Lactobacillus brevis
MYDCSRKFNEFYHTKVILPEKSQNELRQKRKTNIKRLKSGLSEYNAENKTDFRISEERIQGSMAMHTVVQNDKNDYDIDVGIVFESDNLAEIGPYAIKNILENALRRKMGQFAVEPLVKTSCVRMEYSNGYHVDFATFKRSKINFENEYTYEHAGAKWSTRHIKALEEWFNIEESKTNDNLRKIVRLSKMFCKSRETWKNMPSGLIQTVLCDEMITNDYDRADELFYYTMKKIVTRLNINLEVNAPVDNGRKLVTRKIDYTRVRNWKNTLENALKKLDVLFNPDCTFAEAVDAWGLFFNHSYWKDLNMQEIRKSLREDTQRVLNNTEEYIEDKYIVNEYYDVSINCKISGNGIRPMPIAKYLNSNFAKFIPHNFSVTCKIDHTNCPSFEKVLWKVLNVGEESVKRNDIRGQILDRGEKITENTIFRGQHYIECYLIKNNICVAIGHVDIPIG

SEQ ID NO: 2886 - protein, 468 aa, Macrococcus caseolyticus
MLYKEVFKMYDCSKEFNNFYRKKVVLSAKEQNELRLRRKLNIRRMKDGLKEYNEEKKTSYKIAEDRIQGSMAMHTITQNDEKDYDIDVGIVFEADCLNSLGAQATRNMVANALERKTRQFAQPPEVKTSCVRLKYSSLGYHMDFAVFQRSKKYEWDDNYIYKHAGAEWTKRHIKALEEWFIDRVKYSGDDLRKIVRLSKMFCKSRESWKNMPSGLVQTILCDAKLRNYYSRLDEKFYYTMQAIVQRLEVHLNVNAPVDNGRELIIRDIDYRRMENWKNRLRTSLNKLDILFNKDCSREDALLAWASFFNHSYWEELAEKDQRTNLNERHFLSFNDTEQIIDELYPIYEKYNVSIDCDVSGNGFSVMPLEKFFDKLSPQLKKFIPYNFSIRCRLGETDCPSYDKVLWKVRNIGIEAEKRDCIRGQILDNRGTEIIENSNFSGSHYIECYLIQNGICVGIGHVDIPIGDI

SEQ ID NO: 2887 - protein, 460 aa, Staphylococcus epidermidis
MYDCSKEFSTFYRKKVVLSAKEQDELRKRRKQNIRRIKDGLNEYNEEKNTSYKISEDRIQGSMAMHTITQNDEKDYDIDVGIVFEADCLNSLGAQATRNMVANALERKTRQFAQPPEVKTSCVRLKYSSLGYHMDFAVFQRSKEYEWDDNYIYEHAGTEWTERHIKALEEWFINRVKYSGDDLRKIVRLSKMFCKSRDSWKNMPSGLVQTILCDSKLKNYYSRLDEKFYYTMQAIVQRLDIHLDVNAPVDNGRELIIRDVDYKRMENWKNRLRASLNKLDILFDKECSREDALQAWALFFNHSYWEELAEQNQRSNISESRFLSFNDTEQFIEELYPIYENYNVSIDCDVSGNGFSVMPIEKFFDKLSPQLKKFIPYNFSIRCRLGDTDCPTYDKILWKVRNIGIEAEKRNCIRGQIVDNRGTEIIENSNFAGLHYIECYLIKNDICVGIGHVDIPIGGI

SEQ ID NO: 2888 - protein, 460 aa, Staphylococcus sp.
MYDCSKEFYTFYRKKVVLSAKEQNELRLRRKQNIRRMKDGLKEYNGEKKTSYKIAEDRIQGSMAMHTITQNDEKDYDIDVGIVFETDCLNSLGAQATRNMVANALERKTRQFAQPPEIKTSCVRLKYSSLGYHMDFAIFQRSKEYEWDDNYTYEHAGVEWTERHIKALEEWFIDRVKYSGDDLRKIVRLSKMFCKSRDSWKNMPSGLVQTILCDAKLKNNYSRLDEKFYYTMQAIVQRLENHLDVKAPVDNGRELIIRDVDYKRMKNWKNRLRASLNKLAILFDKECSREDALQAWALFFNHSYWEELAEQNQRRNISESRFLSFNDTEQFIDELYPIYEKYNVSIDCDVSGNGFSVMPIEKFFDKLSPQLKKFIPYNFSIRCRLGDTDCPSYDKILWKVRNIGIEAEKRDCIRGQIVDSRGTEIKENSNFAGFHYIECYLIKESICVGIGHIDIPIGGN

SEQ ID NO: 2889 - protein, 465 aa, Staphylococcus pseudintermedius
MYDCSKEFNIFYRKKVVLSAKEQNELRNRRKQNIKRIKDGMQEYNEEKKTTYKIAEDRIQGSMAMHTITQNDGKDYDIDVGIVFESDCLNNLGPQATRNMVAKALERKTRQFAQPPEVKTSCVRLKYSSLGYHMDFAVFQRSKEAEWNDNYIYEHAGLEWAERDIKALEEWFINRVKYYGDDLRKIVRLSKMFCRSREHWKNMPSGLIQTVLCEAKLKNFYLRLDEKFYYTMQAIVHHLEKQLNVNAPVDNGRELVIRDIDYKRMENWKKRLKSSLDKLDILFDKNCLQEDALKAWSQFFNHSYWDELSESTQRRNTTESNALRFNDTEQFIDDLYPVYEQYDVSIDCEVSGNGFSVMPIEKFFDKLPPQIKNYIPYNFSIRCRLGGTDCPSYDKILWKVRNIGTEAEKRDCIRGQIVDKRGIEIKEYSQFAGSHYIECYLIENGICVGIGHVDIPIGGSGHEGI

SEQ ID NO: 2890 - protein, 460 aa, Lactococcus garvieae
MYDCSKEFNKFYRTKVVLPAKEQNELRKKRKLNIKRLKDGLLEYNKEKNKDYKIAEERIQGSMAMHTITQNDESDYDIDVGIVFESDNINNLGPLATRNIVADALERKTKQFAEEPEVKTSCVRLKYSSTGYHVDFAIFKRYKEYSWDDEYTYEHAGSEWSVRHIKSLEEWFNEEIKNSGDDLRKVIRLSKMFCKSRESWVNMPSGLIQTILSAEKLNSNYSRLDEIFYYTMKAIVNRLSLYLEIAAPVDNGRSLVTREIDYQRMRNWKSRLETNLQNLEILFDEECTYKDAINAWSKFFNHSYWNELYSSTVKESYSLRKAYDFDDTEEFIENMYPIYEQYDVTIDCKVSGNGFSVMPISDFLDKFAPKLKKFIPHNFSIKCKIGYTNCTSYDKILWKVLNVGTEAERRNDIRGQIQDNRGSEITENSKFIGEHYIECYLIKNGICVGIGHVDIPIGGS

SEQ ID NO: 2891 - protein, 460 aa, Lactococcus garvieae; identical to SEQ ID NO: 2890

SEQ ID NO: 2892 - protein, 460 aa, Granulicatella adiacens
MYDCSKEFNKFYRTKVVLPAKEQNELRKKRKLNIKRLKDGLIEYNEEKNKDYKIAEERIQGSMAMHTITQNDESDYDIDVGIVFESDNLNNLGPLATRNIVADALERKTKQFAEEPEVKTSCVRLKYISTGYHVDFALFKRYKEYSWEDEYIYEHAGSEWSVRHIKALEEWFNEEIKNTGDDLRKVIRLSKMFCKSRKTWANMPSGLIQTILSAETLNSNYSRLDEIFYYTMEAIVKRLSLYLEIAAPVDNGRPLVTREIDYQRMRNWKSRLESNLQNLEILFDEDCTYKDAINAWSKFFNHSYWNELYSSTVKESYSVSKAYDFDDTEEFIENMYPIYEQYDVTIDCKVSGNGFSVMPISDYLDKFTPKLKRFIPHNFSIKCKIGYTNCPSYDKILWKVLNVGTEAERRNDIRGQIQDNRGNEITENSKFIGEHYIECYLIKNGVCVGIGHVDVPIGGS

SEQ ID NO: 2893 - protein, 460 aa, Unknown
  Description of Unknown: Granulicatella sequence
MYDCSKEFNKFYRTKVVLPAKEQNELRKKRKLNIKRLKDGLIEYNEEKNKDYKIAEERIQGSMAMHTITQNDESDYDIDVGIVFESDKLNNLGPLATRNIVADALERKTKQFAEEPEVKTSCVRLKYISTGYHVDFALFKRYKEYSWEDEYIYEHAGSEWSVRHIKALEEWFNEEIKNAGDDLRKVIRLSKMFCKSRKTWANMPSGLIQTILSAETLNSNYSRLDEIFYYTMEAIVKRLSLYLEIAAPVDNGRPLVTREIDYQRMRNWKSRLESNLQNLEILFDEDCTYKDAINAWSKFFNHSYWNELYSSTVKESYSVSKAYDFDDTEEFIENMYPIYEQYDVTIDCKVSGNGFSVMPISDYLDKFTPKLKRFIPHNFSIKCKIGYTNCPSYDKILWKVLNVGTEAERRNDIRGQIQDNRGNEITENSKFIGEHYIECYLIKNGVCVGIGHVDVPIGGS

SEQ ID NO: 2894 - protein, 460 aa, Unknown
  Description of Unknown: Lactobacillales sequence
MYDCSKEFNKFYRTKVVLPAKEQNELRKKRKLNIKRLKDGLIEYNEEKNKEYKIAEERVQGSMAMHTITQNDESDYDIDVGIVFESDNLNNLGPLATRNIVADALERKTKQFAEEPEVKTSCVRLKYSSTGYHVDFAIFKRYKEYSWDDEYTYEHAGSEWSIRHIKALEEWFNEEIKNAGDDLRKVIRLSKMFCKSRENWVNMPSGLIQTILSAEKLNSNYSRLDEIFYYTMDAIVNRLSLYLEIAAPVDNGRPLVTREIDYQRMRNWKSRLETNLQNLEILFDEDCTYKDAINAWSKFFNHSYWNELYSSTVKESYSVSKAYDFDDTEEFIENMYPIYEQYDVTIDCKVSGNGFSVMPISDYLDKFAPILKRFIPHNFSIKCKIGYTNCPSYDRILWKVLNVGTEAERRNDIRGQIQDNRGNEITENSKFIGEHYIECYLIRNEVCVGIGHVDVPIGGS

SEQ ID NO: 2895 - protein, 343 aa, Enterococcus sp.
MYDCSKEFNKFYRTKVVLPAKEQNELRKKRKLNIKRLKDGLIEYNEEKNKEYKIAEERVQGSMAMHTITQNDESDYDIDVGIVFESDNLNNLGPLATRNIVADALERKTKQFAEEPEVKTSCVRLKYSSTGYHVDFAIFKRYKEYSWDDEYTYEHAGSEWSIRHIKALEEWFNEEIKNAGDDLRKVIRLSKMFCKSRENWVNMPSGLIQTILSAEKLNSNYSRLDEIFYYTMDAIVNRLSLYLEIAAPVDNGRPLVTREIDYQRMRNWKSRLETNLQNLEILFDEDCTYKDAINAWSKFFNHSYWNELYSSTVKESYSVSKAYDFDDTEEFIENMYPIYEQYD

SEQ ID NO: 2896 - protein, 460 aa, Pisciglobus halotolerans
MYDCSKEFNKFYRTKVVLPAKEQNELRKKRKLNIKRLKDGLIEYNEEKNKDYKIAEERIQGSMAMHTITQNDESDYDIDVGIVFESDNLNNLGPLATRNIVANALERKTKQFAEEPEVKTSCVRLKYSSTGYHVDFAIFKRYKEYSWDDEYTYEHAGSEWSVRHIKSLEEWFNEEIKNAGDDLRKVIRLSKMFCRSRESWANMPSGLIQTILSAEKLNSNYSRLDEIFYYTMEAIVNRLSLYLEIAAPVDNGRPLVTREIDYQRMRNWKSRLETNLQNLEILFDEDCTYKDAINAWSKFFNHSYWNELYSSTVKESYSVSKAYDFDDTEEFIENMYPIYEQYDVTIDCKVSGNGFSVMPISDYLDKFAPILKRFIPHNFSIKCKIGYTNCPSYDKILWKVLNVGTEAERRNDIRGQIQDNRGNEITENSKFIGEHYIECYLIKNGVCVGIGHVDVPIGGS

SEQ ID NO: 2897 - protein, 460 aa, Enterococcus casseliflavus
MYDCSKEFNKFYRTKVVLPAKEQNELRKKRKLNIKRLKDGLIEYNEEKNKDYKIAEERIQGSMAMHTITQNDESDYDIDVGIVFESDNLNNLGPLATRNIVANALERKTKQFAEEPEVKTSCVRLKYSSTGYHVDFAIFKRYKEYSWDDEYTYEHAGSEWSVRHIKALEEWFNEEIKNAGDDLRKVIRLSKMFCRSRESWANMPSGLIQTILSAEKLNSNYSRLDEIFYYTMEAIVNRLSLYLEIAAPVDNGRPLVTREIDYQRMRNWKSRLETNLQNLEMLFDEDCTYKDAINAWSKFFNHSYWNELYSSTVKESYSVSKAYDFDDTEEFIENMYPIYEQYDVTIDCKVSGNGFSVMPISDYLDKFAPILKRFIPHNFSIKCKIGYTNCPSYDKILWKVLNVGTEAERRNDIRGQIQDNRGNEITENSKFIGEHCIECYLIKNGVCVGIGHVDVPIGGS

SEQ ID NO: 2898 - protein, 460 aa, Enterococcus durans
MYDCSKEFNKFYRTKVVLPAKEQNELRKKRKLNIKRLKDGLIEYNEEKNKDYKIAEERIQGSMAMHTITQNDESDYDIDVGIVFESDNLNNLGPLATRNIVANALERKTKQFAEEPEVKTSCVRLKYSSTGYHVDFAIFKRYKEYSWDDEYTYEHAGSEWSVRHIKSLEEWFNEEIKNAGDDLRKVIRLSKMFCRSRESWTNMPSGLIQTILSAEKLNSNYSRLDEIFYYTMEAIVNRLSLYLEIAAPVDNGRPLVTREIDYQRMINWKSRLETNLQNLEILFDEDCTYKDAINAWSKFFNHSYWNELYSSTVKESYSVSKAYDFDDTEEFIENMYPIYEQYDVTIDCKVSGNGFSVMPISDYLDKFAPILKRFIPHNFSIKCKIGYTNCPSYDKILWKVLNVGTEAERRNDIRGQIQDNRGNEITENSKFIGEHYIECYLIKNGVCVGIGHVDVPIGGS

SEQ ID NO: 2899 - protein, 460 aa, Enterococcus faecium
MYDCSKEFNKFYRTKVVLPAKEQNELRKKRKLNIKRLKDGLIEYNEEKNKDYKIAEERIQGSMAMHTITQNDESDYDIDVGIVFESDNLNNLGPLATRNIVANALERKTKQFAEEPEVKTSCVRLKYSSTGYHVDFAIFKRYKEYSWDDEYTYEHAGSEWSVRHIKSLEEWFNEEIKNAGDDLRKVIRLSKMFCRSRESWTNMPSGLIQTILSAEKLNSNYSRLDEIFYYTMEAIVNRLSLYLEIAAPVDNGRPLVTREIDYQRMRNWKSRLETNLQNLEILFDEDCTYKDAINAWSKFFNHSYWNELYSSTVKESYSVSKAYDFDDTEEFIENMYPIYEQYDVTIDCKVSGNGFSVMPISDYLDKFAPILKRFIPHNFSIKCKIGYTNCPSYDKILWKVLNVGTEAERRNDIRGQIQDNRGNEITENSKFIGEHYIECYLIKNGVCVGIGHVDVPIGGS

SEQ ID NO: 2900 - protein, 459 aa, Bacillus sp.
MYDCSKEFKKFYRKKVVLPEKEKNELRKKRKLNIKRLKDGLLEYNEEKRKEYKIAEERIQGSMAMHTITQNDENDYDIDVGIVFESDNLNDLGPLATRNMVADALERKTKQFAEEPDVKTSCVRLKYTSTGYHVDFAVFKRYKEYSWEDEYTYEHAGSEWSVRHIKALEEWFNDEIKNKGNDLRKVIRLSKMFCKSRDTWKNMPSGLIQTIMCNEKFTTTYSRLDEIFYYTMQSIVNRLNFYLEVEAPVDNGRALVIREVDYQRMKNWKSRLESNLQNLEVLFDAECTHKDAITAWRTFFNHSYWEELELSAISKVYSENKSQDFNDTEEFIEDLYPIHEQYDVTIDCKVSGNGFSVMPIFEYLDRFAPLLKKFIPHNFSIECRIGSTNCPSYDKVLWKVLNVGAEAERRNDIRGQIQDRGKLITENSNFLGEHYIECYLIKNGVCVAIGHIDVPIGGN

SEQ ID NO: 2901 - protein, 459 aa, Bacillus sp.; identical to SEQ ID NO: 2900

SEQ ID NO: 2902 - protein, 459 aa, Streptococcus parauberis
MYDCSKEFNKFYRTEVVLPAKEQNELRQKRKLNIKRLKDGLFEYNDEKKKDYKISEERIQGSMAMHTITQNDENDYDIDVGIVFESDNLDDLGPLATINIVADALERKTKQFAEVPDVKTSCVRLMYSSKGYHVDFAVFKRYKKNSWNDEYIYEHARAEWSIRHLKALEEWFNDEIKNSGDDLRKITRLSKMFCKSRDSWKNMPNGLIQTIVCNENLSTGSLRLDEIFYHTMKSIVNRLNIYLEVYAPVDKRRPLVTRETDYQRMKNWKNRLDSSLANLDILFDTECTYKDALNAWAQFFNHSYWNELYSSTINESFSMDKAYDFDDTEEFIEDLYPIYEQYDVTIDCKVSGNGFSAMPILDYLDKLGLRSKKFIPHNFSIKCKIGYTNCPSYDKILWKVLNVGSEAERRNDIRGQIIDKGNEITENSKFFGEHYIECYLIKNGICVAIGHVDVPIGGN

SEQ ID NO: 2903 - protein, 459 aa, Atopostipes suicloacalis
MYDCSKEFNKFYRTEVVLPAKEQNELRQKRKLNIKRLKDGLLEYNDEKKKDYKISEERIQGSMAMHTITQNDENDYDIDVGIVFESDNLDDLGPLATRNIVADALERKTKQFAEVPDVKTSCVRLMYSSKGYHVDFAVFKRYKKNSWNDEYIYEHAGAEWSIRHLKALEEWFNDEIKNSGDDLRKITRLSKMFCKSRDSWKNMPSGLIQTIVCNENLSTGSLRLDEIFYHTMKSIVNRLNIYLEVYAPVDNRRPLVTRETDYQRMKNWKNRLDSSLANLDILFDTECTYKDALNAWAQFFNHSYWNELYSSTINESFSMDKAYDFDDTEEFIEDLYPIYEQYDVTIDCKVSGNGFSAMPILDYLDKLGLRSKKFIPHNFSIKCKIGYTNCPSYDKILWKVLNVGSEAERRNDIRGQIIDKGNEITENSKFFGEHYIECYLIKNGICVAIGHVDVPIGGN

SEQ ID NO: 2904 - protein, 459 aa, Carnobacterium sp.
MYDCSKEFNKFYRTKIILPAKEQNELRKKRKLNIKRLKDGLLEYNEEKGTDYKIAEERIQGSMAMHTITQNDENDYDIDVGIVFESDNLNDLGPLATRNMVADALERKTKQFAEEPDVKTSCVRLKYTSIGYHVDFAVFKRYKEYSWDDEYIYKHAGSEWLVRHIKALEEWFSGEIKSTGDDLRKVIRLSKMFCKSRDSWKNMPSGLIQTVLCDEKFATNYSRLDELFYYTMKAIVSRLSLYLEVKAPVDDGRALVTREVDYQRMKNWKSHLESNLQILEVLFDAECTYKDAINAWGAFFNHSYWEELELSAISKRFSESKLQDFNDTEEFIEDLYPVYEQYDVTIDCKVSGNGFSLMPISEYIDKFSPRLKKFIPYNFSVKCRIKSTNFPSYDKILWKVLNVGAEAERRNDIRGQIQDRGKEITENSNFLGEHYIECYLIKNGVCVAIGHVAVPIGVG

SEQ ID NO: 2905 - protein, 459 aa, Lachnospiraceae bacterium
MFDCSAEFNKFYRTEVVLPETEQNELREKRKLNIKRLKEGLIEYEADKGKKYRVAEDRIQGSMAMHTTVQNDKNDYDIDVGIVFESSNLNDLGPLATRNMVADALERKTKQFAQAPEVKTSCVRLKYVSKGYHVDFAVFKRYKENLEDNDYIYEHSGAEWSIRDLKALEEWFNEEIKNKGDGLRKVIRLSKMFCKSRESWKNMPSGLIQTVLCDENFVTDYSRLDELFYYTMQAIVNRISNSADVAAPVDNGRALVTREIDYQRMNNWKNRLEFKLKELDILFEPNCTHNEAIKAWNKFFNHSYWANLESTIVSESFSISKSQRFTNTEEFIEDLYPVYEQYDVTIDCKVTGNGFSSMPILHYLDTYAPRFKRFIPYNFSVKCRIGYTNCPSYDKILWKVLNVGAEAERRNDVRGQIQNRGKEITENSKFFGPHYIECYLIKNGICVAIGHVDVPIGVE

SEQ ID NO: 2906 - protein, 459 aa, Tindallia californiensis
MYDCSKEFNKFYRREVVLPATEQSELREKRKLNIKRLKDGLLEYNNEKGKDYKVAEDRIQGSMAMYTTVQNDKNDYDIDVGIVFESNNLNNLGPLATRNMVADALKRKTKQFAEYPDVKTSCVRLNYTSTGYHVDFAIFKRYKEDSEDKDYIYEHAGGEWSDRHLNALEKWFIGEIKDKGDNLRKVIRLSKMFCKSREYWKNMPSGLIQTVLCDEKFAAEYSRLDELFYHTMQAIVDRINGSTEVEAPVDNGRALVTRDVDRYRMNNWKNRLESNLKVLDVLFDAGCTYNKAVKAWNKFFNHSYWEKLEEKVISESYSVRKSQIFNDTEEFIEDLYPVYEQYDVTIDCKVSGNGFRLMSIFEYLDKYATSFKRFIPYNFSVKCKIGYTNCPSYDKILWKVLNVGSEAELRNEIRGQIQDRGKEITENSKFHGPHYIECYLIKNGVCVAIGHVNVPIGVS

SEQ ID NO: 2907 - protein, 460 aa, Lactobacillus curvatus
MYDCSKEFNKFYRTEVVLSAKDENELREKRKLNIKRLKDGLTEYNTENGTNYKVSENRIQGSMAMHTAVQNDENDYDIDVGIVFEAENLDDMGPLATRNMVANALERKTKQFAESPDVKTSCVRLNYSSTGYHIDFAVFDRERNSIGENEYIYKHAGVKWTPRGIKALEEWFSNETKSKGNDFRKIVRLSKMFCKSQPAWKNMPSGLIQTVLCEEKYASNYSRIDELFYYTMSAIVDRLEIWLEVAAPVDNGRPLVTREVDYTRMKNWKNRLKSKLDSLDILFENNCGHNDAINAWYGFFNHKFWENNGMTSTRRSFDVDKVHRISETEEFIEDLYPVHEQYEVNIDCKVSGNGFRVMPIGDYLDKYVPRFKKFIPYNFSIDCKVAYTDCPSYDKILWKVLNVGEEARRRNDIRGRIEDRGEKINENSTFKGNHYIECYLIKNGICVGIGHINVPIGQEA

SEQ ID NO: 2908 - protein, 161 aa, Enterococcus faecalis
MYDCSKQLEKFYRKKVVLSAKEQNELREKRKLNIKRLKEGLSEYNSEKNKNFKIAEERIQGSMAMHTITQNDRQDYDIDVGIVFEEDNLNELGSLATRNMVANALKRKTKQFAEVPEIKTSCVRLKYNSTGYHVDFAVFKRYKKILMMLITLMSILDQNGQ

SEQ ID NO: 2909 - protein, 161 aa, Enterococcus faecalis; identical to SEQ ID NO: 2908

SEQ ID NO: 2910 - protein, 161 aa, Enterococcus faecalis
MYDCSKQLEKFYRKKVVLSAKEQNELREKRKLNIKRLKDGLSEYNSEKNKNYKIAEERIQGSMAMHTITQNDKQDYDIDVGIVFEEDSLNELGSLATRNMVANALERKTKQFAENPEIKTSCVRLKYNSTGYHVDFAVFKRYKKILMMLITLMSILDQNGQ

SEQ ID NO: 2911 - protein, 450 aa, Unknown
  Description of Unknown: Enterococcus sequence
MYDCSKELEKFYRKKVVLSAKEQNELREKRKLNIKRLKEGLSEYNSEKNKDYKIAEERIQGSMAMHTITQNDKQDYDIDVGIVFEEDNLNELGSLATRNMVANALERKTKQFAEDPEVKTSCVRLKYNSTGYHVDFAVFKRYKKNSNDEYIYEHSGSEWSVRHIKDLELWFSERIKDKGDDLRKVIRLSKMFCKSRESWKNMPSGLIQTVICEENFNESYSRLDERFYYTMKNIVNRLNSYLEVYAPVDNGRSLVNRDVDYQRMKNWKKRLETQLDSLNILFDDECTFEYAVKAWGVFFEHSYWNELSNTVKKQSFTDTEEFIGDLYPILEQFDVTIDCKVSGNGFISMPFQKYLERYAPRLKKFIPPNFKVECSIQSTNCPAYDKILWKVLNVGAEAEKRNDIRGQIQDRGSKITENTNFRGNHFIECYLIKDNVCVGIGHVDVPIGGI

SEQ ID NO: 2912 - protein, 450 aa, Unknown
  Description of Unknown: Enterococcus sequence
MYDCSKELEKFYRKKVVLSAKEQNELREKRKLNIKRLKEGLSEYNSEKNKDYKIAEERIQGSMAMHTITQNDKQDYDIDVGIVFEEDNLNELGSLATRNMVANALERKTKQFAEDPEVKTSCVRLKYNSTGYHVDFAVFKRYKKNSNDEYIYEHSGSEWSVRHIKDLELWFSERIKDKGDNLRKVIRLSKMFCKSRESWKNMPSGLIQTVICEENFNESYSRLDEIFYYTMKNIVNRLNVYLEVYAPVDNGRPLVNRDIDYQRMKNWKNRLETQLDSLNILFDDECTFEEAVKAWEIFFEHSYWNELSNTVKKQSFTDTEEFIGDLYPILEQFDVTIDCKVSGNGFTLMSLQKYLDKYAPRLNKFIPPKFKIECSIQSTNCPAYDKILWKVLNVGHEAEKRNDIRGQIQDRGSQITENTNFRGNHFIECYLIKDDVCVGIGHVDVPIGGV

SEQ ID NO: 2913 - protein, 451 aa, Enterococcus faecalis
MYDCSKQLEKFYRKKVVLSAKEQNELREKRKLNIKRLKEGLSEYNSEKNKNFKIAEERIQGSMAMHTITQNDRQDYDIDVGIVFEEDNLNELGSLATRNMVANALKRKTKQFAEVPEIKTSCVRLKYNSTGYHVDFAVFKRYKKNSDDADYTYEHSGSEWSVRHIKDLESWFSEKIKDKGDDLRKVIRLSKMFCKSRESWKNMPSGLIQTVICEENFNESYSRLDEVFYYTMKNIVSRLNVYLEVYAPVDNGRQLVNRDIDYQRMRNWKNRLEIQLDSLNVLFDDECTSEEALKAWGIFFEHSYWNELSDTVKKQSFTDTEEFIGDLYPVLEQFEVTVDCKVSGNGFNLMTFQKYLDKYAPRLNKFIPPKFKIECSIQSTTCPEYDKILWKVLNVGPEAEKRNDIRGQIEDRGSKITENTNFSGNHFIECYLIKDDVCVGIGHVDVPIGGV

SEQ ID NO: 2914 - protein, 451 aa, Enterococcus faecalis
MYDCSKQLEKFYRKKVVLSAKEQNELREKRKLNIKRLKEGLSEYNSEKNKNFKIAEERIQGSMAMHTITQNDRQDYDIDVGIVFEEDNLNELGSLATRNMVANALKRKTKQFAEVPEIKTSCVRLKYNSTGYHVDFAVFKRYKKNSDDADYTYEHSGSEWSVRHIKDLESWFSEKIKDKGDDLRKVIRLSKMFCKSRESWKNMPSGLIQTVICEENFNESYSRLDEVFYYTMKNIVSRLNVYLEVYAPVDNGRQLVNRDIDYQRMRNWENRLEIQLDSLNVLFDDECTSEEALKAWGIFFEHSYWNELSDTVKKQSFTDTEEFIGDLYPVLEQFEVTVDCKVSGNGFNLMTFQKYLDKYAPRLNKFIPPKFKIECSIQSTTCPEYDKILWKVLNVGPEAEKRNDIRGQIEDRGSKITENTNFSGNHFIECYLIKDDVCVGIGHVDVPIGGV

SEQ ID NO: 2915 - protein, 451 aa, Enterococcus faecalis
MYDCSKQLEKFYRKKVVLSAKEQNELREKRKLNIKRLKDGLLEYNSEKNKNFKIAEERIQGSMAMHTITQNDRQDYDIDVGIVFEEDNLNELGSLATRNMVANALKRKTKQFAEVPEIKTSCVRLKYNSTGYHVDFAVFKRYKKNSDDADYTYEHSGSEWSVRHIKDLESWFSEKIKDKGDDLRKVIRLSKMFCKSRESWKNMPSGLIQTVICEENFNESYSRLDEVFYYTMKNIVSRLNVYLEVYAPVDNGRQLVNRDIDYQRMRNWKNRLEIQLDSLNVLFDDECTSEEALKAWGIFFEHSYWNELSDTVKKQSFTDTEEFIGDLYPVLEQFEVTVDCKVSGNGFNLMTFQKYLDKYAPRLNKFIPPKFKIECSIQSTTCPAYDKILWKVLNVGPEAEKRNDIRGQIEDRGSKITENTNFSGNHFIECYLIKDDVCVGIGHVDVPIGGV

SEQ ID NO: 2916 - protein, 451 aa, Unknown
  Description of Unknown: Enterococcus sequence
MYDCSKELEKFYRKKVVLSAKEQNELREKRKLNIKRLKEGLSEYNSEKNKDYKIAEERIQGSMAMHTITQNDKQDYDIDVGIVFEEDNLNELGSLATRNMVANALERKTKQFAEEPEVKTSCVRLKYSSKGYHVDFAVFKRYKENPDDDDYIYEHSGSEWSVRHIKDLELWFNERIKDKGDNLRKVIRLSKMFCKSRESWKNMPSGLIQTVICEENFNESYSRLDEIFYYTMKNIVNRLNVYLEVYAPVDNGRPLVNRDIDYQRMKNWKNRLETQLDSLKVLFDDECTFEEAVKAWEIFFEHSYWNELSNTVKKQSFTDTEEFIGDLYPILEQFDVTIDCKVSGNGFTLMSFQKYLDKYAPRLNKFIPPKFKIECSIQSTNCPAYDKILWKVLNVGHEAEKRNDIRGQIQDRGSQITENTKFRGDHYIECYLIKDNICVGIGHVNVPIGGN

SEQ ID NO: 2917 - protein, 451 aa, Unknown
  Description of Unknown: Enterococcus sequence
MYDCSKQLEKFYRKKVVLSAKEQNELREKRKLNIKRLKDGLSEYNSEKNKNYKIAEERIQGSMAMHTITQNDKQDYDIDVGIVFEEDSLNELGSLATRNMVANALERKTKQFAENPEIKTSCVRLKYNSTGYHVDFAVFKRYKKNSYDADYTYEHSGSEWSVRHIKDLESWFSERIKGKGDDLRKVIRLSKMFCKSRESWKNMPSGLIQTVICEENFNESYSRLDEIFYYTMKNIVRRLNVYLEVYAPVDNGRSLVNRDIDYQRMKNWKNRLETQLDSLNVLFDDECTSEEALKAWGIFFEHSYWNELANTVKEQNFTDTEEFIGDLYPVLEQFEVMVDCKVSGNGFTLMALQKYLEKYAPRLNKFIPPKFKIECSIKSTNCPSYDKILWKVLNVGSEAERRNEIRGQIKDRGKQITENTKFRGDHYIECYLIKDNICVGIGHVNVPIGGN

SEQ ID NO: 2918 - protein, 451 aa, Enterococcus faecalis
MYDCSKQLEKFYRKKVVLSAKEQNELREKRKLNIKRLKDGLSEYNSEKNKNYKIAEERIQGSMAMHTITQNDKQDYDIDVGIVFEEDSLNELGSLATRNMVANALERKTKQFAGNPEIKTSCVRLKYNSTGYHVDFAVFKRYKKNSYDADYTYEHSGSEWSVRHIKDLESWFSERIKGKGDDLRKVIRLSKMFCKSRESWKNMPSGLIQTVICEENFNESYSRLDEIFYYTMKNIVRRLNVYLEVYAPVDNGRSLVNRDIDYQRMKNWKNRLETQLDSLNVLFDDECTSEEALKAWGIFFEHSYWNELANTVKEQNFTDTEEFIGDLYPVLEQFEVMVDCKVSGNGFTLMALQKYLEKYAPRLNKFIPPKFKIECSIKSTNCPSYDKILWKVLNVGSEAERRNEIRGQIKDRGKQITENTKFRGDHYIECYLIKDNICVGIGHVNVPIGGN

SEQ ID NO: 2919 - protein, 125 aa, Enterococcus faecium
VYQGTPQYNSEKNKDYKIAEERIQGSMAMHTITQNDKQDYDVDVGIVFEEDNLNELGSLATRNMVANALERKTKQFAEEPEVKTSCVRLKYSSKGYHVDFAVFKRYKKILMMMITFMSILDQNGQ

SEQ ID NO: 2920 - protein, 274 aa, Lachnospiraceae bacterium
MYDCSKEFNKFYRTSVVLPETEQNELREKRKLNVKRLKEGLLEYNEENKKDYKISEDRIQGSMAMHTNVQNDEGDYDIDVGIVFESSNLNGLGPLASRNMVADALKRKTKQFAEEPEVKTSCVRLKYTSTGYHVDFALFKRDKDTVDDKEYTYEHAGAEWSICDWIYDEMDCGNKIYPKEPFVDISMVVSRIKTTKRFSKQAFEKLMDSWGKSEGECKVQLEKLNEYGYCIEEKTIEWCDSSEKKNIEKAIKSQMEQIENNYPKMAYFKPIFAI

SEQ ID NO: 2921 - protein, 459 aa, Psychrobacter sp.
MFDCSKEFKKFYNNHVKLPDQEKNILRDKRDKNIKRLKNGLEKYNNENNTSYKIAESRTQGSMAMHTIVQNDRKDYDIDVAIVFESDNLGSLGPLATRNMIADALKREMHQFSEEPEVKTGCVRVRYTTGYHIDFAIFKRSKYSEWQDEYNYEYAGDVWSARDIKALDDWFIEEIKAKTDDLRKVVRLSKMFCKSRDTWGSLPSGLIQTILCSENFDSIHSRIDEKFYHTLKSIQSRLEWNLQVNAPNNIDNARSITTRQVDLDKMRRWKDKLSTQLEKLDILFESDCTYQDAISAWGEFFNHDYWSGLGKSTVKISESLESRSYKDTEEFIDELYPVLEIYSVGIDCRVSQDGFREISLYKYLEKHLRGFSRFIPFNFKVKCKVGNTDCPSYDKVLWKVRNVGEVAENKDCIRGQIKERTHEIIEPTSFKGTHYIECYLIKNGICVAIGRVDVPIGQG

SEQ ID NO: 2922 - protein, 459 aa, Psychrobacter sp.
MFDCSKEFKKFYNNHVKLSEQEKNILRDKRDKNIKRLKNGLEKYNNENNTSYKIAESRTQGSMAMHTIVQNDRKDYDIDVAIVFESDNLGSLGPLATRNMIADALKREMHQFSEEPEVKTGCVRVRYTTGYHIDFAIFKRSKYFEWQDEYNYEYAGDVWSARDIKALDDWFIDEIKAKTDDLRKVVRLSKMFCKSRDTWGSLPSGLIQTILCSENFDSIHSRIDEKFYHTLKSIQSRLEWNLQVNAPNNIDNARSITTRQVDLDKMRRWKDKLSTQLEKLDILFESDCTYQDAISAWGEFFNHDYWSGLGKSTVKISESLESRSYKDTEEFIDELYPVLERYSVGIDCRVSQDGFREISLYKYLEKHLRGFSRFIPFNFKVKCKVGNTDCPAYDKVLWKVRNVGEVAENKDCIRGQIKERTHEIIEPTSFKGTHYIECYLIKNGICVAIGRVDVPIGQE

SEQ ID NO: 2923 - protein, 457 aa, Clostridium botulinum
MYDLSTEFNKFYRTEVVLPATVQNELREKRKLNIKRLENGLTEYNEENGTDYKICENRVQGSMSMHTVVQNDNNDYDIDVAIVFEKSKLGDLGPLATRNMVANALRRKTKQFNAEPEVKTSCVRIKYEDGYHVDFAVYRRYKESETDTEYKYEHAGSEWSSRDVRAIEDWFKGEIEGNGKNLRKIIRFSKMFCKSRDSWKNMPSGLIQTVLCDEQFADYTRIDELLYHTMERIKNRLEDDVEVSVPVDNNRALVTRDSDRQKMNNWKSRLDSKLKELDILFDDGCKYSDAVTAWSKFFNHSYLSELATAQVSESFNIKKSYGYTDTEQFIEDMYDVNELYDVSIDCRVIGNGFTLMPIYEFITTYTHRFKRFIPHNFSVKCKVGRTTAPAYDKVLWKVRNIGAEAERRDDIRGQIKERGLQISENTLFAGPHYIECYLIKNNVCVAIGHMSVPIGTE

SEQ ID NO: 2924 - protein, 447 aa, Peptoniphilus sp.
MLDCSAELNKFYNEKVVLPKKDKDKLWDSRRKNIKRLKEGLEKYNQENNASYNIEEDLIQGSMSMHTVVQNDENNYDIDVAIVFDENDLKDKGPESTRNIVANALKKETAQFSEEPEVKTGCVRIKYSTGYHVDFAVFKRYKENDEDENFIYEHAGADWSIRDIRAIEEWFDEKNKSSDGKLRKVVRLSKMFTRSRKSWKNMPSGLIQTVLCEEELADEYDRIDEIFYYTMKNIYNRLLYKLEVEAPVDNGRALVYRESDYTNMRNWKNRLNTELNKLDVLFNDCSKKDALETWGEFFNNSYLENLGESLKVENYIYKDTEEFIEDMYPIDLKYNLQIDCEIEKDGFRTMPIIRYLKEFFSLLPHNFDIRCSIKTTNCPPDYKILWKVKNVGNVAEERDMIRGQIEDRGKKIKETSDFYGPHYIECYLIKNGVCVAIDRVDIPIGDK

SEQ ID NO: 2925 - protein, 447 aa, Peptoniphilus sp.; identical to SEQ ID NO: 2924

SEQ ID NO: 2926 - protein, 455 aa, Unknown
  Description of Unknown: uncultured Clostridium sp. sequence
MYDLLSKFNTFYDSYVVLPQAEQTNLHSKKDLNIQRLKDGLQEYNEENKTSYSIVETCVQGSVAMSTVVQNEDGDYDIDVAVVFDKSALGDKGAQSTRNLVANALKRKTKQFNAEPEVKTSCVRIKYADGYHIDFAVYRRYYDLWNDCWVYEHAGSYWTKRDLRGLNEWFKTQNDNSEGKLRKVVRLSKMFCKSRKSWKNMPSGLLQTVLCDEKLQESYKRIDELFYYTMKEIVNRLETNTSVSAPVDDGRDLTPRNLDTQRMTNWKNRLKSKLEDLDILFKDDCSKADALLAWYGFFNHDYWNEQISEAASYSLKPLSKAVCAFVDNEQYIEELYPVKLSYYCRVSCIVTGNGWRPKPLTELLSILKHYLPHNFEIRCTMDYTNCPPPYKIFWKVKNVGPEAARRNQIRGQIVEKGNCIVEHSNFFGNHYIECYVVKEGVCVAKERVNIPIGRG

SEQ ID NO: 2927 - protein, 455 aa, Erysipelatoclostridium sp.
MYDLSSKFNTFYNSYVVLPQVEQTNLHNKKNLNIQRLKDGLKEYNEENKTSYSIKETCVQGSMAMSTVVQNEDEDYDIDVAVVFDKSDLGDKGAKATRNMVANALKRKTKQFNAKPEVKTSCVRVNYAEGYHIDFAIYRRTYDEWNDCYVYEHAGSDWTARELKGLSEWFTMQNENSDGKLRKVVRLSKMFCKSRKSWKNMPSGLLQTVLCDEKLQQDYERIDELFYYTIKAIVDRLETNTSVTAPVDDGRDLTPRNSDIQRMTNWKNRLRSKLEDLEILFEDDCSKADALQAWYGFFNHDYWNEQITETVSYSSHPIFKSVNTFVDTEQYIEELYPVKISYYCKVSCNVSGNGWRSKPIAEFLSILQHYLPHDFEICCTMDFTNCPKPYKIFWKVKNVGPEAERRNQIRGQIVEKGNTIVEHSNFYGNHYIECYIVKDGVCVAKKRINVPIGRG

SEQ ID NO: 2928 - protein, 456 aa, Flavonifractor sp.
MYDLSSKFASFYNDSVVLSQAKQTNLHSKKDLNIQRLKDGLKEYNEENNTFYSIAETCVQGSVAMSTVVQNEDGDYDIDVAVVFDKSTLGDKGAQATRNMVANALQRKTKQFNAEPEVKTSCVRIKYSDGYHIDFAIYRRHYDTENKRWIYEHAGTTWTERELKDLTKWFTEQNKASNGKLRKVVRLSKMFCKSRDTWKNMPSGLLQTVLCDEKLQDSYDRIDELFYYTMKEIVVRLETDVSVAAPVDNGRNLTPRQIDTQKMTNWKNRLKSKLEDLDVLFKGDCTKEDALQAWYGFFNHDFWNEQLSESSNYSQFSTLIIKSVRSFSDTEQFIEDLYPVNLSYSCKISCYVSGDGWRPKLLSEFLSLLRRYLPHNFEIRCVMEYTNCPPPYKIFWKVKNVGPEAERRNQLRGQIVEKGKTLVEHSRFFGNHYIECYIIKNGVCVAKSRIDIPIGR

SEQ ID NO: 2929 - protein, 457 aa, Butyrivibrio sp.
MYDMSSRFIAFYSSCVVLPQNKQNKLYELKDINLQRLKDGLEEYNDENGTSFCIVESCVQGSVAMSTVVQNDENDYDIDVAVVFDFSDISEIGAQAARNIVADALRRRTKQFDADPEVKTSCVRVKYAAGYHIDFAIYRRSWDEYNCCWKYEHAGKDWSERELRGLTDWFKMQNDYSDGKLRQVVRLSKMFCNSRDSWVNMPSGLLQTVLCDENLQADCSRIDELFYYTMKAVIERLDLESTVSAPVDNGRNLTPRLVDIKKITNWKNRLKSKIEDLDILFEDCCSEEDAFQAWYGFFNHDYWREQINDVFSNISMSAGKKSNVRTFNDTEEFIEDIFPVCIKYSCRVTCKVSGDGWTDTLIRDYFSKFRRFIPHNFTVKCSLTYTDCPGIYSVYWKVKNVGVEAERKNCLRGRIEERGKSIKEPTSFYGYHYIECYIIKDKVCVARTRVGIPIDRR

SEQ ID NO: 2930 - protein, 456 aa, Clostridiales bacterium
MFDLSAEFEKFYCDEVVLPQEAQNDLRAKRNTNVRRLKSGLKEYNDEHGTSYSIAETLTQGSMAMHTVIQNDSNDYDIDVAIVFNSGNINNLGPLSVRNIVADAINRKKGNLGTEPEVKTNCVRIKYSNGYHVDFAVYRRTQNSDGTYSYEHGGSAWRSRDPKAISNWFSDQIRSKGVKLRKAVRLLKTFSKSRSSWVMPGGLIQTVLCDEQINTGYDRLDETFYYLMKSIRDRLNVYIEVYNPTESAVSLLLKQSDRDKMENLRSRLDTYLGKLDVLFDSNCSKSDAYASWHEVFNHDFWNPDLVTESASLSKGAFDRSAVTFSNTEEFIENEVNVNEIYEVEIDCEASGNGFRTGPISVYIDKVLKKFLPHNLSLRFYIKECNVPKPYDIWWKVRNVGAEAERRNCIRGDLLKTNQPERKETTNFFGPHYVECYIIKNGVCVAIGHIDVPIGHS

SEQ ID NO: 2931 - protein, 347 aa, Runella slithyformis
MANCNNLFQDFDTNLGITDTKRQNMIRSRKDLEERIKKHFREKHNHLTPKFYIQGSYKMKTMIRTGDDDCDMDLGVYFFPKPNETPTTLQKWIKEAVKDATDTPPMHKKKCIRVRYEGENNPARRYHIDIPVYYRDSETTTNSPYLGLKDEGWQQSDPKKFRQWYNDKKDNDNQLTRLVRYLKAWANHKKDVFMPKGVALTVLATNYLRTKSDRDDEALYETLRAIKASLDVYFYCQMPVTPFDNLLAAFDVERRRKFLEALQAFIDDAKKALDNECQYEASQLWQKHLGKRFPDGKKIENSQGAHRNALLQKAEMIATGAYTTPSGVITHLPQQSVRNQTHLFYGD

SEQ ID NO: 2932 - protein, 347 aa, Runella slithyformis; identical to SEQ ID NO: 2931

SEQ ID NO: 2933 - protein, 362 aa, Psychroflexus torquis
MWWIPVILIGSVVLLSTKNKEEKIGNMANCNKLFSDYDNNLNIPKKKKDKLKESKEVLRERIRKHFKDNHPEYKPEFYIQGSYKMGTTILTKDDDCDLDDGVYFRREADVTATTLQKWVKDALDGATSSSVEHRSKCLRVIYKGDYHIDFPVYIFPKDDNDPSLAVKNNGFEESDPKEVVEWYKVEKAKNIQLNRIVKHLKGWGDHKRNKMPSGLAMTILAANNIQPNDRDDIALKNTLIEIQETLDNDFACIVPATPGDDLFENYDATRKNNFLSNLDDFIKDSKQALDNEPNQLKASRLWRKHLGIHFPFGEDEDTDAKEAALKRISENVLKGAAYSQSSGTISTEPTRAKNKPHTNYGG

SEQ ID NO: 2934 - protein, 362 aa, Psychroflexus torquis; identical to SEQ ID NO: 2933

SEQ ID NO: 2935 - protein, 337 aa, Muricauda sp.
MANCNKLFLDYNENLKIPSEKKKRLKSSKETLRDRIRNHFKKNHPEYEPEFYIQGSYKMGTTILTKDEECDLDDGVYFKREADVTATTLQKWVKDALDGATSTPVEHRSKCLRVIYKADYHIDFPVYIFPDGDEHPSLTIKNEGFEESDPKDVVEWYKKEKKKNEQLKRIVKHLKGWGDHKRNKMPSGLAMTILGAENLQPNERDDVALKDTLIKIQKTLDGKFECIVPATPYDDLFENYDATRKSNFLNNLDDFIQDAKKAVDDEPNQLRASKLWRKHLGDKFPLGADEDVDAKEASLRAISAAVLSDNAFSDSTGRISTDNTGVKNKPHTNYGGQ

SEQ ID NO: 2936 - protein, 337 aa, Dokdonia pacifica
MANCNGLILNYSNNLNISKKKKDKLRDSKNFLQDKITSYFKKNHPDYIPEFYIQGSYKMKTMILTKDNECDLDYGVYFKRDVDVTGTTLQKWVKKALKDVTSIPTEHRKKCIRVKYKAEYHIDFPVYYFPDDCDHPLLAVKDDDLQESDPREVVDWYNSEKDENGQLNRIVKYLKGWGDYKRNKMPSGLAMTILATENIQYNDRDDIALKDTLIAIHNTLLEDFECKVPGTPYDDLFADYDSTRMNNFLDNLDSFVDDAIEAVENESNQRKASKLWRKHLGRDKFPLGEDVDVDAKEVSLRKTSKNILTGTAYSQKDGSISNNSSGVKNKIHTNFGG

SEQ ID NO: 2937 - protein, 336 aa, Olleya marilimosa
MANCNKLFKDYNVNLTIKSAKKDRLKESKRVLRDRIRKYFKDNHPDYVPEFYIQGSYKMKTTIVTKDDDCDLDDGVYFKREVGVTGTTLQKWVKDAVTGATSADPQHRKRCVRVIYAADYHIDFPVYYFQEDWEHPRLAVKDEELQESDPKEVIDWFAGAKDENGQLVRVVKFLKGWGDFKRNKMPSGLAMCILAEKNIKYNDRDDISIKETLETIKTALNNSFECIVPGTPYDDLFSDYDDSRKNNFLSNLDDFIKDATKAVEDEPNQLKSSKLWRKHFGDKFPLGADEDVDAKEKALLAQSASILSGTAHTKRDGSISDSGSVKNKPHTNYGGK

SEQ ID NO: 2938 - protein, 341 aa, Bacteroides fragilis
MANLDTQFQEFYGELQITVTKKQALITSHNNLRTKIQKYFAKNHPEYVPSFYIQGSYKMGTTIRTRDDECDLDDGCYFIPKPEVKGITLQNWVMDAVNGTVGATPVHKNKCIRVNYAAGYHIDLPVYRKERCNDNTEHPELAVRDGEYELSDPREIVQWFNSKKKDNPVLIRLVSYLKSWCDTVRGFMPPGLAMTILASKYQKKHEGRDDIALRDTLKSIRTALQANFSCVVPGTPYDDLFESYDSNRQEKFMSELDGFIEDADRAVNEKNKLKASKLWKKHLGNRFHLAPDENDAEMSKLDKLRDIGNKVLTGIATTAHNGYIHAAEGVKNVSHRNYGNE

SEQ ID NO: 2939 - protein, 481 aa, Hymenobacter coccineus
MANCNKLFLDFNQNLNVLSAKKTKLSTSKNELRRKITDYFKEHHSAYKPKFFTQGSQKLGTVIRIHDDTCDLDDGVYFLCEPDVTPTTLQRWVYEAVKDHTSEPAQWRKKCIRVTYKADYHIDLPVYYMLADEDHPHLAVKNEGWEDSDPKEFITWFRKQRDAKGQLVRLVKYLKSWGDWCAHKMPSGLCMTVLAECNFVANDRDDCALRALLKAIRTDLEREWKCTMPTTPGDDLFGKYSDELKRNFFDALDELIEDADEAVDDEKNQLSASKLWRHHLGPRFPDGLDEDVDAKEVKLRASADLINSGRAATTAAVSIASQGRDRVSNPPHRFDGGRRFHLLARQGRNWFAVFHREKQLVERHYPAFRCQSTRDALCCRGEVASPGGEGTYRIKIECTPGRPPKVFVLNPGIEYRDHSLTHFYPADNSLCLYYPGDLQWSDKHHLHDKTIPWLAEWLVFYELYQITGRWEGPAVDHRLHS

SEQ ID NO: 2940 - protein, 314 aa, Lewinella sp.
MANCHKLFLTFNSDLKITTTKKRNLIKSKDSLRDRIRKWFRENRPDYVPLFWIQGSYKMKVVIRTKDDTCDLDDGIYFARKIDVSPSTMQGWIYQAVSGHTGNASQRQKCVRVDFAGNYHIDYPIYQNEDQDTAPWLCIKDGAWDDEQSDPKAYVDWFNERKTDQLARIIRYLKSWGDNVRHNMLSGLAMTLLAEDNYYQDERDDEALLQTLRNVQASLEDEWTAVMPTVPNDDVIKKHDKDFQKRFFDKLDALITDGESALEQESELKASKLWRKHLGARFPLGKAPSGSRSDSLREVADRGMFSPYFSIDLQ

SEQ ID NO: 2941 - protein, 318 aa, Lewinella agarilytica
MANCHSLFSTFNGELQITSTKRANLIKSKDALRKAIIKWFKENHPEYVPKFWIQGSYKMKTVIRTKDDMCDLDDGIYFLCEPDVTPATLQNWVYQAVCDHTKEGATRHRKCVRVHFAKDYQIDLPIYKKADGDDHPWLCVKGGTWAEEQSDPKEFVEWYDEERNHQLTRIIRYLKSWGDTVRHNMLSGLAMTLVAQANYDEDDRDDQALYNILVAIRSSLKSNWQAKMPTTPGDDILAEYDHDFRDRFFSHLDSFIEDAKNALEQESEKKASNLWRKHLGKRFPEGEDDDAKTDNVNRLKEVASRGTVAPYWGGKVSN

SEQ ID NO: 2942 - protein, 342 aa, Gracilimonas tropica
MANCNKLFLDFNKDLRPSKTKRGRMKISRENLRDKIRDHFNENHPEYSPHFYIQGSANRLINTQILYKDNTCDLDDGIYFFRDPDVEAKTLQGWVKEAVKDATDTAPQHRRKCIRVIYQDDYHIDLPVYCKKDKDDDSTPPELADKDNGFSPSDPKEFVEWFHDEKDDDKQLVRIVKYLKAWGDKIRNKMPTGLALSVLTAECISCNERDDIALKETLVSIKSKLDRSWKLEMPTVPHDDLFSGYDDDKKDYIIEKLDAFIDDANKALDEPNQLKASNLWRKHLGDRFPKGKDEDTDTKEEALKKKAAILSSNAFVGRDGKVTDDSKAGKPVPDTKNYGGKI

SEQ ID NO: 2943 - protein, 337 aa, Polaribacter dokdonensis
MANCNKLFLDFNDKLKLTSSKIRRMITARENIKTKIAEYFKDKSKYSFSGTWIQGSYKMDTIIRTNEDTCDMDLGVYFKSVDSEVTTATVMDHVFKAVENVTSTTPSKKSKCIRVIYKDDFHIDIPVYHYNSEEHNHPKLATRYNGWEESDPKDFYVWFNEKSEDLPQMKRIVKYLKAWSDNKKGKFPSGLAFTIWAVKHLELNDRDDVALYEVLKKIKNDIDYSWFLPMPVTPFDDVCKKLSDQQKSNFKDALKAFIDDAKDALESKNQLEASKLWQAHLGDRFSDGADEDTDAKEAALRRISEKVLASNAYSQRSGVLNDDTLGVKNKPHTNYGG

SEQ ID NO: 2944 - protein, 353 aa, Polaribacter dokdonensis
MIIHQLTEDTPLKINNMANCNKLFLDFNDKLKLTSSKIRRMITARENIKTKIAEYFKDKSKYSFSGTWIQGSYKMDTIIRTNEDTCDMDLGVYFKSVDSEVTTATVMDHVFKAVENVTSTTPSKKSKCIRVIYKDDFHIDIPVYHYNSEEHNHPKLATRYNGWEESDPKDFYVWFNEKSEDLPQMKRIVKYLKAWSDNKKGKFPSGLAFTIWAVKHLELNDRDDVALYEVLKKIKNDIDYSWFLPMPVTPFDDVCKKLSDQQKSNFKDALKAFIDDAKDALESKNQLEASKLWQAHLGDRFSDGADEDTDAKEAALRRISEKVLASNAYSQRSGVLNDDTLGVKNKPHTNYGG

SEQ ID NO: 2945 - protein, 368 aa, Polaribacter dokdonensis
MDNLFFQVLKNIIDGMIIHQLTEDTPLKINNMANCNKLFLDFNDKLKLTSSKIRRMITARENIKTKIAEYFKDKSKYSFSGTWIQGSYKMDTIIRTNEDTCDMDLGVYFKSVDSEVTTATVMDHVFKAVENVTSTTPSKKSKCIRVIYKDDFHIDIPVYHYNSEEHNHPKLATRYNGWEESDPKDFYVWFNEKSEDLPQMKRIVKYLKAWSDNKKGKFPSGLAFTIWAVKHLELNDRDDVALYEVLKKIKNDIDYSWFLPMPVTPFDDVCKKLSDQQKSNFKDALKAFIDDAKDALESKNQLEASKLWQAHLGDRFSDGADEDTDAKEAALRRISEKVLASNAYSQRSGVLNDDTLGVKNKPHTNYGG

SEQ ID NO: 2946 - protein, 354 aa, Winogradskyella thalassocola
MIIHQLTKNEHLKINDMANCNKLFLDYNNKLKLTSSKIKRMKTARENIKTKITEYFKDKSKYSFTGTWIQGSYKMDTIIRTDDDTCDMDLGVYFKMVDSEVTAATVMDQVFKAVEDITTTTPSKKSKCIRVVYKGDFHIDIPVYHYNTNEHSHPRLATRYNGWEESDPKDFYDWFNNQSSDDLPQLKRIIKYLKAWSDNKKGKFPSGLAFSIWAVSLLNINERDDIALYELLKKIRDDISYSWSLKMPVTPFDDVCKKLTYEQKSNFKDALEAFIKDAKDAIESKNQLAASTLWQNHLGNRFPEGADEDTDAKEADLKTISEKVLSSTAYTQSSGAITSQTTGVKNKRHTSYGG

SEQ ID NO: 2947 - protein, 336 aa, Flavobacterium sp.
MANCNKLFLDFNKVITPTSEEMKKMKTSREALQKKITTKLKDKLNMTPSYYTQGSGARDMKTIIIKEDGTYDSDRGIFLPEKPSVTAETVQGYVYDAVCDHTDDGAEHRKKCIRVFYKSAYNIDFPIYYEVKGEDYSYMAVKGDGWIKDDPSHMVNWLSKHKDSNGQLVKVIKCLKAWASKSSLKMPSGIAFAVWACNNFSESIDRDDESLYQTLKNIKSELSWGVTCDSPVEPYDDLTSKLTQDQKDKFKKELDKFVEDAKKALDEENQLESSKTWRKYLGDRFPLGADENTDAKERALMFSASHVLDGSAHLDKSGNINPSTGVNHKTHRNYGG

SEQ ID NO: 2948 - protein, 336 aa, Confluentibacter sp.
MANCNKLFQDFNKVITPSNEQMQQMKTSREALEKKISAKIKDKLNMNTSYFTQGSSAKDMKTIIIKEDGTYDSDRGVYLPEIPDVAAETVQKYVYDAVKDHTSGGAEHRKKCIRVFYKSAYNIDFPIYYEVKNEDYAYMAVKGIGWVKDDPWHMIKWLEKHKDSNGQLVKIIKYLKVWVSKCNFKMPSGIAFAVWAANNFSEKIDRDDESLYHTLKNIQSELYWNVVCDSPVEPFDDLTDKLKQEQKDKFKKELDKFVDDAKNALDEKNQLAASKIWRKYLGDRYPLGVNEDVDAKERALMFSANQILSGSALLDESGRINTSGGVNHKPHRNYGG

SEQ ID NO: 2949 - protein, 247 aa, Mucilaginibacter gossypii
MADCNNLFLDYNKVITPTSIQRQKMKTSRKSLETKISNKLYDKLGVYPTFFTQGSDAPKFKTIIIKEDSTFDSDRGVYLPGKPNVSGETVQGYIYDAVKDHTKDGAQHRKKCVRVLFQCEYNIDFPAYYEVEGEDYAYMAVKGEDWLKDDPWHMITWLTQFKDADGQFIRMIKYLKGWTSKRKSQGKMPSGIALAVWAARHFSIEDGRDDKCFLNLLKGIKSAIQFSVSCYAPVEPFDDLTAKLSKR

SEQ ID NO: 2950 - protein, 321 aa, Sphingobacteriales bacterium
MANCHKLFQDYNSEISIPKSKKDKMSGSKEGLRKRIREDFKKNHPGYEPRFHIQGSGGPKMRTGIRTKDDICDLDDGVYFFREPDVSATTLQTWIKDAVAGYTDTDPEHRKKCIRNIFEKDYEIDQPVYYKVDGKNYQLAVKNTGWEDSDPKALADWFHKQKDKNGQLVKIVKYEKGWCDNIRNKMPSGLAMTILACNAKAKINYTVDRDDITLRDTLKEIKKVLDLKFDCIVPVVPGDDLFKDYDKNRKDNFMAALQNFIDDADTAINEKNELKASKLWQKHLGSRFPDGEDKDETTSNSAPSIAALKRTAIVSQPWGLK

SEQ ID NO: 2951 - protein, 315 aa, Siphonobacter sp.
MANCHNLFMDYHDDISIGSTKKNKMINSKNALRKRIREWFKENHPDYVPKFYIQGSHKMKSGIRTKEDICDLDDGVYFFRKPDVTATTLQGWVWDAVNGHTSTTPEHRRKCIRSVFVNDYEIDHPIYYKIEGQEYRIAVKGNGFEDSDSKAVVNWFNSKKDKDGKLLRHVKYSKGWCDNIRNKMPSGLAMTILISNAKERIVLNERDDITLRDLLKEIKRALDREFKCIVPAIPNDDLFANYSDARKNNFLRSLDEFIADADAAIREENQFKASKLWRRHLGSRFPEGKDEKQQVNSRAAAAAAAGAITSNPWAN

SEQ ID NO: 2952 - protein, 315 aa, Mucilaginibacter pedocola
MANCHDLFLGYHEDISIGSSKKNRMITSKEGLRKRIRKWFKDNHPDYEPKFFIQGSHKMKSGIRTKDDICDLDDGIYFFRKPDVTSTTLQNWVWDAVDGYTDTDPEHRKKCIRSIFAGDYEIDHPIYYKVEGEDYQIAVKSNGFEASDPKAMVEWFEGKKDKSGKLIRDVKYLKGWCDERRHRMPSGLAMTILAGNAKDKIVLNDRDDITLRDILKEIKKELDRDFKCIVPAKPNDDLFADYDETRKSNFLNALKDFINDADAALKEENQLTASKLWKKHLGSRFPEGKDEKQQSNRTANAVVAGAATSTPWACE

SEQ ID NO: 2953 - protein, 199 aa, Prolixibacter bellariivorans
MANCHSLFQDFHEDISIGKSKKDRMMNSKNGLRKRIRKWFKDNHPDYEPKFYIQGSYKMKTGIRTKDDICDLDDGIYFFREPDVTATTLQTWVWNAVDGYTSTTPEHRKKCIRSIFSGDYEIDHPIYYKVDGQNYRLAVKNNGFEDSDPKEMVDWFNKQKDVDGKLIRHVKYLKAWCDNKRNKMPNGLAMTNSCVECKN

SEQ ID NO: 2954 - protein, 316 aa, Prolixibacter bellariivorans
MANCHSLFQDFHEDISIGKSKKDRMMNSKNGLRKRIRKWFKDNHPDYEPKFYIQGSYKMKTGIRTKDDICDLDDGIYFFREPDVTATTLQTWVWNAVDGYTSTTPEHRKKCIRSIFSGDYEIDHPIYYKVDGQNYRLAVKNNGFEDSDPKEMVDWFNKQKDVDGKLIRHVKYLKAWCDNKRNKMPNGLAMTILASNAKTKIVLNSRDDITLKDILKEIKKALNIKFECIVPAVPNDDLFADYDETRQTNFLTALDNFIEDAEKALRENNQLTASKLWRKHLGNRFPEGEDKEDESRSQHAAAIAAGAAKSNPWASE

SEQ ID NO: 2955 - protein, 314 aa, Pedobacter luteus
MADCHKLFEEFQDEISLPSGKKSRMTTSKSALRERIRKFFKDNHPEYDPKFYIQGSYKMGTVIRTKDDICDLDDGIYFFREPDVTATTLQGWVWDAVQGYTSTDPEHRKKCIRKLFSADYEIDYPVYCKEDGKEYQIAVKNIGFEDSDPKAVVKWFNNKKDPKGILVRIVKDLKGWCDNIRNKMPSGLAMTILASNAKSRIVLNDREDITLRDILKEIKKALEIKFECVVPALPNDDLFESYDETRKSNFLTSLENFIEDADKAIREDNQLAASKHWRKHLGDRFPKGEDKKDKEDAIAAAVTLGAATSNPWSE

SEQ ID NO: 2956 - protein, 313 aa, Flavobacteriales bacterium
MANCHNLFGEFNTEISLTSNKKTKMTTSKDGLRERIRKHFKLHHPEYVPKFYIQGSYKMKTGIRTKDDICDLDDGVYFFRTPDVTATTLQNWIWDAVNGYTSTTPEHRKKCIRNIFSGDYEIDIPVYYKIYGKEYQLAVKNNCWEDSDPKELIDWFNNKKDPHGKMIKAIKELKAWCDHKRNKMPSGLAMTILAMNAKAKIVLNDRDDILLTDILREIKKALAQKFECIVHAAPKDDLFADYDETRKSNFLNNLDSFLSDAEAALKEQNQLKASRLWQKHLGTRFPDGEDKNEQSNSSVATTSGAALSRPWGK

SEQ ID NO: 2957 - protein, 313 aa, Flavobacteriaceae bacterium
MANCHHLFGEFNTEISLTSNKKTKMTTSKDGLRERIRKYFKEHHPEYVPKFYIQGSYKMKTGIRTKDDICDLDDGVYFFRTPDVTATTLQNWIWDAVNGYTTTTPEHRKKCIRNIFSGDYEIDIPVYYKINGKEYQLAVKNNGWEDSDPKAFIDLFNNNKDANGKMIKAIKELKAWCDHKRNKMPSGLAMTILAMNAKAKIVLNDRDDILLTDILREIKKALAQEFECIVPAAPKDDLFADYDETRKSNFLNNLDSFLSDAEAALKEQNQLKASRLWQKHLGTRFPDGEDKNEQSNSSAVTTSGAALSRPWGK

SEQ ID NO: 2958 - protein, 313 aa, Flavobacteriaceae bacterium
MANCHHLFGEFNTQISLTSNKKTKMNTSKDGLRERIRKYFKVHHPEYVPKFYIQGSYKMKTGIRTKDDICDLDDGVYFFRNPDVSATTLQNWVWDAVNGYTSSSPEHRKKCIRNIFSGDYEIDIPVYYKIDRKEYQLAVKNDGWENSDPKALIDWFNDNKDANGKMIKVIKELKAWCDHKRNKMPSGLAMTILAMNAKNKIVLNDRDDILLTDILREIKKTLAQKFECIVPVTPKDDLFAEYDSTRKNNFLTNLDSFLADAEAALKEPNQLKASRLWKKHLGTRFPDGEDKNEQSKSNAATTSGAVLSRPWGK

SEQ ID NO: 2959 - protein, 315 aa, Spirosoma sp.
MADCQNLFRSYLAKISIDSEKEKKMKTSRDKLRDRIRDWFKKNQPDYKPCFYVQGSTKMKSVIKTKDDICDLDDGVYFFQTPTHEPETLQDWVRQAVDGYTSKPAQHRKKCIRTIFAGDYEIDHPVYYKDVDTDEYQIAIKGEDWRDDDPKGMISWFIKKKKQDTRIVNAVMYLKAWCDFKRHKMPSGLTMTILASNTLDKIVLNDRDDITLRDILSEIKKTLDSEFKCIVPVKPGDDLFEDYDQTREDNFKTALKEFLDDANKALREENQFKASKLWQKHLGDRFPDGEDKKQESALKTTIVTGAARSNPWCND

SEQ ID NO: 2960 - protein, 298 aa, Epilithonimonas sp.
MANCNNLFKKFNRSISIDADKSTKMTNSKTKLRDRIRKWFKDNHSEYEPKFYIQGSYKMKTGIRTKDDICDLDDGVYFFRQPDVSATTLQKWVHQAVNGYTATPSEHRKKCIRTIFTSDYEVDHPVYYKVAGEDYQIAVKDNGFEGSDPKAVIDWFNSNKDKNGILISTVKYLKAWCDNLRNKMPSGLAMTILAVNAKNKIVLNQRDDITLKDILKEIKNTLNVRFECIVPAVPYDNLFESYDDTRKNNFIKALNDFIDDSEKALKEENELKASKLWRKHLGERFPEGKDENQSSSSK

SEQ ID NO: 2961 - protein, 314 aa, Chryseobacterium sp.
MANCNNLFKKFNRSISIDADKSTKMTNSKTKLRDRIRKWFKDNHSEYEPKFYIQGSYKMKTGIRTKDDICDLDDGVYFFRQPDVSATTLQKWVHQAVNGYTATPSEHRKKCIRTIFTSDYEVDHPVYYKVAGEDYQIAVKDNGFEGSDPKAVIDWFNSNKDKNGILISTVKYLKAWCDNLRNKMPSGLAMTILAVNAKNKIVLNQRDDITLKDILKEIKNTLNVRFECIVPAVPYDNLFESYDDTRKNNFIKALNDFIDDSEKALKEENELKASKLWRKHLGERFPEGKDENQSSSSKAAAAAVGASTSFPWAK

SEQ ID NO: 2962 - protein, 314 aa, Chryseobacterium arthrosphaerae
MANCNNLFKQFNGSISIDSHKNSKMTSSKTKLRDRIRKWFKDNHPDYEPKFYIQGSYKMKTGIRTKDDICDLDDGVYFFRQPDVSATTLQKWVHQAVNGYTATPSEHRKKCIRTIFTSDYEIDHPVYYKVDGEDYQIAVKDNGFEGSDPKAVIDWFNSNKDKEGILISTVKYLKAWCDNLRNKMPSGLAMTILAVNAKNKIVLNQRDDITLKDILKEIRNALNIKFECMVPAVPYDNLFKSYDENRKNNFLKALNDFIDDAEKALREENELKASKLWRKHLGERFPEGKDESQSSSSRAAAAAIGASTSFPWAK

SEQ ID NO: 2963 - protein, 314 aa, Elizabethkingia anophelis
MANCNNLFKDFNKSISISADKKSKMTNSKEKLRDRIRKWFKDNHPDYEPKFYIQGSYKMRTAIRTKDDICDLDDGVYFFKEPDVTATTLQKWVHQAVNGYTNTPSEHRKKCIRTIFTSDYEIDHPVYYKIESEDYQIAVKDSGFEGSDPKAVVEWFNKNKDNNGYLISMVKYLKAWCDHLRNKMPSGLAMTILAVKAKNNIVLNQRDDITLKDILKEIRNILNIRFECIVPAVPYDDLFENYDETRKNNFLNSLNNFIEDAEEALREENELKSSKLWRKHLGERFPEGKNQDQNKSNKAAAAAVGAATSFPWAK

SEQ ID NO: 2964 - protein, 312 aa, Myroides sp.
MANSHNLFQEYHQEISISSKKNEKMKNSKEALRKRIKAWFEKNHPDYKPCFYIQGSYKMKNGIRTSQDICDLDDGIYFFRQPDVSASTLKDWVKQAVDGHTDTKPENRKKCVRSIFVNDYEIDHPVYYKVEGQEYKLAVNGSGFEDSDPKAVVDWFVSNKDKEGRLVRIIKYLKGWADKQTFKMPSGLALTILATNAKNRIVLNERDDISLRDILKEIKRDLTNKFECIVPAVPKDDLLDSYVNKDKFLDCLDRFIEDADRALFESNHRESSKAWRKHLGDRFPLGQNKEENRSLSSAAAALGAITSKPFGV

SEQ ID NO: 2965 - protein, 289 aa, Sphingobacterium faecium
MKSSKEGLRKKIRKWFNDNHPDYVPQFYIQGSYKMKNGIRTEQDICDLDDGIYFFREPDVTASTIKEWVRQAVDGYTDTAAENRKKCVRTIFVNDYEVDHPVYYKIDGQEYKIAVKGNGWEDSDPKAMVDWFVSKKDKDGRLIRDIKYLKGWADNRPFKMPSGLALTILATNAKEKIVLNERDDITFRDILKEIKKVLNNEFTCIVPATPNDDLLEGYVNKDKFLEALNNLITDADEAIRSNNQRTASKLWRKHLGDWFPLGEDKEENLLSNVAAAAIGASSSIPYGHE

SEQ ID NO: 2966 - protein, 359 aa, Bacteroidetes bacterium
MANCNNLFSEFNKSIKLTDERRQKLRNKRNDLRKRIEGGYGIVKASDRYDHELKFQTQGSFIMDTIISPEDKNCEYDLDDGLYFIGSASRNDRPVPATFHNWVIKSIKEGKSDNQYEEIIDKYTCVRVKYKGNNGDFNYHIDIPIYYARNLNNPDLAHLNSGWIESNPIDFIVWFEKLIESGFRQEFILERKLYSDEYQNWFSDIRKKDHQLRKIVRYLKAWGDHLDGEMPPGIVMTILAGYNYKSNERDDISLKETLINIQSYLKNNGFKCPRPTSPKDEDLFKNYTPEQKDFFLNELDEFVTSAKQAIELENQKSACRKWQKHLGDRFPCFLAKDEIEGSKSYAAPTIIKSDNSKSA

SEQ ID NO: 2967 - protein, 359 aa, Tenacibaculum holothuriorum
MANCNNLFREFNRTIRLDNDRRIKLKEKRNDLRKRINGGFDIIKTNDNLNHRLEFQSQGSYVMDTIINPCNEEDQYDIDDGIYFLGELSREQRPEPSVFHDWIIKSIKSGKSDNDFEEIIDKDTCVRVVYKGDNGDLNYHVDLPSYYAIIVDEPDLADKKMWWQISSPIEFIIWFEKKINSGFKKEFIVESKLYSDQYSNWLNDMRKKDHQLRRIVRYLKAWGDFLKGDMPPGIVMTILAGVNYEEDDRDDISLEKTLKNIADYLVKNDFKCIRPTTPIGEDLFEKYKPQQKEYFKNALNSFIESAMQAIEMENQKSACRKWQKHLGDRFPCFLAKDEIEDSKTYTSAPLIKSDNSRSA

SEQ ID NO: 2968 - protein, 359 aa, Gramella portivictoriae
MANCNNLFIEFNKEIRLTDKRRKKLRKRRNDLRKRIQSGYNIIKSSGETRHDITFQSQGSYVMDTIINPENKDCEYDLDDGLYFFGQLSKHQRPKAQTFHNWVIRAIEQGKSDRNYEEIKDKPPCVRVHFRSPGNDFNYHVDIPIYYAREIHRPELAHLNEEWPESNPVAFIIWFEEKTESGFKQEFILEREKFYGEYKDWLNDIRKKDHQLRRIVRYLKAWGDHIDNDMPPGIAMTILAGRNYCPADRDDESMTLTLEEIARFLENNGFQCPRPTSPVGEDLFASYNQEQKNFFKERLDAFIESAKEAMAAENQKEACRKWKEHLGKRFPCQLAKDKMEGSDTQSNPVIINSSRDKSA

SEQ ID NO: 2969 - protein, 346 aa, Flavobacterium fontis
MANCNELFKTFNSTIRLNEESREILKSVRNSLREKMNSRFKQIKDIDNHTLEFQSQGSFIMDTIIKPKDDDYDLDDGVYFIGSLTQEKRPTTQQFHDAVIIAVGTDENYATITDKETCVRVSYEKEKFHIDLPIYYANKINPELAHTKEDWILSNPIKFIAWFEKIAESSFREELILEKNLFSEEYKTWLDDIRKKDVQLRRIVRYLKAWGDDLRGEMPPGIVMTILAAENYVKNDRDDIALKETLIKIRQYLKSNNCKCLRPTVPVGEDLFKNYSQTKKQYFLDRLDTFIESAEQAVNHPNQKDACYKWQKHLGPRFPCSIAKDTIDGANTYERPAIIGSTAKSA

SEQ ID NO: 2970 - protein, 347 aa, Algoriphagus marincola
MANCNLLFAEYNRIIRLSDEKRKELLEARNNLRIRLRQGYIIVSKELGLKHEIQHQSQGSFVMDTIIAPMRGDYDIDDGLYFIGSLNRSSRPTPSEFHKWIKSALDRGHDDIEKVIDKSTCVRVQYKIGFHVDIPIYYADNIDCPDLADVNRGWILSHPIEFIEWFEQKIQSGFKKGFITESRLFDEFVQWTSDIRKNDHQLRRIVRYLKAWGDLRREEMPCGLIMTILAANNYYPHHRDDISLKETLINIQASLQEEFKCERPTTPKGENLFDGYKNEEAFMKYLGYFIENAKKALEEPNHKLACKYWQTSLGDRFPCHLAKDEIIGNSATVSLGIGGSIRKPWCY

SEQ ID NO: 2971 - protein, 350 aa, Mucilaginibacter sp.
MANCHNLFQDYNGKIKLSDAKRIELITVRDDLRARIINGYNLFSHALAQYHRIEFQSQGSFVMDTIIVPIHDDYDLDDGVYFIGNISKEQRPAPAVFHEYVIRAIDHGYDDIEKIVDKETCVRVIYKKGFHVDIPIYYADNLDHPDLANKALGWILSNPIEFIAWFEDKIQSGFKKSYLLEAAMYDEYRRWITDIRKQDHQLRRIVRYLKSWGDLRREEMPCGLIMTILATNHYHPHERDDIALKETLVNMQASLQRKFECTRPTTPKGEDLLGNYKNKDAFMNYIGQFIENAKKALEEPNQKIACGHWQKSLGDRFSCENSINSTSFNIGSAGLAAGAASSRPWGKLVY

SEQ ID NO: 2972 - protein, 370 aa, Roseivirga seohaensis
MANTHNLFEEYNREIKLDGDRRGLLKVRRDDLRSRIKGGFRELKQEKQLLLEGLNITIEEEMEFQSQGSYVMDTIINPSRKEDEYDIDDGVYFMGSRDRYSRPDPEAFHEFVIQSIKKGESKNTIEEIEDRSTCVRVKYKGVNGDFNYHVDLPIYYAINVKEPDLADTKDGWYTSNPIEFIVWFEDLVQSGFKAEFILESKFFEEEYKEWLNDRRKADHQLRRIVRYLKAWGDHLKGDMPPGVVMTILAGSDSNFAGGDRDDVALRDTLVNIKNWLELNGFKCPRPTTPKGEDLFRGYSDEKKEYFRNVLNSFITSANQALENPNQKDASLKWQKHLGSRFPTHLAKDEIEGAKTYLASPVIKSNNSRSA

SEQ ID NO: 2973 - protein, 285 aa, Runella slithyformis
MANLHEDFLFFNNALNIPSSKLTQLKTSEANIKRYIKSYLTEKKVPVPTLIRQGSFALGTIIRTKTDTCDIDFGVRFFPDPQFAAPTLQKYIRDALTKVSNSTLPKHKDKCIRLHYKAGYHIDVTIYVHTNFNEPIRLATKNGWLDSNPSGFKKWVEERGGKQAVQLKRLIRYIKAWASQQGKNMPKGVALTTLMANGFVPHFRDDLSLLYTLRNVYDNLEEDFCCEMPVVPFDDLLERMYEHRYSFLNKLESLINNLEKATHARLGNDKAKALIKGHFGKYFPK

SEQ ID NO: 2974 - protein, 420 aa, Nostoc sp.
MADCHKLFLEFNTFIALNSKRKEGLRVSRNAVRDKIRRYFQDKQNGFVPKFHGQGSFMMNTIIEPLDGEFDIDDGIYFKVETQPVKSVSTFHQWIWEAVNGQTKQEPIDKQTCVRIVYTRQYHIDLPIYYVIEGQTPYLAHKAKGWIQSDPREFIKWFNKKADNEGQLKRIVRYLKAWSDYRKGDLPSGLIFSILAANNIVFDERDDVAFYQTLLNIKRNLEWNFVCYRPTTPAYENLLEDYSKTKKNYFLGQLSSFIESAKTALDDNTSQRDACKAWQRHFGKDRFPFESEEFIEDYYQLDLRYKLTIDCRVTQAGFRTYSLKQMFSKKLPLLPNKKLEFYIVDFNAPEPFKVKWKVRNVGNEAIRRRQIRGQIVKDSGNYRINESSNFHGSHFVECYLIKNNFCVARARIDVPIKLPE

SEQ ID NO: 2975 - protein, 436 aa, Nostoc sp.
MLSFLKNVNNILLGDSVADCHKLFLEFNTFIALNSKRKEGLRVSRNAVRDKIRRYFQDKQNGFVPKFHGQGSFMMNTIIEPLDGEFDIDDGIYFKVETQPVKSVSTFHQWIWEAVNGQTKQEPIDKQTCVRIVYTRQYHIDLPIYYVIEGQTPYLAHKAKGWIQSDPREFIKWFNKKADNEGQLKRIVRYLKAWSDYRKGDLPSGLIFSILAANNIVFDERDDVAFYQTLLNIKRNLEWNFVCYRPTTPAYENLLEDYSKTKKNYFLGQLSSFIESAKTALDDNTSQRDACKAWQRHFGKDRFPFESEEFIEDYYQLDLRYKLTIDCRVTQAGFRTYSLKQMFSKKLPLLPNKKLEFYIVDFNAPEPFKVKWKVRNVGNEAIRRRQIRGQIVKDSGNYRINESSNFHGSHFVECYLIKNNFCVARARIDVPIKLPE

SEQ ID NO: 2976 - protein, 174 aa, Coleofasciculus chthonoplastes
MANCHQLFLEFNNLIALDSKRKETLRTSRDAVRERIRRYFRDKQNGFVPKFHGQGSFMMNTIIEPLDGEFDIDDGIYFKLKAKPLQAVSTFHKWIWEAVNGHTKQNPIDKQTCVRLVYAGQYHLDLPIYYIIEGQTPYLAHKGRGWIQSDPREFRKWFNDKADNDGQLKRIVRY

SEQ ID NO: 2977 - protein, 420 aa, Scytonema sp.
MGNCHKLFLDFNTVIALKSSRKNSLRKSRNAVRDKIREYFRDKHNGFFPKFHGQGSFMMNTIIEPLDGEFDIDDGIYFKVEAEPLQSISTFHRWICEAVDGHTKQNPIDKQTCVRLVYARQYHIDLPIYYIIEGQTPYLAHKGKGWIKSDPREFIKWFNSKADNNGQLKRIVRYLKAWSDYRKGDLPSGLIFSILAANNIIFDERDDVALYRTLLKIKSSLELNFVCYRPTTPADENLLEDYSKTNKDYFLGQLGSFIQSAEKALGEKTSQKDACKAWQRHFGEDRFPIESEEFIEHDFQVDIQYELKIDCLVSQKGFRAHSLRQMILSRLPLLRNKNLEFHIVDCNVPKPFQVKWKVRNVGEEAKRRNQIRGQILNDSGNYRRIESSDFHGPHFVECYIIKDNLCVARSKIDVPIKLPE

SEQ ID NO: 2978 - protein, 288 aa, Prochloron didemni
MANCHKLFLEFNSVIALSSSRKEKLRKSRNAVRDKIRDYFKKKQNGFSPKFHGQGSFMTNCMIKPIDGEFDIDDGIYFEVEAEPTQSIGTFRHWICEAIDEHTEQKPIDKQACVRLVYAKNYHLDLPIYYIIKGQPTPYLAHKVKGWIESDPREFTKWFNGKADKDGQLKRIVRYLKAWSDYRKGIVPSGLVFSILAANNIVFNERDDVALNRTLIRIQNRLKERLVCLRPTTPAGENLLKYYSEAGKHYFLSQLDSFIQSAEKALDDRTNQKDACRAWRSHFGKDRF

SEQ ID NO: 2979 - protein, 324 aa, Phormidesmis priestleyi
MADCHASFLSFNTVIALDSTRKGQLRKSRNAVRERIRRFFREKKNGFFPKFHGQGSFMMNTIIYPLDGEFDVDDGIYFLVDRKPTYSVSTFHDWIYTAVDGHTQQKPVDKQTCVRLVYAGQYHLDLPIYYVIEGQCPRLAHKSKGWIDSDPRDFIKWFNEQTDEDGQLKRIVRHLKAWSDYRSGELPSGLIFTILAANNISFHDRDDVAFYQTLVNIKNSLDKNFVCYRPTTPTDEDLLVNYSKTNKDYFLGQLDSFIASAEKALSDKTNQKDACKAWQRHFGDRFPCDLSQFTSDSLLEPAFAAAALTFPNRPVVPKKPGGFA

SEQ ID NO: 2980 - protein, 324 aa, Gloeocapsa sp.
MADCHKLFLEFNSIIELKPNHKAFLRTSRDAVRDRIRSYFKEKANGFFPKFHGQGSFMMNIIILPSDGEFDIDDGIYFLVDKEPIYSVDTFHRWICEAVDGHTKQEPIDKQTCIRVVYAGQYHLDLPIYYIIKGQYPRLAHKSKGWIESDPREFIKWFQDKTDDKRQLRRVVRYLKAWSDYKAGSLPSGLILSILATRNIHFNARDDIALYNTLIGIKNSLALSFTCYRPTTPTYEDLLQNYSQTDKNYFKSQLISLIRSAEKALDDKTSLKNACKEWQKHFGDRFPCHLAEDNADELLSAAFTAQNLTFPNRPLIPKKPGGFA

SEQ ID NO: 2981 - protein, 324 aa, Gloeocapsa sp.; identical to SEQ ID NO: 2980

SEQ ID NO: 2982 - protein, 332 aa, Aequorivita sp.
MANNHDQFIEFNEAIYLHSGKKSELQKNRDALREKITKFFNEEKQNETKPKYSAQGSFMMNTVVNPITSTETDDDGNTKTLHPYDLDDGVYFIDDLENRQSVSTYHTWIYNAVKNHTSKGAIKKNSCVRVLYSDGHNIDLPIYFKEKETDGEKTIPQLAHKSEGFIDSDPRAFYKWFNNKANDQLKRIVRYLKAWRDKQNKSYSTKMPNGLILTILATNHFVSNNRDDISFLDTLNAIKKELDDDFACERPTIKKGEDLLQKYNEQHFMDRLSKLINSGESAIAHSNPKEGCKKWQKHLGDRFPCSNVEDNSTDDTKSYSRPAVVNVNAASA

SEQ ID NO: 2983 - protein, 330 aa, Chryseobacterium taklimakanense
MANNHEQFIAFNDAIKLNDTKKEELRENRDALRKKIEKYFNDNLPNETKPGFHAQGSFMMFTTVNPIPIITENEDGDTITLRPYDLDDGIYFIDKLENKKESKIYRNWIYDAVKCHTSKGAEKKASCIRVNYADGHNIDLPIYFEEKDKKDVIPELAQKSGYIESDPIEFLTWFNDLADEQLRRIVRYFKAWRDKQMQDSDITLPPGIILTILVSNNYVKNDRDDISLQETLQKIKNELDINYVCYRPTTKKDEELLKDYDKTHFLDRLSKFIESANEAVNHSSQKEACKKWQKHLGERFSCSNIKEENESNEAKSFSSPAIINKNAESA

SEQ ID NO: 2984 - protein, 339 aa, Dysgonomonas sp.
MANNHEQFIAFDDTIALSQTKEDELKKNRKALREKIRKYFKDNKSDEIQPKFNSQGSFVMKTTVNPIPKWSDEDKKNLYKYDIDDGIYFMGNEEPADRYEEQTYHNWIYDAVADHTSKGAQDRTTCVRVLYADGHHIDLPIYYKRKDIKNSIPELAHTSKEWLDSDPEEFYKWFNTKADSNKQLRRVVRYFKAWADYKNTMSSTKMPPGFILTILVTNNISYNGRDDIAMKETLINIQNKIDDSKGGIFKCYRPTTPSNEDLFAGYSDTRKNNFLNNLDSFVKSASQAIENTNQKEGCLKWQKHFGERFSCSTAKDKDEQSNLKTYSSPAIINQNAKSA

SEQ ID NO: 2985 - protein, 331 aa, Spirosoma sp.
MANCHQQFLDFNSTISLTGDRKKKLKKSRTKLRNRVRDDFKENHKDEIKPKFASQGSSEMKTSVNPIVRVIDEDGEEKSITKYDTDDGIYFIGNLDDRKSVQTYHNWVWDAVDGHTSIPPIDKNTCVRTLFSDGHHIDQPIYFIDEANNAHPKLAHKKRGWIESDPREFADWFNEKASKDEQLRRLVKYLKGWCDYQNYSDDSKKMPTGFVITIWTVNNFSADERDDLALRNTLENMYDTLTNEFECLRPTTPKDEDVVENYSYEDYYMTKLKAFLESAKQAINEKNPKNACYKWQKHLGSRFSCATAKDEDEGANSYAAPAIVTSNAKSA

SEQ ID NO: 2986 - protein, 334 aa, Hymenobacter mucosus
MANCDSIFKVFDEDIILHDTRRDSLKKSRKALRNRIKEYFKEEKPDEIKPKFYGQGSFMMGIAINPIPKVVTEDGKEVSKHKYDVDDGIYFIGKESERKAVQTYHNWIWDAVDGHTDTPPVDKNTCIRVIYHDGHNIDLPIYFLVKGDDDAVPQLAHKSKSWLDSDPREFVTWFTGIADAQKKDQLRSLVRYMKAWADYQNNSSGTSKMPPGMVMTIWAAENACYNERDDVALRDTLQAIRDTLTDAFECNRPTVPAGENLLDDYKYEEYFLGRLDAFLESAKQAVNETNQKTACGKWQTHLGPRFPCRLAEDKDMGARAYGTPAIIQENAKSA

SEQ ID NO: 2987 - protein, 331 aa, Aliifodinibius roseus
MANCTDLLHEFDSTIRLTKARKDSLKISRNDLRKKIRKYFSEERPDEITPKFAGQGSMETDTAVNPIPRKEEAGGEEQTLYKYDIDDGIYFIGDDFEEERKTIQTHHNWICEAIDGHTSQKPIDKNTCVRVVFADGHHIDLPIYYKKEDTPELAHKAKGWVYSDPKEFIEWFKAQIGKKQQLIRLIRYLKAWCDYREFSNSSIKMPSGFIMTILAVNNYYRHKRDDIALKETLVNIQAELSREFKCERPTTPAGEDLFEEYSHEGYFMNVLAHFIEQAQHALREGNQMEACKYWQKIFGNRFSCSNAQDEDEKKHTGALAIGAASSNPWAS

SEQ ID NO: 2988 - protein, 336 aa, Flavobacterium sp.
MADLHSTFTEFDDIIKLSSKKKETLRTSRNSIRTDIVKYFEEKREKHTVSFKGQGSFMMNTTIQPISKEYDVDDGVYIFGKKEDKPSVQMAHNWIYEAVKNRTSSESLDKNTCIRVIYKSDYHVDLPIYYKIEKSDNENTLDDETPEIAHLSKGWILSDPYAFKKWFDDQAKGKSQLKRIVRYLKAWSDKKQNDNSKLIFPSGMIFTILASNHYVENSRDDKSLLETLKKIQSNIDETKFNYVSYECYRPTVDKNENLLDKYSAETTKNNFLSALDSFIKSAEQAIELESKKDACAKWQKHLGDRFPCSLIKEEKSNSSARVYSSPDQVSFDNKSA

SEQ ID NO: 2989 - protein, 307 aa, Flavobacterium sp.
MADLHSTFTEFDDIIKLSSKKKETLRTSRNSIRTDIVKYFEEKREKHTVSFKGQGSFMMNTTIQPISKEYDVDDGVYIFGKKEDKPSVQMAHNWIYEAVKNRTSSESLDKNTCIRVIYKSDYHVDLPIYYKIEKSDNENTLDDETPEIAHLSKGWILSDPYAFKKWFDDQAKGKSQLKRIVRYLKAWSDKKQNDNSKLIFPSGMIFTILASNHYVENSRDDKSLLETLKKIQSNIDETKFNYVSYECYRPTVDKNENLLDKYSAETTKNNFLSALDSFIKSAEQAIELESKKDACAKWQKHLGDRFP

SEQ ID NO: 2990 - protein, 337 aa, Flavobacterium omnivorum
MADLHSTFTEFDDIIKLSSKKKETLRTSRNSIRTDIEKYFEEKREKHTVSFKGQGSFMMHTTIQPLSKEYDVDDGVYIFGKEEDRPTPQTAHNWIYDAVKNRTSSESLDKNTCIRVIYKSDYHVDLPIYYKVEKSDNENTLDDEVPEIAHLSKGWIQSDPYAFKKWFDDQSKGKSQLKRIVRYLKAWSDKKQNDNAKLIFPSGMIFTILASNYYVENDRDDLSLLETLKKIQSNIDDIRFEFINYECYRPTVDKNENLLDKYSSETTKNNFLNALDSFINSGDQAIELESKKDACSKWQKHLGDRFPCLSIKEEKSNSSARVFTTPDQVSFDNKSAK

SEQ ID NO: 2991 - protein, 336 aa, Flavobacterium ummariense
MADLHSTFTEFDGIIKLNSTKKSSLRTSRNSIREDIRKYFDEKREDHSVSFKGQGSFMMNTTIKPISNEFDLDDGVYIFGKEEDRPTPQTAHNWIYDAVKNRTSSESLDKNTCVRVIYKSDYHIDLPIYYKVDKSKDEYTLDDEVPELAHLSKGWIKSDPYAFKKWFDGEAKNKPQLKRIVRYLKSWSDKKQTDNSKLIFPSGMIFTILASNCFIEDERDDISLLETLKAIQEEIDDTRFDDAYYECYRPTVDETEDLLNKYAAKTTKENFLNALDSFIKSGNQAIELESKKDACAKWQKHLGDRFPCSTIKEESSDTSARVFSNPDQIGFDHKSA

SEQ ID NO: 2992 - protein, 336 aa, Parapedobacter koreensis
MADLHSTFLEFDDIIKLSSDKKKSLRTSRNSIREDIRDYFDENRDKHTVSFKGQGSFLMNTTIEPLSGEYDVDDGVYIFGKEEDKPTVQTAHNWIYNAVKDRTSSEPLDKNTCVRVIYKKDYHVDLPIYYKTDKSDDQFILDDEVPLLAHKSKGWVESDPYAFKKWFDDQAKSRPQLKRIVRYLKAWSNKKQEDNSLLRFPSGMVFTILASENYVSNGRDDKALLGTLKAIQQSIDDIKFLSANYSCYRPTVDMYENLLDKYSSQGTKSSFLNALDSFIKSGEQAVELESKKDACAKWQKHLGDRFPCSNVKDNNAESSAKVFASPDIIKRDNKSA

SEQ ID NO: 2993 - protein, 337 aa, Capnocytophaga canis
MADLHSTFLDFDDIIRLKQSKKESLRKSRNSIRDDIRDYFEKNRDKHSVNFKGQGSFMMNTTIQPLSNEYDLDDGVYIFGKEEDRPTPKTAHNWVYEAVKNRTSTEPIDKNTCVRVIYKEDYHIDLPIYYMLEKSDDEYSLDTEIPKLAHLSKGWIESDPYAFKKWFDEQAKGKPQLKRIVRYLKAWSDKKNNDNSSLRFPSGMIFTILASNNFVADERDDISLLETLKAIQKQIDDNRFSWSANYACYRPTPNKDENLLDKYSADSTKNTFLDALDSFIKSGEQAINLTDKKDACAKWQRHLGNRFPCNAIKEENHSSTAKTFSSPDQIKYDNKSA

SEQ ID NO: 2994 - protein, 335 aa, Chryseobacterium limigenitum
MADLHSTFTEFNDCIRLNSTKKNQLKTSRSSVRTDIRTYFSNNRDKHTVSFKGQGSYMMNTTIEPLSKEFDIDDGVYIFGKEEDKPSVQTAHNWIYDAVKNRTSSEPLDKNTCVRVIYKNDYHVDLPIYYVFDRSEDQYTFLDEPPLLAHKSKGWIESDPYKFKLWFDEQAKDRPQLKRIVRYLKAWSNKKQQDNNSLKFPSGMIFTILASENYHSDERDDISLLETLKAIQKKIDNNKFFTNYSCYRPTTDTSENLLEKYSASTTKSNFLDALDSFIKSGDQAIELESKKDACAKWQKHLGDRFPCSNITDDESKSSAKQFSQVESILIDNRSA

SEQ ID NO: 2995 - protein, 333 aa, Flavobacterium hercynium
MADLHETFTEFNGIIALSSAKKNELRTSRNAIRKDIKSYFELKRKEHTVKFKGQGSFSMNTTILPLSGEYDVDDGVYIFGTEEDKPTPETAHSWIVKAVENRTDQNTIDKNTCVRVQYAKKYHVDLPIYYKITNNENEDFYDNDDIPELAHKSKGWIQSDPYAFKKWFDDKSKDKSQLKRIVRYLKAWTDNKSRLKLPSGMIFTILAVNNYQPNDKDDVAFLDTLEKIQKSIDDTRFTWTGVYECKRPTVDDTENLLEKYSSETSKKNFLDALNSLIDSGRQAINLKSKKDACAKWQKHLGDRFPCSNIKENDEDLAKTFSSSDQLRYDNKSA

SEQ ID NO: 2996 - protein, 332 aa, Confluentibacter lentus
MADLHETFTEFNRIIALSSTKKNELRTSRNSIRKDIETYFDKNRDKHTVKFKGQGSFAMNTTILPISGEYDVDDGVYIFGKEEDKPTPNTAHNWIFKAVENRTNQETIDKNTCVRVQYAKSYHVDLPIYYKTTDTDNENFFDSEDIPELAHKTKGWIESDPYAFKKWFDEKAKDKNQLKRIVRYLKAWTDNKSHLNLPSGMVFTILAVNNYVSKDRDDESFLETLQGIQKSIDDTRHIWAKYECYRPTVDTLENLLDKYSSETRKKDFLDALNSLITSGKQAVEVKSKKDACAKWQKHIGDRFPCSSINEKDEDVAKAFASPDQLRYDNKSA

SEQ ID NO: 2997 - protein, 335 aa, Unknown
  Description of Unknown: unidentified eubacterium sequence
MAVLNKEYNKFDKEIKLNQARKDSLTTSRKELRKKIKKWFKENKQDEIQPKFHSQGSYEMNTTINPIVEYDSDGNALRKYDLDDGVYFIYSKEGDTKQSINTWHEWVFKATENHTGKNSIKKTTCVRVVFSDGHHVDLPIYYKEDGTIELAHKSKDWLLSDPKKFYEWFNKEKKSRSRLEAIVRCLKAWKNFRELKNSNLKLPSGFELTILATNNYCDADNLDEAFRKTIIAIDKELNKYGGFICLRPTTPENEDIFEGYSETRKNDFLSTFKNLKDDCIKASEEKNFKKASEILIDKQFGSRFPKGEDKDEQSKSNALKESLALATIKPKPYAS

SEQ ID NO: 2998 - protein, 291 aa, Olleya sp.
MAVLNKEYNKFDKEIKLNENRKESLKTSRRELRKKIKKWFKDNKPNQIQPKFGSQGSFEMNTTINPIVEYDSDGNLLRKYDLDDGVYFIYKSEDDTKQSINTWHDWIFKATENHTGKDSIKKTTCVRVVFADGHHIDIPIYYKEDNTIELAHKSKGWLESDPKEFYEWFNEKKKTRSRLEAIVRCLKAWRNFRENKNTNLKLPSGFELTILATNNYVDADNLDEAFRETVKVIDMELNRYNGFKCVRPTTPSGENVFEDYSDTRKTNFLSALKSLKEDCIKASEEKNFKKA

SEQ ID NO: 2999 - protein, 335 aa, Olleya sp.
MAVLNKEYNKFDKEIKLNENRKESLKTSRRELRKKIKKWFKDNKPNQIQPKFGSQGSFEMNTTINPIVEYDSDGNLLRKYDLDDGVYFIYKSEDDTKQSINTWHDWIFKATENHTGKDSIKKTTCVRVVFADGHHIDIPIYYKEDNTIELAHKSKGWLESDPKEFYEWFNEKKKTRSRLEAIVRCLKAWRNFRENKNTNLKLPSGFELTILATNNYVDADNLDEAFRETVKVIDMELNRYNGFKCVRPTTPSGENVFEDYSDTRKTNFLSALKSLKEDCIKASEEKNFKKASEILIDNQFGARFPKGEDKDEQSKSSTLKKSLSSAIITPKPYGY

SEQ ID NO: 3000 - protein, 335 aa, Flavobacterium sp.
MAVLNKEYNKFDKEIKLNNSRKDSLKTSRKELRKKIRNWFKENKPDEIKPKFNSQGSFEMNTTINPIVEYEDDGSALRKYDLDDGVYFIYNDEDDVKQTIDTWHNWVFRATENHTGKDSMRKTTCVRVIFADGHHIDLPIYYKEGDNFELAHKSKGWIDSDPKEFYEWFNEKKKIRSRLEAIVRCLKAWKNYREINNSSLKLPSGFELSILATDNYVDSDNLDEAFRETVKSIDETLNKENGFKCYRPTTPSGEDVFENYSETRKNNFLSTLRSLKDDCIKASEESNFKKASEILIDKQFGSRFPKGEDEDQQVKNDALKTSLASALVTPKPYGH

SEQ ID NO: 3001 - protein, 335 aa, Nonlabens ulvanivorans
MAVLNKEYNKFDKEIKLNDSRKESLKKSRKDLCKKIKKWFKNNKPDEIQPKFHPQGSSEMGTTVNPLVTYDEEGKSLLDYDTDYGVYFIKKNDDDVKQSINTWHDWVYNATENHTGKDSIRKTTCVRVVYADGHHIDLPIYYKEDGFIELAHKSKGWLESDPKEFYEWFNDKKKTRSRLEAIVRCLKAWKNFRETNNTNLNLPSGFELTILATNNYVEADNLDEAFRETVKAIDAELNRYNGFKCYRPTTPSNEDVFENYSETRKSNFLNTLRSLKNDCIKASEESNFKTASEILRNNQFGTRFPLGEDKDEESKSNSLKKSLGAAMVKPKPYGY

SEQ ID NO: 3002 - protein, 335 aa, Leeuwenhoekiella marinoflava
MAVLNKEFNKFDQEIKLSKSRKEDLKKSRKDLKKKIKKWFSENKSDEIQPKFHPQGSSEMGTTINPIVAYDGDGKPLLDYDTDYGVYFIKKNDDDIKQSINTWHDWVYKSTENHTQKDSIKKTTCVRVVFADGHHIDLPIYFKEDDTIELAHKSKDWLESDPKEFYEWFNDKKKTRSRLEAIVRCLKAWKNFRENKNSNLKLPSGFELTILATNHYVDADNLDEAFRETIRAIDAELNKHNGFKCFRPTTPSDEDVFESYNETRKSNFLSTLNSLKEDCDKASEEKNFKAASEILRNNQFGVRFPLGDDKGEESKSNHLKSSLGSAIIKPKPYGY

SEQ ID NO: 3003 - protein, 335 aa, Sinomicrobium oceani
MAVLNKEYINFDKEIKLNNSRKESLARSRKDIKKKIRKWFKENKPDEIQPKFHGQGSYEMNTTINPIVVYDEDGNPIRKYDLDYGVYFIEKEGEDNKQSIQRWHNWVYASVEDHTSKKPIQKTTCVRVVFSDGRHIDLPIYYKKEEIIELAHKAKDWIESDPKEFYEWFNDEKTQKYRLEAIVRCLKAWKNFRELNNSNLKLPSGFELTILATENYYDADNLDEAFRETVRKIYDTLSEDWGFKCIRPTTPKGEDVFEGYSETRRNNFLTVLKSLLDDCDKAKEEYNFKTASEILRKNQFGSRFPLGEDKEEENKSKSLTRSLSTAFIKPKPYGY

SEQ ID NO: 3004 - protein, 332 aa, Labilibacter aurantiacus
MTVLHKEFTKYNKEIKLTSSRKESLKKSREDIKKKIRKWFKENKPDELQPKFHGQGSFEMNTGVNPIPEKDNNNTLLKYDLDFGVYFIENDDEDNKQTIETWHNWVYKSVEDHTAQKPIKKTTCIRVIYSDGHHLDLPIYYKLNEVIELAHKAKSWIESDPKEFYEWFNDLKNGQLERLVRYLKSWKNFRELKNTNLKLPSGFELTILAANNYVEDDSDDKALRETIRNIDIELNKANGFKCLRPTTPKNEDVFSSYSTTRKDNFLSTLKSLLNDLDRAKDEKNFKKASEILRNNQFGERFPLGADKDEEEKSNNLGKSLGAAAITPKPYGY

SEQ ID NO: 3005 - protein, 332 aa, Zobellia uliginosa
MAVLHKEFTKFNKEIKLTSSRKEKLKTSRKDIKKKIRKWFKDNKPNELQPKFHGQGSFEMNTGVNPIPEKEGETTLLKYDLDFGIYFIEKEDQDNKQSIDTWHNWIYKAVEDHTNKKPVRKTTCIRVIFSDGHHIDLPIYYKLEDVIELAHRSKDWIESDPKEFYEWFNNLKNAQFERIVRYLKAWKNYRELNNTNLKLPSGFELTILAANNYVEDDNDDKAFRETVHKINTELNKANGFKCLRPTTPKDEDVFADYSTTRKNNFLSTLKSLLNDLGRAKDEKNFKKASEILRDNQFGDRFPLGADKDEEEKSNILGKSLGAAAITPKPYGY

SEQ ID NO: 3006 - protein, 334 aa, Brumimicrobium sp.
MSVLHKEFIGFNKEIKLDPKKKEGLLTSRKDLRKKIKKWFSENKSNELQPKFASQGSIEMDTAINPIPVYDEELDRRLFKYDLDDGIYFIEKEDEDNRKPIQTWHNWVFDSVDNHTKQDTIRKQTCIRVVFADGHHIDLPIYYKKDDIIELAHRTKDWTVSDAKAFFEWFNELKSPQLVRIVRYLKAWKDYRELKNSSLKLPSGFELTILAVNNYTEDDNDDFSFRETVRKIDKELNKVNGFKCIRPTTPKDEDVFADYSETRKNDFLKSLGNLLRDLDKAEAETNFKKASEVLIKNQFGDRFPLGEDKDQDVKSENLGRAISTAPIIPRPYGY

SEQ ID NO: 3007 - protein, 338 aa, Kordia algicida
MATLHKEYNAFLKKVRLTNNRKKKLKKSRRKLRRTIRDWFSENKPKRLQPKFGSQGSFTMNTIINPIPIPVENEDKKLVKYDLDDGIYFIEKPNEDNREKIDTWHDWVYKAVNNHTTEETIRKKTCVRVVFVDGHHIDLPIYYQISENGTPELAHRSKSWIESDPKKFTEWYNEQAEGKPQITRIVQYIKAWKNFREQKNTNLKLPSGFAFTILVVNNYYADNKDDVAFRETVRAIHTKLSNNFECRRPTTPKNEDIFSDFSETKKSNTLETLKNLLKDCDRADEEDNFKTASEFLRDNQFGGRFPKGDDISEREKKRQISESLEKERIKPKPYADER

SEQ ID NO: 3008 - protein, 338 aa, Kordia algicida; identical to SEQ ID NO: 3007

SEQ ID NO: 3009 - protein, 333 aa, Tenacibaculum agarivorans
MATLHKEYNKFYTIIKLTQNRKDDLLGSRKSLRKKIEDWFAQHKPDRLQPTFKGQGSFEMDTTVNPIVVEDQDGKKLRKYDLDDGVYFNEKDREDNKEHISTWHNWVYEAVKDHTETDPIRKNTCVRVIFADGHHIDLPIHYKKGTTPELAHRSEGWKESDPPEFTQWFLKKSNPQIKRLVRYIKAWKDFRHDKNSHLKLPSGFALTILIVNNYVKDNNDDTAFRETVRKMLDTLTVPDSFACIRPTTPKGEDVFADYSPTRKKDFLTTLQSLVTDCDRAKEESNFKKASEYLRNNQFGDRFPKGSNTDEKTQKKAMASTLNSSYIKPKPYAN

SEQ ID NO: 3010 - protein, 328 aa, Clostridium beijerinckii
MANLNELFLKYNTNISLSNIERERIIKGRDALRNKITSKFKEKGKSIPKFCMQGSFIMKTTVIPKEGEEYDLDNGIYIQGYSDDISKWPTTQTIHNWIYDGVDGHTDTPPVDKNTCIRVIYKADYHIDLPSYIVRDEEQEDKTIIKVAYLAHKTKGWIVSDPRSFTNWFREKVNDNGEQLRRLVKYLKGWKENKGIDLKGIAITILVGNHFQGEKERDDIALLSTITNIIDELEDNFQCYKPVIPTDEDLFSGASETTKTSIMNGLNTLKKKLDKAINEINNEKEAAAELRKILGDSFPEGEDIIRENMAYASTTAPILLSKENHHFA

SEQ ID NO: 3011 - protein, 282 aa, Selenomonas ruminantium
MADMDREFRSYYQRIKLSSANEDRLRRGRDALRNRIRSWFINTGKPVPKFCWQGSFAMKTTINLWGQGQQYDIDDGIYLSYRKKDLTASRVHGWIIEAVADHTESIINKDTCIRVNYSAGYHIDLPIYVMDGDNAYLAHKTKGWVLSDPKAFRDWFIKKVKNNSEQLRRIVLYLKGWKTNCSIPLKGIEITILVSNCYQRNQKDDEALYDTVSKIIETLNMHFSCVKPVQPYEDLFGCISENRKNRILDGLYGLQSSLLLVQITSSNIEAINSLKTKFGNIF

SEQ ID NO: 3012 - protein, 282 aa, Selenomonas ruminantium; identical to SEQ ID NO: 3011

SEQ ID NO: 3013 - protein, 318 aa, Clostridiales bacterium
MANMNQLFSDFDGKIKLTNAKTNSLKTSRDALRKDIRDWFFEKNKDIPTFCWQGSFAMKTTVNPLSGGEYDLDDGVYLEGYSDIDKESWPTTSTVHGWIKSSVEDRTSDLPIDKDTCIRVTYTSGYHIDLPIYIIKNDIAYLAHKTKGWIESDPKAFKKWFVDHVSDKGEQLRRIVRYLKSWKDYKNVSLKGIEITILVTNHFDKYDNRDDKSLKNTISSIISSLEESFSCYKPVIPNEDLFEGFSDTKKTSINDSLKNALNKLEKAINEPNEKKASEYLQSIFGERFPTGNDSITSNSSYEITNAPGVLKNDGRSGK

SEQ ID NO: 3014 - protein, 316 aa, Clostridium sp.
MANLNKLFSDFEEEISLKSKKKENLKKGRNALREKIRNSFKEKERSTPKFCGQGSYMMKTTVNPIDGEYDIDDGVYLQGYSDKDIEEWPTTSTVHRWIKDAVDGHTSTPPKDKNTCVRVIYVDDYHVDLPSYIVKDDVCYLAHKRDGWTESDPRAFTKWFVDKVQENGEQVRSLVKYLKAWKDYNNVDLKGIAVTILVCENYYSYENRDDLALLGTVTEIINSLENEFTCKKPVIPYEDLFEEIDEVNQNKLLESLKSLKTEIQNAVDKEDEAEASDIMIKVFGDRFPKGSSTKKAESNYAKSEAPSIIKNDGRSA

SEQ ID NO: 3015 - protein, 317 aa, Clostridioides difficile
MADLNNLFLGFNDKITLSPSKKENLRIGRDALRKKIKDKFSEKGRNKPKFCGQGSYMMKTTTNPIDGEYDLDDGVYLQGYSDKEIDEWPLTSTVHNWIKDAVDGHTSTSPMDKNTCVRVIYVNDYHIDLPAYIVKDDVAYLSHKRDGWIVSDPKSFTDWFVGKVTDKGEQLRRLVKYLKAWKEYKGIDLKGIAVTILVGENYYSYDNRDDLSLLGTLTNIIETLEEDFKCVKPVAPNEDIFDGYSETKKNSILSGLKNLRDSVQDSINKEDEKEASDIMIECFGNRFPQGKSSSKENKSQYVRAESPAIIKNDGRSA

SEQ ID NO: 3016 - protein, 321 aa, Paeniclostridium sordellii
MSDLNNKFSDFNEKITLTKSKKENLKTGRDALRDKVKASFKDEGRNQPKFCGQGSYMMKTTTNPINGGEYDIDDGVYLQGYSDKEQSDWPSTYTAHNWIKKAIEDHTSKTPIDKNTCVRVVYAGDYHIDLPAYIEKDGVVYLAHNGKDWTESDPKSFTDWFIGKVKSEGEQLRSIVKYLKAWKDHKGIDFKGIAITILVGENYSPYENRDDLALLATVTNILSELEDDFKCTKPVAPGEDIFEGYSQTRKDSIINGLKTLKSKLQKAVDEKNEKEACNIMRGEFGDRFPKGEDTEEKNMNESSTYARAEAPAIIKNDGRSA

SEQ ID NO: 3017 - protein, 315 aa, Cryptobacterium curtum
MASTRRLFREFDNAIKLTTSKRDELTTSRDAIRSDIRQWLKDKDKGQARFKLQGSFAMHTVINPIDDDEFDIDDGLYLEEFEDANKEDWPACSTVHSWVVSAVQGRTKTPPKDKNACVRVTYGHGYHVDIPIYIKLDGAAYFADKARGWTQSDAEGFVEWLDGKNDAEGQLKRIIRYIKRWKDYCNVPLKGIELTILCAQNFSPANGRDDDAVRYTMENVLTSLKACFECKKPVAAWEDLFEGKSDADKSSILAKLEKLLDALISASSTPSEGDAADFLRGVFGSDFPKPDRPKNTLAYVTTSAPAVLKHDGRSG

SEQ ID NO: 3018 - protein, 322 aa, Unknown
  Description of Unknown: Trichococcus sequence
MNDLSNLFSAFNKKIVLTDTYKENIRRGREALREKINASYIDNGLSAPKHSSQGSFHMHTAIMPKEEEDFDLDNGVYLQGYATDQTNWPAPRSVHDDILSAVKGHTKDISDKDTCIRVNYQDNYHIDLPIYIMGKDDTGNDVAYLAHTTKDWQISDPKALSDWFTEKVKEHGKVLRRTVRYLKAWTHHNSINLKGITITILASECFYSDDNDSLILLGTITNIIDRLEDDFTCYKPVRPKNEDLLSSYTYNEQQTLLEDLKTLKNKFNDAIYDSPNEREASEVLRELFGSRFPLGNRENKNGEDYLKTNQPESVGGKNRHYA

SEQ ID NO: 3019 - protein, 324 aa, Listeria monocytogenes
MNDLSNLFREFNDKISLNPSYKEKIRRARDAIRNKINNKFEKENLKKPKHHTQGSYTMHTAIMPLENEDFDLDNGIYLQDYGEDKEEWPSVQEVHKLIVEAIDGHTKDIIDKNTCVRVVYQDNYHIDLPIYIMGEDDENNEVAFLAHKIDGWIISDPKAFRNWFNDAVKNSEDQTLRRIVKYFKHWIHQNKIDLPGITITILASKHFLIKDDDAQTLLEVTTSILDELEENFTCFKPVRPTDEDLLSKIGFNQRVSILNSLRELKDKLSEALFDSENQKDSSIILRGLFGVNCFPLGNENKKNSEDYLETASPEKVIGKNRHYA

SEQ ID NO: 3020 - protein, 324 aa, Listeria monocytogenes
MNDLSNLFREFNDKISLTPGYKEKIRRARDAIRNKINNKFEKENLKKPKYHTQGSYTMHTAIMPLENEDFDLDNGIYLQDYGEDKEEWPSVQEVHKLIVEAIDGHTKDIIDKNTCVRVVYQDNYHIDLPIYIMGEDDENNEVAFLAHKIDGWIISDPKAFRNWFNDAVKNSEDQTLRRIVKYFKHWIHQNKIDLPGITITILASKHFLIKDDDAQTLLEVTTSILDELEENFTCFKPVRPTDEDLLSKIGFNQRVSILNSLRELKDKLSEALFDSENQKDSSIILRGLFGVNCFPLGNENQKNSEDYLETASPEKVIGKNRHYA

SEQ ID NO: 3021 - protein, 312 aa, Spirochaetae bacterium
MVDFQAEFKTFDEKIKLTESKKASMRISRNAIKKKIINYFKNDLEITAPIFTTQGSFVINTALNPIEDEEVDMDYGVYLQDQSENEEDWITPRKAHKRIIDALEGHTQDECISKTSCVRVLYRNFYHLDLPVYIMKNNKAFLAQTECNEWINSDSKEFRNWFYENRNDVKLSKMVRFIKAWRDFTKTEMTSIEITILTVNCFKNEREREDLVLYDTVANIYDEILISRKVEKPVSPFEDLWENYSEDKKDEIIEMVKQFRDDLNIALSNTSNHRGSVILREVFGERFPLKKDEENAERYRQQLRSGVKPWGV

SEQ ID NO: 3022 - protein, 163 aa, Treponema phagedenis
MTNLHQAFIDFDSKIKLTKKKKEELLHRRDVVRDKIRKYFKDELKLNQPKFMSQGSFTINTALNPIGDNEVDIDDGIYLQHLLENETTWPTPKEAHKLITDALEAHTKDGCKDKTSCVRLIYAGDFHIDFPIYVMKKNHAKLADIELNKWIASDSKEFKDWFL

SEQ ID NO: 3023 - protein, 322 aa, Firmicutes bacterium
MLDLNKLFLGFYDEISLTKTYKEKITKGRDALRNKIGDKFEEKGRKKPQHCTQGSYAMKTAIMPLDNDEFDLDNGVYLRGYSTDQDDWPATQTVHTWVKEAVEKHTSNSPIDKNTCIRVVYEDKYHIDLPMYIMGENSAGDSIAYLAHKSKGWIESDPKAFTAWFQGYVNENGQEIRRMVKYLKAWKDYKNIDIKGMAITILVCNNFCVTEKRDDLSLLDTVTNIIDSLEDSFHCYKPVTPTDEDLFADVSETSKNEILKGLNNLKKKLDAAINENNNEKDATDILQKVFGERFPTGEDADKDIAESTAGPIKLGNEDKHFA

SEQ ID NO: 3024 - protein, 322 aa, Firmicutes bacterium; identical to SEQ ID NO: 3023

SEQ ID NO: 3025 - protein, 322 aa, Lachnospiraceae bacterium
MGSLSKLFLDFHDENSLTKTYKEKITKGRDALRNKIGNKFEEKGRKKPQHCTQGSYAMKTAIMPLDGDEFDLDNGVYLRGYSTDQDDWPAAQTVHTWVKEAVEKHTSNSPIDKNTCIRVVYEDKYHIDLPIYIMGENSAGDSIAYLAHKSKGWIESDPKAFTAWFQGYVNENGQEIRRMVKYLKAWKDYKNIDIKGMAITILVCNNFSVTEKRDDLSLLDTVTNIIDSLEDSFHCYKPVTPTDEDLFADVSETSKNEILKGLNNLKKKLDAAINEKSNEKDATDILQKVFGERFPTGEDADKDIAESTAGPIKLGNEDKHFA

SEQ ID NO: 3026 - protein, 322 aa, Anaerostipes hadrus
MLDLNKLFEDFHDEISLTKTYKDKITTGRDALRTKIGNKFEEKGRKKPQHCTQGSYAMRTAIMPIEDDEFDLDNGVYLKGYSIEQDEWPSTQTVHIWVKDAVDGHTSNSPIDKNTCVRVVYEDKYHIDLPIYIMGENSDGNSIAYLAHKSKGWIESDPKAFTSWFQEFVNDNGQQIRCMVKYLKAWKDYKNIDIKGMAITILVCNNFSVTANRDDLSLLDTVTNILDSLEDSFHCYKPVTPTDEDLFADISETSKNSILNGLNNLKRKLDVAINEKNNEQEATDILRKVFGDRFPDGEDVNKDISEKTVAPIKLGNEDCHFA

SEQ ID NO: 3027 - protein, 322 aa, Bacteroides pectinophilus
MLNLNDLFLEFNDNLTLKKKYKDKVTTGRNALRNKIGSKFEENDRKKPKYYMQGSYAMHTAINPEEDEEFDLDDGVYLQGYSDDKDTWPATTTVHDWVKKAVDKHTSNDPIDKNTCVRVVYEEKYHIDLPIYIMGENDAENECAYLAHKSKGWIESDPKAFKEWFQNCVNENGQVIRHMVKFLKAWKVKKGVDIPGMAITILVCNNYSLTDNREDVSLIDTVTNILDCLDTKFECYKPVTPTDEDLFAGYSATKKENVINSLKTLKSSLNKAIYEEKNEKKATDLLQKEFGDRFPEGEDKDKSIYDRTSAPIQLGGEDSHFA

SEQ ID NO: 3028 - protein, 322 aa, Bacteroides pectinophilus; identical to SEQ ID NO: 3027

SEQ ID NO: 3029 - protein, 183 aa, Paenibacillus sp.
MEELGLAEPKFYGQGFYMMNTTVTPIDGEYEIDDGIYLEHLKDTDEKDWATPVTVHNWIVKAMKEHTTTDPVDKNTCVRVIYKANYHVDLPIYVKKTDAHPKLAHKTKGWIDSYPKELTKWFNDEVKEKGNQLKRLVRFLKAWKDNKEGVVKLPSGMFLTILAANHFVAYYPDEDDAALAFDR

SEQ ID NO: 3030 - protein, 223 aa, Paenibacillus sp.
MSNCHDLFINFHKEIYLDSTQKESLRTSRNEIRKKIKKYFMEELGLAEPKFYGQGFYMMNTTVTPIDGEYEIDDGIYLEHLKDTDEKDWATPVTVHNWIVKAMKEHTTTDPVDKNTCVRVIYKANYHVDLPIYVKKTDAHPKLAHKTKGWIDSYPKELTKWFNDEVKEKGNQLKRLVRFLKAWKDNKEGVVKLPSGMFLTILAANHFVAYYPDEDDAALAFDR

SEQ ID NO: 3031 - protein, 264 aa, Paenibacillus senegalensis
MSNCHDLFIKFHDDEIYLKSDKKESLRTSRNALRDKIKKYFSEELDVKKPKFYGQGSYMMNTTVTPIDGEYDIDDGIYLEHLKNSDEGDWPTPSTVHSWIVKATKNHTSEEPVDKNTCVRVIYKANYHVDLPIYIKKDDQSPKLAHKSKGWITSDPKALTDWFKGEVQIKGDQLKRLVRYLKAWKDYKESDTKFPSGMILTILAANHFVSDYPDEDDAALVATAKEIHNTLSESFSLVRPVVPGEELFDNWSETRRSNFLNKLE

SEQ ID NO: 3032 - protein, 326 aa, Paenibacillus barengoltzii
MSNCHDLFIKFHDDEIYLKSDNKESLRKSRNALRDKIKKYFSEELDVKKPKFYGQGSYMMNTTVTPIDGEYDIDDGIYLEHLKDSDEGDWPTPSTVHSWIVKATKGHTSEDPVDKNTCVRVIYKANYHVDLPIYIKKDDQSPKLAHKSKGWITSDPKALTDWFKGEVQIKGDQLKRLVRYLKAWKDYKESDTKFPSGMILTILAANHFVSDYPDEDDAALVATAKEIHNTLSESFSLVRPVVPGEELFDNWSETRRSNFLNKLEDLIKKGGEALENQDKTEASKKWRKIFGSRFPEYQPPEDENKGSNSAIQTTSAAVLGNHGRSA

SEQ ID NO: 3033 - protein, 323 aa, Paenibacillus odorifer
MSNCNDLFASFHDEIYLHSEKKESLRTSRNSIRKKIKKYFKETLGLTEPKFYGQGSYMMNTMVNPIEGEYDIDDGIYIEHLKKEDEENWDTPIKVHNWIVKAVTGHTSTAPIDKNTCVRVIYKNEYHVDLPIYVKKEGEHPKLAHKSKGWVDSDPKELTKWFNDQVKEKGDQLKRIVRYLKAWKDHKEGDIKLPSGMVLTILAANHFVTDYPDEDDAALTATVKAIYDELSVSFSLTRPVFPDEELLDWSDSKQENLLTKLDNLIKKAEKALEEQDKTKASKKWIDVFGDRFPEHPPEDSQSESNSVLKSAAPAVLGNHGRSA

SEQ ID NO: 3034 - protein, 323 aa, Paenibacillus odorifer
MSNCNDLFASFHDEIYLHSEKKESLRTSRNSIRKKIKKYFKETLGLTEPKFYGQGSYMMNTMVNPIEGEYDIDDGIYIEHLKKEDEENWDAPIKVHNWIVKAVTGHTSTAPIDKNTCVRVIYKNEYHVDLPIYVKKEGEHPKLAHKSKGWVDSDPKELTKWFNDQVKEKGDQLKRIVRYLKAWKDYKEGDIKLPSGMVLTILAANHFVTDYPDEDDAALTATVKAIYDELSVSFSLTRPVFPDEELLDWSDSKQENLLTKLDNLIKKAEKALEEQDKTKASKKWIDVFGDRFPEHPPEDSQSETNSVLKSAAPAVLGNHGRSA

SEQ ID NO: 3035 - protein, 325 aa, Paenibacillus sp.
MANCNDLFTTFHEKIYLSSDKKESLRTSRNAIRTKIRKYFKDELGVSEPKFYGQGSYMMNTTIVPLDGEYDVDDGVYLEHLKETDEEDWATPSEVHNWIIKATEGHTDTDPLDKTTCVRIIYKAEYHVDLPIYVKKKDEHPKLAHKSKGWIDSDPKELTKWFNNEVKAKGSQLKRLVRYLKAWKDFNEGETKLPSGMFLSILAANHFVSDHPDDDDAALSATAKAIHEELTASFSLLRPVFPNEELMADWSVTRRDNFLNKLEKLIQKAGVALETQEKTTASEKWIEIFGDRFPEYESTEDSRSETNTVIKSSAPPVLGNHGRSA

SEQ ID NO: 3036 - protein, 327 aa, Lysinibacillus fusiformis
MANCNDLFLKFNDEIKLSAAKKKSLRTSRNAIGKDIQKYFDETLKVKKPKFWGQGSYMMNTIIKPIEGEYDIDSGVYLMHLSDTDEENWPATSTVHNWIKKAVENRTSTPPQDKNTCIRVIYKDDYHIDLPIYIKHKDMDHPKLAHKSKGWVDSDPKELTNWFSDEVQDKSDQLKRIVRYFKAWKDFKANGDIFPSGMIFTILAANNYVEGYEADDDSAFIAVAKEIYETLEESFTLERPVFPNEELLDDWSDSAKTKFLDKLSSLITNGQKALEEEDKEKASETWIKIFGDRFPKYTPPKQENKMDRGYALQTSEPPVLGNYGRSS

SEQ ID NO: 3037 - protein, 325 aa, Anoxybacillus sp.
MAQCNDLFLKFDEKIKLKPEKKESLRTSRNALREKIKGYFEETLKVSKPQFWGQGSYMMNTTIEPIEGEYDIDDGVYLMHLADKKEEDWPAASTVHNWTVKAVEGHTSTPPVNKNTCVRVIYKNNYHVDLPIYIKAEDAEHPKLAHKTKGWIDSDPKALTNWFNDEVKNKGAQLKRIVRYFKAWKDYKKGDDKFPSGMIFTILAANHFVEGYEEDDDSAFVATAQEVYDQLNSSFSLKRPVFPEEELLDGWSEAAKTKFLNKLSNLITQGQKALEKEDKKEAADIWWKIFGDRFPEYTLPEERVDKGYALQTSKPAVLGNHGRSS

SEQ ID NO: 3038 - protein, 325 aa, Bacillus sp.
MAQCNDLFILFDANIALKSEKKQSLRTSRNAIRKKIQDHFAQTLKASKPKFWGQGSYMMNTTIKPIEGEYDIDDGVYLAHLAGEKEENWPAVSTVHNWILKAVDGHTTTPPVDKNTCVRVIYKNDYHVDIPIYIKVDDAEHPKLAHKTKGWVDSDPKLLTNWFNCEVTEKGLQLKRIVRYFKAWKDSKKGSDKFPSGMIFTILAANHFVEGYEDDDDAAFVATAKAIYDALNSSFSLTRPVFPEEELFDGWSEGIQTTFLSKLSTLIINGQKALEKDDKKEVADIWRKLFGDRFPEYTSPEERVDKGHAFQTSSPAIIGNHGRSS

SEQ ID NO: 3039 - protein, 325 aa, Bacillus megaterium
MAQCNDLFLKLNDEIGLKSTKKSTLRTSRNTLRKKIQDHFEETLKVSKPKFWGQGSYMMNTTIVPIEGEFDIDDGVYLIHLSGKEEKDWPATSTVHNWILNAVDGHTSTSPIDKNTCVRVIYKDDYHIDFPIYIKGNDAAHPKLAHKTKGWIDSDPKALTNWFNSEVSDKGAQLKRLVRYFKKWKDYKKGSDKFPSGMIFTILAANHFLKGYEEDDDSAFIATAKEIYDSLNSSFTLTRPVFPEEELFDGWSETAKANFLSKLSTLVTNGQKALEKESKKEAADIWRNLFGESFPEYSSPEERVNKGYALQTSQPAVLGNYGRSS

SEQ ID NO: 3040 - protein, 326 aa, Anaerobacillus sp.
MAQCNHLFIEFNNKIKLKSEKKKSLRKSRNALRTKIQSYFDNTLEVSNPKFWGQGSYMMNTTIEPIEGEYDIDDGIYLVHLSSKKEEEWPATSTVHNWILKAVDGHTSTPPVNKNTCIRIIYKNDYHIDFPIYIKGDDADHPKLAHKTKGWIDSDPKALTNWFNDEVTVKGDQLKRIVRYLKAWKDFKKGDDKFPSGMVFTILAANYFIEGYEDDDDAAFVAIAKEIYNNLNSSFSLTRPVFPDEELLADWSETAKTNFLSKLSTLVTNGQKALEKDKQSDASDIWIKIFGERFPKPNPPEEERVNKGYAFQTSTPAVIGNHGRSS

SEQ ID NO: 3041 - protein, 327 aa, Bacillus sp.
MAQCNDLFLDFDKEIKLKPEKKKSLRTSRNALRTKIQNYFETNLKVSKPKFWGQGSYMMNTTIKPIEGEYDIDDGVYLIHLAGKNEGEWPLASTVHNWIVNAVEDHTSTPPINKNTCVRIVYKDDYHIDFPIYVKGDDAEHPKLAHKTNGWIDSDPKALTNWFHSEVTEKGSQLKRMVRYFKAWKDNKKGDNKFPSGMVFTILAANYFVEGYVDDDDSAFIALAKEIYDALSDSFSLKRPVFPDEELLDDWSETAKNNFLSKLSTLITNGQKALEKEEISDSVDIWRKVFGERFPEYTPPETENRVNKGDALQTSSPAILGNHGRSS

SEQ ID NO: 3042 - protein, 324 aa, Unknown
  Description of Unknown: Bacillus cereus group sequence
MAQCNDLFLGFNDEVKLSSDKKKVLRTSRNAIRDKIRNYFDDTLKVTEPQFWGQGSYMMNTTIAPIEGEYDLDDGAYLIHLAEKNEDEWPATSTVHSWVKKAVDGHTSTPPVNKNTCVRVIYKDDYHIDIPIYIKATDADHPKLAHLTKGWVDSDPKKLTNWFNNEVSEKSDQLKRLVRYFKAWKDYKKGTDKFPSGMIFTILAANHFVSGYTNDDDAAFIALAQEIYDELNSSFSLKRPVFPEEELLDDWSEYAQTNFLKKLSKLIEQGQKALEEDKVESSKIWRKFFGNRFPEYIATEERVNKGYALQTSQPAILGNYGRSS

SEQ ID NO: 3043 - protein, 318 aa, Candidatus Ratteibacteria
MANCHDLFQKFYDEVKLTPSKEDSLKTAREAIREKIRNYFKNTMKENHPKFYGQGSYAMSTIINPLDGEYDIDDGIYLQNLDLNKLKWPVPETVHNWIYNAVKGHTNENPIDKRTCVRVIYSGQYHVDLPIYGMFSNVPYLAEREEAGWHVSDPRAVTDWFKNEVKDKGEQLRKVVRYLKAWKDNKSKLRELPSGLVLTILAVNNYEKSDRDDGSFAGTVRNIYNQMLSSSTILNPVDSSEHLSDRITESQMENFKVKLSTLLSNASEALKEDSKEKACRKWKKEFGDRFPKCEDLKENGGPLRTSAPALLRDDSRSA

SEQ ID NO: 3044 - protein, 321 aa, Candidatus Atribacteria bacterium
MANCHDLFQKYHDVVKLNFSKKDSLKKGKNALRKKIKEYFSNNLKAESPKFWSQGSYALRTIVNPLDGEYDIDDGVYLQNIGAIKDKWPAPQTVHKWIYDAVKGHTKEDPIDKRTCVRVVYSGQYHVDLPIYGIYNEEHYLAEKGESGWHVSNPQTLHNWFMKQLKVNGEQLRTSVKYLKAWADYQAKTKSVTLPSGLILTVLVAENYTLRDRDDAAFGRTVKNIYQKVSSALVVYNPVDKSEILTERLTDKQKKDFIELLLGLLNSANEALGQQNKKEACKIWRKEFSDRFPCCDDIKESDDKVLHTRAPAILKDDARSA

SEQ ID NO: 3045 - protein, 328 aa, Desulfobacterales bacterium
MANCHQNFFTASDSFYLKISLDNSKSDSLRGSRDNLRKHIKKKFNEEGRPAIKFYMQGSFVMKTMITPLDGDYDIDDGLYFSPNLNPRPTTETIHQWVVKATQSYSTVDPPIDKKRCVRIPFKAGYHVDYPIYDLIKKDDTNDPEPYLAVKNDGWLFSDPVQISKWFEEQSSGNGGQLRRLVKYFKAWADYENQSTRSKMPSGLVLTILAAEGFKCNDKRDDSAFGNTASSIYERLIENEEIKNPRDSSEDLRERITDAQFANFLNRLNLLIQTAETALNHTSEKEAAKQWEKRLGDRFPIFEDPSNKATKFTSAKVGSAISVNTGSA

SEQ ID NO: 3046 - protein, 329 aa, Desulfocarbo indianensis
MADMAKEFSTFHGNIALSATKKASLRTSRDALRTRIRNYLKNDLELPVPKFRGQGSYSMDTTVNPLDGEYDIDDGVYLLHLDNEDDSEWPTPATVHGWLVKATDGHTNEKPMDKNTCVRVRYAGQYHVDLPSYGEFRGKYLLAEKGDKGWHESDPLAITDWFKDEVCKCGNDGQLRRLVRYLKAWADFQSSRRGKMPSGLILTVLAAENFGGHERDDVALAETASVISGKVQNAFIVYNPVDPSEKLTERLSPQQKERFQAAIADLASQAQKALDAEDAAEASDLWRGQFGDRFPKVDPKEKEGNAKRHTAAAAAAIGGRAPKPWSPKS

SEQ ID NO: 3047 - protein, 282 aa, Bacteroidetes bacterium
MAFAERLNLSPTKARQLNKARTVLQTKIKKYFSEKTNTTTPLFYIQGSVKHGTVIRKQDDTCDIDVGVYFKGKPRIKPATIQANIVKAIGNHTNEKASIRQKCVRVYYANLFHIDLPVYYIDIKTGTIYLGIGKEWHPSDPKQFTDWLKTEVIGTQQQRLVMYFKAWADVVKGRNQQKMPNGLSFTLWVNTFYCEDKRDDISFIKTAYKLLKYLKRTETDEWDCAMPVVPKDNVIQKLSWDQRKNFKYALDELIQSSVKIFESNSKEQCIEAWKWLLGKWFN

SEQ ID NO: 3048 - protein, 291 aa, Cytophagales bacterium
MKTNAKINTQPYFLQFCQNISLTLGRSKRLTTSKRNVEKKIKEHFTYHKLPRPDFFIQGSYKMKTMVIKSDGTYDVDLGVYFRRDNDLTPSTVQKHVYEAVNGITSIGAKRKNKCVRLIYKSYYNIDLPVYSTYDTEHPHLATKKGWEESDPKELCAWFDYKAKKHGSQLISLVKYFKAWANVTSGRMPSGIAFSVWVAENFIGHVRDDIAFYKTAVAIQNTFGRHPTCINPATPNDDFLEKLTPIQVVVFEDKFDKMISLAKTALEEKTEAKALATWKKIFGRNFYVNLF

SEQ ID NO: 3049 - protein, 262 aa, Cytophagales bacterium
MTTSKRNVEKKIKEHFTYHKLPRPDFFIQGSYKMKTMVIKSDGTYDVDLGVYFRRDNDLTPSTVQKHVYEAVNGITSIGAKRKNKCVRLIYKSYYNIDLPVYSTYDTEHPHLATKKGWEESDPKELCAWFDYKAKKHGSQLISLVKYFKAWANVTSGRMPSGIAFSVWVAENFIGHVRDDIAFYKTAVAIQNTFGRHPTCINPATPNDDFLEKLTPIQVVVFEDKFDKMISLAKTALEEKTEAKALATWKKIFGRNFYVNLF

SEQ ID NO: 3050 - protein, 444 aa, Alteromonas sp.
MDFSVAFFSSDGSRETLATRNTLLKEQTDGARREKDQLLQFLKSELHCQLGIKVGYWIQGSFKNHTVIRPVRVKEEFDIDVGIYLFADAESIGLDAKTAKSALRKVLASYCQRHEEAILEEPKSNCERVRFPERFHIDLPLYYVNETSEKYRLATESNGWIDSDPKSLQSWFDDRAGHLSDAEKARLRRVIKALKTWVCLKKVKLPSIAISCFVACNYKTYSSEEDALWSLADSITSHLIDGGVVLSPRNGDDLIGATETELKELKRECARFQQVLKALALSNSVVMSHQLWSIEFEHTLPPIDFVVEQPGNSNLPALTCPPVISVKVSNGTPEQVTTSVNAYRGDYVDFKVRNIGDYPESSQVIWMVRNTHTDASMKNDLGHKRELPISEIANEHCEYRGKHYMECTVINSGQILGVTSVTVNIRTLERPARNPVKKRYGPRR

SEQ ID NO: 3051 - protein, 344 aa, Halomonas sinaiensis
MGLSARLFFDNNEAETLFTRISLTPEQLEDARAKKDKLLELFKPELAASLEVTVKHWLQGSYKNHTLIRPMQKGDEFDIDVGVYVLCDAEDEGLSALEVKQLNRNILEWYVSNRPEAKVGESKTSCERLIYPSSFHIDIPIYYYDFETDTCKLAIESDEWVDSDPKVLQDWFNKKVSGLTPKSLAQLRRIIKYLKAWALIKGKEDGVKIPSIAITALVAEKYVEADDDDDAFIQTAVNVASYIISNDTLNNPCNGGDLFEFKGDEYEQIKSRVIALKNSCEFIDKSEDSLQQYVLWGATFEHMFPPFAERIDEVSKKTNLPAITVPPKINVRHLEKMESYFLVK

SEQ ID NO: 3052 - protein, 453 aa, Marinomonas sp.
MGLSAKLFFDNNENETLFTRVSLTPEQLEDARAKKDKLLELVKPELSLSLEVPVKHWLQGSYKNHTLIRPIKKGDEFDIDVGLYVLCNAEEDGLSALDVKQLNRSILEWYVSNRPEAKLGESKTSCERLIYPLSFHIDIPIYYYDAETGSCKLATQEDEWINSDPKALQDWFNKKVSSLTSKSLAQLRRMIKYLKVWTAIKGKDDGIRIPSIAITVLVADLYFEADDDDDAFIQTAVNVMNYIISNDTLDSPCNGGDLFGFKDNEYQQIKSRSEALKSSCEFINKSDDSLQQYVLWSATFEHMFPPFIERIDEVSKKTNLPAITVPPQIKVRHLDKNKKLLSSGVKDEIRVFRDEELYFSIDNKVDYSQTAEVHWIVRNQDEEAKRVNDLGHTSVLSISDERYEGCSYSGTHYMECLVLDKNNIKGMGAVKVRITGFSRPLRNPPRKKYFKGR

SEQ ID NO: 3053 - protein, 453 aa, Pseudomonas caspiana
MGGCSALFYDSDNQNTLFSRISLSDKQLKTAREGRDALLGFVKPKLSEVFDVEVKHWIQGSLKNHTLIRPTSKFEEFDIDVGLYLIGEGDESGIDAVDIKSDLHDAIVDYCQFDPSARVPEEVKERCERVVFSGDFHIDMPLYYFNFRNDTVVLATENGWEHSDPKGFQDWFDNSVGVSQRPVVRRIIKYLKAWASLKANSSRAKPLSSMALTILVVKFMDLIGSSDDESDFARAAQEIVNCILESESVINPLSGSDILSFSKADIDYWRPHLLELEEVSGSAMRVEDAFASFYLWERIFGHMLPPINEAAIAGGRAGLPAVSLPAHTEVRHYDSKGVLLSTEVTSSVICYKNESLSFRVFNFNEYHPESSITWIVRNQGGEAADSNDLGHNTPLDISEEISRGCAYTGIHYMDATVVYRGQVLGVGKVKVNIQPYNRPVKNPIRRRIYKGSR

SEQ ID NO: 3054 - protein, 444 aa, Vibrio anguillarum
MNCSQLFYSIDESIETLHQRTKLSDIVLSKGINKKDEVIEFLKAELSVAFECKVEFWLQGSYKSSTLIKPVDKYSSYDIDIGVYLLFDAEEEEIDAQDVKATLKDALESYCQINDEAKLQKSKNACEGLTFSSFLTLDTPIYYKSDLETKLATDNGWIDSDPRAIQEWLTNYYTNSDDRALMKRLVRYFKAWVNVKWQGTEFKKIPSLAINVLVAQHMQKYENEDDSFIHTVLSICEELESTFIVSNPLNGNNILTMPEDAETFAHQKLDHLKRVCLNCSDSSELERSLEFSNLFQHYFPQVELGPSSGSINLPAVTTVPEISICRYDKNGKHVETIVTNSVTVKKGDSLTFTICNHSDFNLFADAHWTVRNVGKQATDANDIGHKVSGRTNESHKRDTTYTGAHTMECMITYNGSVIGIQTINVEVKPATTLRRKRVFKGGRR

SEQ ID NO: 3055 - protein, 445 aa, Vibrio cholerae
MMNCSQLFYSVDESIETLHQRTKLSDIVLSKGINKKDEVIEFLKAELSAAFECKVEFWLQGSYKSSTLIKPVDKYSSYDIDIGIYLLFDAEEEEIDAQDVKATLKDALESYCQINDEAKLQKSKNACEGLTFSSFLTLDTPIYYKSDLETKLATDNGWIDSDPRAIQEWLTNYYTNSDDRALMKRLVRYFKAWVNVKWQGTEFKKIPSLAINVLVAQHMQKYENEDDSFIYTVLSICEELESTFIVSNPLNGNNILTMPEDAETFAHQKLDHLKKVCLNCSDSTELERSIEFSNLFQHYFPQVELGPSSGSINLPAVTTVPEISICRYDKNGKHVETIVTNSVTVKKGDSLTFTICNHSDFNLFADAHWTVRNVGKQATDANDIGHKVSGRTNESHKRDTTYTGAHTMECMITYNGSVIGIQTINVEVKPATTLRRKRVFKGGRR

SEQ ID NO: 3056 - protein, 444 aa, Vibrio cholerae
MNCSQLFYSVDESIETLHQRTKLSDIVLSKGINKKDEVIEFLKAELSAAFECKVEFWLQGSYKSSTLIKPVDKYSSYDIDIGIYLLFDAEEEEIDAQDVKATLKDALESYCQINDEAKLQKSKNACEGLTFSSFLTLDTPIYYKSDLETKLATDNGWIDSDPRAIQEWLTNYYTNSDDRALMKRLVRYFKAWVNVKWQGTEFKKIPSLAINVLVAQHMQKYENEDDSFIYTVLSICEELESTFIVSNPLNGNNILTMPEDAETFAHQKLDHLKKVCLNCSDSTELERSIEFSNLFQHYFPQVELGPSSGSINLPAVTTVPEISICRYDKNGKHVETIVTNSVTVKKGDSLTFTICNHSDFNLFADAHWTVRNVGKQATDANDIGHKVSGRTNESHKRDTTYTGAHTMECMITYNGSVIGIQTINVEVKPATTLRRKRVFKGGRR

SEQ ID NO: 3057 - protein, 444 aa, Vibrio vulnificus
MNCSQLFYSIDENIETLHQRTKLSDIVLSKGINKKNEVIEFLKAELSAAFECKVEFWLQGSYKSSTLIKPVDKYSSYDIDIGVYLLFDAEEEEIDAQDVKATLKDALESYCQINDEAKLQKSKNACEGLTFSSFLTLDTPIYYKSDLETKLATDNGWIDSDPRAIQEWLTNYYTNSDDRALMKRLVRYFKAWVNVKWQGTEFKKIPSLAINVLVAQHMQKYENEDDSFIHTVLSICEELESTFIVSNPLNGNNILTMPEDAEAFAHQKLDHLKKVCLNCSDSTELERSVEFSNLFQHYFPQVELDPSFGSINLPAVTTVPEISICRYDKNGKHVETIVTNSVTVKKGDSLTFTICNHSDFNSFSDAHWTVRNVGKQATDANDIGHKVSGRTNESHKRDTTYTGAHTMECMITYNGSVIGIQTINVEVKPATTLRRKRVFKGGRR

SEQ ID NO: 3058 - protein, 444 aa, Thalassobium sp.
MSCNELFFSSNDADVTLHQRTKLSDVILSKGITKKDELIEFLRPELSEAFECEVHFWLQGSYKSHTLIKPADKFSSYDIDIGVYLFFDAESEGIDSKDVKSTLKDALSSYCQINDEAEPQKSKNACEGIKYSTFLTIDTPIYYIDGSNIKLATDDGWVESDPKAIQDWLTNYYSDKTDRALMKRLVRYLKAWINVKWQGTGFKKIPSLAVNVLVAQHMKKHDREDDSFLHTALSICEELESTFVVKNPLSGSNLLTMPEDSERFAHQKLDELKAICLSCIGSIEFDKGINFSNLFQHYFPQVNISPSEGTTGLPAVVTVPEISICRYDKDGNHIETITTDNLTVKKGDSLTFTICNQSAFNIYSDAQWTVRNVGGQATDANDIGHKVIGRLNESHKRDTSYTGTHTMECMITHNGVVKGFQAIHVQVKPATTLRRKKIFNGWRR

SEQ ID NO: 3059 - protein, 444 aa, Pseudoalteromonas sp.
MSCNELFFSSNDKDETLHQRTQLSDVVLSKGITKKDELIEFLRSELSEAFECKVGFWLQGSYKSRTLIKPVDKFSSYDIDIGVYLFFDAESEEIDSKDVKSTLKDALSSYFEINDEAEPQKSKNACEGLKYSTFLTIDTPIYFIDGSNIKLATDDGWVESDPKAIQDWLTNYYSEKADRALMKRLVRYFKAWINVKWQGTGFKKIPSIAVNVLVAQHMQKHDREDDSFLHTALSICEELESTFIVNNPLGGSNLLTMPEDSESFAHQKLDELKAICLNCIDSSEFDRGINFSNLFQHYFPQVNISSSEGTTGLPAVVTVPEISICRYDKDGNHVETTTTDNLTVKKGDSLTFTICNQDSFNTYSDAQWTVRNVGGQATDANDIGHKVIGRLNESHKRDTSYTGSHTMECMITHNGVVKGFQAIHVQVKPASTLSRKKTFKGWRR

SEQ ID NO: 3060 - protein, 444 aa, Aeromonas salmonicida
MNCSNLFNSELDGEDSLHKRTKLSSLILTKGISKKDELVEFLRTELKEAFECEVRFWLQGSYKSHTLIKPVDKFSSYDIDVGVYLFFDAEAEGIDSRDVKATLKDALISYCNINDEAKLQESKNACEGLEFSTFLTIDTPIYYIAGSNIKLATDGGWVDSDPMAIQGWLTEFYSDKDDRALMKRLVRYFKAWINVKWQGTRFKKIPSLAVNILVAQHMNRYEREDDSFLYTTLRICEVLEANFIVKNPLNENNLIDMPQESRKFSIQKLEQLKRLCQKCIDASEFEKGVEFSNIFQHYFPQVKLETTEAKPGLPAVVTVPNISICRYDRDGKHIETVISDNITVQKGDSLTFTICNHNEFNPLSDAQWTVRNVGPQATDANDIGHKVVGRPNESHQRDTSYTGSHTMECMIIYNGVLLGFQAIHVKVNPVRILRRKSIFKGWRR

SEQ ID NO: 3061 - protein, 443 aa, Escherichia coli
MNCSDLFYADTNTENTLHQRTQLSEVILSKGIAKKNELIEFLRQELKEAFDCDVRFWLQGSYKSHTLIKPVDKFSSYDIDIGVYLFFDAENEGVDSKDVKETLRDALLSYCSINNEAKLQESKNACEGLKFSTFLTVDTPIYYKTDTKIKLATDKGWSDSDPKAIQDWITNYYKDKSDRALMKRLVRYFKAWVNVKWQNTGFKKIPSLAINVLVAQHMKQHVREDDCFIYTALSICEELESTLIVRNPLNNSNLISMPQDAECFAHQKLDELKQVCLSCIKSDDIKRGAHFSNLFQHYFPQISLDSATGSTGLPAVVNVPEISVCRYDKNGNHVETIITDRLTVNKGDSLTFTIRNHYDFNIYSSAQWTVRNIGSQANDANDIGHAVTGKPSESHKRGTSYTGSHTMECMILHNGAIIGFKTILVIVKPARTVRRKTLKFWRA

SEQ ID NO: 3062 - protein, 443 aa, Pectobacterium parmentieri
MNCSDLFYLTDNPENTLHQRTKISDVVLSKGIAKKDELIEFLREELKESFDCEVKFWLQGSYKSHTLIKPVDKFSSYDIDIGIYLFFDAEEEGVDSKDVKDILRDALSSYCEINNEAELQKSKNACEGLKFSTFLTVDTPIYYKTADGLKLATDSGWSDSDPKAIQEWLTDYYDDKSDRALMKRIVRYFKAWINVKWQGTKFKKLPSLAMNVLVAQHMKKYSREDECFVYTALSICEELESTFIVSNPLNSSNIVSMPFDSETFAHQKLDELKQFCLKCLDADDFQRGILFSNIFQHYFPQVYLDAGSEIVGLPAVVTVPEISICRYDKNGNHVETITTDTLTVNKGDSLTFTICNHNEFNIYSNAQWTVRNVGVQATDANDIGHTVVSKTNESHKRDTSYTGAHTMECMINYNGSLIGFKTIHVMVKPARTVRRKINKIWRK

SEQ ID NO: 3063 - protein, 442 aa, Escherichia coli
MNCNELFYSADNHALTLHERTKLSTVVLDKGITKKNELIEFLREELKGSFGCDVKFWLQGSYKSHTLIKPVDKFSSYDIDVGIYLFFDAEAEEINSKDVKDTLKDALLSYCEINNEAKIQESKNACEGLIFSSFLTIDTPIYYKTTTKVKLATDKGWSDSDPKAIQDWLTNSHATKPARALMKRLVRYFKAWVNVQWHGTSFKKIPSLAINVLVANNLSIHDREDDCFIYTVLAICEQLERSMEVENPLNGTNLLAMPDDALTFAHQKLQQLKKVCIDCIDANENERNINFSNLFQHYFPQVTIVSNGGGTGLPAITTTPEISVCRYDKHGSHIETVLTDQLTVDKGDSLTFTICNPGAFSPYAQTKWTVRNVGSQANDANDIGHIEYGKPNESHKRGTSYTGSHTMECMVTYNGAVLGLKVIQVIVRPAISVKRPIRKFWR

SEQ ID NO: 3064 - protein, 442 aa, Escherichia coli
MNCNELFYSADNHELTLHERTKLSTVVLDKGITKKNELIEFLREELKGSFGCDVKFWLQGSYKSHTLIKPVDKFSSYDIDVGIYLFFDAEAEEINSKDVKDTLKDALLSYCEINNEAKIQESKNACEGLIFSSFLTIDTPIYYKTTTKVKLATDKGWSDSDPKAIQDWLTNSHATKPARALMKRLVRYFKAWVNVQWHGTSFKKIPSLAINVLVANNLSIHDREDDCFIYTVLAICEQLERSMEVENPLNGTNLLAMPDDALTFAHQKLQQLKKVCIDCIDANENERNINFSNLFQHYFPQVTIVSNGGGTGLPAITTTPEISVCRYDKHGSHIETVLTDQLTVDKGDSLTFTICNPGAFSPYAQTKWTVRNVGSQANDANDIGHIEYGKPNESHKRGTSYTGSHTMECMVTYNGAVLGLKVIQVIVRPAISVKRPIRKFWR

SEQ ID NO: 3065 - protein, 443 aa, Enterobacter cloacae
MNCNELFYSPDKNELTLHERIKLSTVVLDKGVTKKNELIEFLREELKGSFGCDVRFWLQGSYKSHTLIKPVDKFSTYDIDVGIYLFFDAEAEEIESKDVKDTLKDALLAYCAINNEAKIQESKNACEGLIFSSFLTIDTPIYYKTDKTLKLATDKGWSDSDPKAIQDWLTNSYVTKDDRALMKRLVRYLKAWVNVQWNGTSFKKIPSLAINVLVANNLSVDERDDDSFINTVLGICEQLEQSMEVANPLNGSNLLAMPEDALTFARQKLQQLKKVCMDCVDANENERNINFSNLFQHYFPQIQIVSNEGVVGLPALTITPDISVCRYNKNGVHIETIRTDRLTVDKGDTLTFTICNSASFNAFAQTQWTVRNVGHQANDANDIGHIEYGKPYESHKRGTSYTGTHTMECMITYNGAILGLKVIHVVVRPALSVNRPIRKWWRR

SEQ ID NO: 3066 - protein, 447 aa, Vibrio alginolyticus
MNCADIFHNSDGSIETLNTRTKLSEVILKKGILKKDELIEYLRAELSEAFDCRVGFWLQGSRKSHTLIKPVDKNSSYDIDVGVYLFFDAEEDGVSAKDVKQTLKLALQSYCETNDEPTPQESKSACEGLKYSSFLTIDTPIYYISNDDDSPKLATDSGWVDSDPKAIQKWLTDAQDTDAKRALMKRVVRYLKAWVNVKWNGTDYKKIPSLAINVLVACHLKQYEFEDDSFIYTTLSICEELESLFKVENPLTGQDILTLSYESEVFAHSKLSELKDACLEASDASEHQKCIIFSKLFEHYFPQVEHSDFSGTIGLPATVIVPELTINHYDKDNKHIRTLISDHITVRKGESLTFSITNKKDFNQYCNAQWTVRNIGSQANDANDIGHKIISNMGESHQREASYTGCHTMECIIFSGAGVVGVNCIKVRVRPALPVLRRKNTFKGFRK

SEQ ID NO: 3067 - protein, 443 aa, Alteromonas sp.
MDCSTLLYSQNKELNTLHNRLKISEVVLTKGVYKKNELIDFLREELKETFDCEVRFWLQGSYKSHTLIKPSDKYSSYDIDIGIYLSFEIEEADASEVKQAVKEALESFCKVNDECNLQQSKNACEGLKYKQLLTIDTPVYAFSSTAIKLATDDGWVDSDPKLIQDYLTNAFENPVDRAIMKRVVRYLKAWINVKWNGTDYKKIPSLAVNILVADHLIIEENEDDTFINTVLSICESLDKVFRVNSPIDSSNLLSMPDEAISFAYKKLDELKRTCNKCVKSPDYRPLLLANLFEHYFPPLTEESGSGSINLPALSKVPNISISRYSKGDKHIETVDENEITVFKGESLTFSICNKNDFNSESTVHWTVRNIGKQADDANDIGHKNISNLESNERRDATYTGSHIMECMIVANGRIQGISSVLVEVKPSKVVSRRRKKIFKGFRR

SEQ ID NO: 3068 - protein, 445 aa, Unknown
  Description of Unknown: Pseudoalteromonas sequence
MSCTNLFYLKDSDETLHSRLTLSKLLLNKGVARKNELIEFLRVELKEAFDCDVRFWIQGSYKSHTLIRPLDRYSSYDIDIGIYLFFDAESEGIEASDIKETLKDALISYTNINDECELQDSKNACEGLKFKSYLTIDTPIYYCIEKEKVRLATDSGWIDSDPKSIQDYLTNSFDKESDRALMKRVVRYLKAWANIKWQNQKYKKIPSLALNVLVAEHLHINDCDDVSFIETAINICEKLEFIFKVDSPLDGSNLVHMPEEDQAFAHRQLDSLKSICIASQDSDDADRTFIFSNLFEHYFPQVSFNEEGQAGLPTLTTVPDLSVSRYDKNGKHIETIKSDEITVFKGESMTFSINNKTAFPPDSNIHWTVRNIGDQASDSNDIGHKTITQLSDSEKRGAAYTGKHSMECIVVANGSVKGVNLVNVNVKPAKTVQRKSKIFKGSGRR

SEQ ID NO: 3069 - protein, 453 aa, Vibrio ichthyoenteri
MNCSDLFYSSQTTLGTLHSRTKLSKSILSKGIAKKDALIDYLRAELEDSFGCSVKFWLQGSYKSFTLIAPVSSQSTYDIDIGIYLISELETPDVDAKDVKEVLKETLSYYCQIDTEAKLQDSKNACEGLTFENFLTIDTPIYFIRDIKDSTPLLATDNGWIDSDPIAIQTWLTNFYSTDADRSLMKRNVRYLKAWANIRWKRSEHKKIPSLALNILVANNLHIGDNEITSFEKTVSNICSQLNQSFEVLNPLNGQDILGMSDEAKAFAVKQFDHLNSVYLKVKHEDEATKALEYSNLFEHYFPQLPVLTTQQGGVSVPVVTNIPEIYVERYDSSGNYLSGEVTNQIDVRKGDSLTFKINNPHDFIMSDEVHWTVRNEGNQSISANDIGHSEITSINDTSQRGSAYTGTHAMECLVKSWGSITGFNLVKVRVRPVAQIVKNKVFKGFNKFGKRR

SEQ ID NO: 3070 - protein, 453 aa, Enterovibrio pacificus
MNCSDLFYNSKSDSTTLHSRIKLSKNILDAGVAKKKSLIDYLRTELEDSFDTDVKFWLQGSYKSSTLISPLDKDSTYDIDIGIYLFYDCDFPDINAKEAKGILRQTLEFYCKTDTEAKIQKSKNACEGLEFENFLTIDTPIYFMSTKSGSTPLLATDKGWLDSDPKAIQTWLTNAFSKHEERALMKRIVRYFKAWANVQWKNSEFKKVPSLALNILVAKNLYIGNCELDSFEGTLSNICTSLEVRFTVFNPISNENILGMSDDETQFAKRKFEQLHSLYLRIKDEDDSTKAIEYSCIFEHYFPQISALTSSRLGDTVPVISKIPEIYVERYDSSGNYLSGNITSEIEVRKGDSLTFKIKNIDDFIISDEVYWTVRNDGDQSLNANDIGHRRTTKINESFQRATSYTGTHSMECMVKSWGMITGFSLVNVRVRPVAKISRTKKFKGLNKFGKRR

SEQ ID NO: 3071 - protein, 469 aa, Unknown
  Description of Unknown: uncultured bacterium sequence
MGKASRLFNGTAEQTLHSRITPTTDQREFLQTQWNNLAEHLKIELVGWGYPISTWLQGSYKYGTLIKPVHKGEEYDVDVGVYFSWNPKTTDLTPTPEQLRTWVQQELVQYKQANPDVKHIDEPAKERCSRAVYAKQFHIDTPTYHLNSETDTRRLACLSGKWEDSDPKAVYNWFKKVVGPDNRDLLRRLVRYLKGWAAVAFEEAPSSRPSSIVLTVLAAEAFKDMWGARLLGIDDDDALIAVIETIHKRLSADKRVANPIDDSEDLNRIADEHWQAFFTRLTLLQDAAQSAGEAEDEAAAALAWSESFAFLMPLPETDEVEVLDHNSGRALMQIPDIQVQVFDTEGGALLATYMNEVPDVERDRYMTFTIVNRHIVPDFAMVEWTVRNDGSDADALGDLGHKRGGIGLLSVNEHTAYVGKHYMDCVIRCNGSVFSARRVPVFIKAGSRTLVPQAKRSWTRLRTRRGRRK

SEQ ID NO: 3072 - protein, 469 aa, Burkholderia sp.
MGKAARLFNGTAEQTLYGRVTPTAEQREFLQSQWNALADHLKEQLAGWGYPISTWLQGSYKYGTLIKPVHKGEEYDVDVGVYFEWNPGDVDISPTPTQLRHWVQRELVEYRQSNPDVERVEEPPKERCSRVTYQRQFHIDTPTYHLNRGTDERRLACLSGKWENSDPKALYKWFKNAIGSDNREQLRRLVRYLKGWAAVAFEEAPASRPSSILLTVLTTEAFSEMWGARLLGIADDDALVAVIESIYVRMHKDRRVRNPVDRGEDLNRISDEAWDAFLTRLTVLRDAAQMSSEAEDEAGAALAWAGAFSFLMPLPETDELEVVEHLSGRALMQIPEIQVQVFDSERKNLLATHMNEVPAVGRNQALTFTIVNRQVIPDFAAIEWTVRNDGAEADYLGDLGHASGGIGMFSVDERTAYVGKHYMDCIIRCNGSVFSARRIPVFISADVRALAKPVQRNWTRLRTRRGRRR

SEQ ID NO: 3073 - protein, 469 aa, Comamonadaceae bacterium
MGKAARLFNGTAEQTLYGRVTPTPEQRQFLQEQWNALADRLKDRLSNWGYPISTWIQGSYKYGTLIKPVHKGEEYDVDVGIYFSWDPNETDLSPTPQQLRSWVQHELLEYQKDVGVLVEVADPPKERCSRVIYKQQFHIDTPTYHLNPVNDARRLACLSGSWESSDPKLLYKWFRDVVGPDNHELLRRLIRYLKGWAAVAFEDAPKARPSSILLTVTVAEAFTNMWRARLLGVADDDALIAVIGILYERFANDSKVPNPVDGKENLNRIPADSWSAFLTRLAVLNDAAQAADAAEDEASAAFAWEGAFSFLMPLPETDGVEVVEPATNLALMQVPDIEVRVYDKRAGKLLATHTNEVPSVAKDRWLVFDLANKHVLPDYADISWTVRNNGEEAVHIGDLGHFRRGINMRTAEESTAYLGKHYMDCVIRLNGTIFAVRRVQVNIMPDQKILLAQAQRSWTTLRTRKGRRR

SEQ ID NO: 3074 - protein, 469 aa, Burkholderia pseudomultivorans
MGKAARLFNGGAEQTLYERVTPTQEQRQFLQEQWNAMAEHLKVKLSEWGYPVSTWLQGSYKYGTLIKPVHKGEEYDVDVGIYFSWVPKEHEISPTAQQLRTWVQEELIEYKNTAAALKEVVAPPKERCSRAIYEQQFHIDTPTYHLDPATDRRRLACLSGAWEDSDPKQLYKWFRDVVGSDNREQLRRLVRYLKGWAAVAFEDAPEARPSSILLTVTAAEAFSQMWGARLLGIADDDALGAVVGKIYTRLAENRKVLNPVDSDEDLNRISATSWDAFLTRLAVLNDAAQAAGAAEDEAAAAFAWEGALSFLMPLPETDEVEVVEAATDRALMQVPDIEVKVYDYRGGSLLATYRNEVPRVPKNKWLVFELANKHVVPEYADISWTVRNDGDEADYIGDLGHFKRGINMHTVEESTAYLGKHYMDCVIRLNGAIFAVRRVPVHVKNDQQKLFAQTQRAWTKLRTRRGRRR

SEQ ID NO: 3075 - protein, 469 aa, Unknown
  Description of Unknown: Alcaligenaceae sequence
MGKAARLFNGQAEQTLHGRVTPTSEQRQFLQSHWNALRDRIKPRLEALGYPVTTWLQGSYKYGTLIKPVHKGEEYDVDVGIYFSWDPTQSDFSPTADQLRSWVQQELIEYEKGVEELTEVLDPPKERCSRAVYKQRFHIDTPTYHLDPATDTRRLACLSGAWEKSDPKVLYKWFRDAVGSDNRDLLRRLVRYMKGWSAVAFDDAPKARPSSILLTVAITEAFIQTWGDKPVDIADDDALIVVVDLLYKRFVHEPLVCNPVNREENLNRIPDDSWGVFLTRLAVLNDAAQAADAAEDEAAAALHWEGAFSFLMPLPEADEVEVVEPATDRALMQVPDIVVRVFDRKDGNLLATHLNEVPSVTAKKWLVFELANKHILPAFADISWTVRNDGDEADRTGDLGHFKRGINMLATSESTAYLGKHYMDCVVRLNGTIFAVRRVPVHITSDPKKLLAPAQRQWTKLRTRKGRRR

SEQ ID NO: 3076 - protein, 467 aa, Herbaspirillum huttiense
MGHAARLFNGSAEQTLYGRITPTEAQRDFLQAQWNSLAEHLKEELADWGYPVSTWLQGSYKYGTLIKPVHKGEEYDVDVGIYFHWEKKLGEITPSPDQLREWVQQELMEYQKINADIQKIDLPKERCSRAIYAQQFHIDTPTYHLDPAEDHRELACLSGKWEASDPKAIYKWFKNAVGSDNRDQLRRLVRYLKGWAAIAFQDAPASRPSSIFLTVLAADVFRDMWGARLFGIADDDALSAIIKAIFERLIKDPRVPNPVDRKEDLNRIPEGAWDAFLTRLTVLHDTALSADEAEDEASAALIWAESFSFLMPLPETDAVEVIEPTSERQLMQLPEIQIQIFDSQDNLLATHMNEVPSVVKGQKLLFTIVNPEVVPAYASIEWTVRNSGNESDRIGDLGHARGGIRMFSIEEYSGYIGKHYMDCVIKNNGSIFSARRIAVYIEENLSIRRKNSQRNWMKLRTQRGRRS

SEQ ID NO: 3077 - protein, 471 aa, Ramlibacter tataouinensis
MGKASRLFNGQAEQTLHAKVTPSTEQRDFLQQRWNNLADHLKARLAQHGYGISTWLQGSYKYGTLIKPVKWGDQYDVDLGLYFEWEPQAGQPEPAPGQLRTWVQRELHSYKENAPELKEVAEPAKERCSRAIFTRRFHIDTPTYHLDPQSDKRRLATLSGKWEDSDPKALYKWFKKVQSGAEREQMRRLIRYLKAWAAVAFEGADDARPSSIVLTVLTAQIYESMWLERFGGIDDEDALILVVKRMYARLTESAEVWNPVNRKENLNRISAAAWPVFMTRLTALLDCADAAEAAHDEFAAACAWSAAFSYLMPLPETDLVEVEQDSTRMAIMQVPDVRIEVAEDVDFKTSVNTHENEVVEVAKNRWLRFSIANPQLVPPMASIEWTVRNDGADAESLGDLGHTQGGIGLHQVVERTAYAGKQYMDLVIRLNGTVYAARRVAVHIRDNHQLGQKRATPRAWLSLRTRKGRRR

SEQ ID NO: 3078 - protein, 472 aa, Polaromonas sp.
MGKASRLFNGQAEHTLYERVTPTTEQREFLQQQWNELADYLKAELTGYGYPITTWLQGSYKYGTLIKPVHRDEEYDVDLGIYFDWDPKAVEIAPTAQQLRTWVQRELLTFKLGHPAVKDVADPPKERCSRAIYAKRFHIDTPTYHLDSKREKRELATLSGQWEDSDPKAIYKWFKGVVSGDEREQLRRLIRYLKAWAAIAFETAPDSRPSSIVLTVLVANIYSDDMWLQRLITMDDDDALITVIKEMHKRLNKNRDVLNPVNTKESLNRIPSEAWGAFLTRLQLLYEAAESAEAAEDEVAAALAWSEALTYLMPLPETDVVEVSDPASTTALMQIPEVKIEVATDWSFKNILQTHRNEVPGVAKGQCLRFTIINPQIIPAMAMIEWTVRNEGEDADYLGDLGHTRGGMQMFTVEEGTKYAGKQYMDLTVRCNGSVYAVRRISVLIEDRPVLSKPKATPRAWTTLRSRKGRRR

SEQ ID NO: 3079 - protein, 469 aa, Betaproteobacteria bacterium
MGKAASLFNGAGEQTLLKRVTPTTEQREFLQIQWNALADHLKQALYTDYGYPISTWLQGSYKYGTLIRPVHVDEEYDVDVGIYFQWENDGNATPAPTQLREWVQRELLVFKSLNADVKSIAEPPKERCSRAIYEKKFHIDTPVYHLEKSTDTRRLACLSGAWEDSDPKAIYEWFKNVVWGDDREQLRRLVRYLKGWAAVAFVESAAARPSSILLTVLAAESFEKHLLSRLVGMDDEDALVLVIKDMHERLFDDRVVLNPIDESENLNRIPDEHWDVFLTNLQALRNAAENAEAEQDEAAAALAWSEVFSFLMPLPPTQEVEVVEEVSGRAIMVLPEIEIEVFDRVSKKPIGKHRNEVPSVPKDCDLIFKIVNPHVIPEYASVEWTVRNDGEESDYIGDLGHRRMGIRMLEADEHTAYAGLHFMDCVVRFNGQVYAVRRVPVTVKDVNYPARNPPRPAYTKLFSKFRRRR

SEQ ID NO: 3080 - protein, 471 aa, Janthinobacterium sp.
MAKAAHLFSGNASDSLINRVTPTVEQREFLQQQWNDMRDYVCPNLQEESGYPISTWLQGSYKYGTLIRPVHIDEEYDVDVGIYFKWEKKDGEAFPAPEQLRTWVQTELLGYADECSDVRKIEAPAKERCSRAVYKMQFHIDTPVYHLDPSTDRRQLATLSNTWEKSDPKPIYKWFKDAASGSAREQLRRLIRYLKGWAAVAFVETPESRPSSILLTVVVTQAYQDAWVDRLLALRDDEDALVDVIVRIHKRLFASCQVRNPVDENEDLNRMSADAWDAFLSSLQSLEDAAARAVDAADEAAAALIWSEPFSFLMPLPDVEAVEMQEEASGRAVMQIPDVVITVYLGNSKVAHASYENEVPNVGKDCWLDFRIKNPHVIPDYATVEWTVRNAGQEADGIGDLGHRQMGMRLLSVREHTSYIGKHFMDCVVRLNGQVYAVRRVPVHIKNILRAERNPPKPAYTKFVSRLRRRR

SEQ ID NO: 3081 - protein, 471 aa, Unknown
  Description of Unknown: Massilia sequence
MGKAARLFSGAAPDSLINRVTPSTEQREFLQRQWNDMRDSVCPKLQQESGYPISTWLQGSYKYGTLIRPVHLGEEYDVDVGIYFEWEKEKGAAYPSPEQLRSWVQRELLAYGKECEMVDRVEDPAKERCSRAVFKQQFHIDTPVYHLERSTDTRRLACLNNGWEQSDPKPIYKWFKEAASGDERDQLRRLIRYLKGWAAVAFIDISGSRPSSIFLTVVITEAYQAGWLDRLLGLKDDEDALVDIIVRVHNRLFAHREVRNPVAADEDLNRISADAWDGFLTCLQALREAAERALDAEDEAGAALVWSEVFSFLMPLPEADEVEIQENTSGRAVMQVPEIEVTVFIGNSKQPHTSYRNEVPSVGRDCWLVFRIVNAHIIPEYATIEWTVRNAGEESDFIGDLGHRQMGVRLLTVREHTQYLGRHYMDCVVRLNGQVYAVRRVPVHIRNIQRAERNPPKPAYTKIVSRLRRRR

SEQ ID NO: 3082 - protein, 471 aa, Janthinobacterium sp.
MGKAAQLFSGNAPDSLINRLTPSVEQREFLQLQWNAMRDVVCPMLRDDSGFPISTWLQGSYKYGTLIKPVHLHEEYDVDVGIYFEWVGKAGEAYPAPEQLRAWVQNRLSDYGKECEDVERVEEPAKERCSRALFKRQFHIDTPVYHLDRSTDTRRLATLAKGWESSDPKPIYKWFRDAASGAEREQLRRLIRYMKGWAAVAFVETPDSRPSSILITVVVTEAFQAAWFERLLGLKDDDDALVDIITRIHNRLFAAREVRNPVDRDEDLNRMTDDAWDAFLSNMQGLRDAAEQAIEANDEAASALIWSQPFSFLMPLPDVAAVEMQEEVSGRAVMQIPDIEIAVFVGDSKQPDVTYDNEVPGVAKNCWLVFRIKNQHIIPDYATVEWTVRNAGNESDGIGDLGHRKMGMRLLTVREHTSYSGKHYMDCVVRVNGQVYAARRVTVHIKNILRAERNPPKPAYTKLVSRLRRRR

SEQ ID NO: 3083 - protein, 468 aa, Verminephrobacter eiseniae
MGQASKLFNGNTDQTLIGRVTPTTEQREFLQQQWNDLADHLKQALAKHGYTISTWLQGSYKYATLIKPVHLGEEYDVDVGLYFEWNDDQDAEPTPKQLRDWVQAELLEYEKACEELKKVEVPPKERCSRASYIQQFHIDTPVYHLNTDSDVRRLACLSGKWEHSDPKKLYKWFKEAVSGDDRDQLRRLVRYLKAWAAVSFDDAPGSRPSSIFLTVIATEAYQDLWAQRLLGLADDDALLAVIKKMHDRLFDDRKVENPVDKNEDLNRMTAEAWDGFLPRLAALQDIAERAGDAKDEASAALIWSEAFSFLMPLPETDQVEIVDEGSGRAVMQLPEIEVKVCTGTPPRPVATYRNEVPGVAKDCMLSFAIVNPHVVPEFATVEWTVRNEGQEADQRSDLGHRRVGMRLLSVEEHTAYVGRHFMDCVVRLNGQVYAVRRVPVTIRDVQHVARNPPRPPYTKLRSLFRRRR

SEQ ID NO: 3084 - protein, 468 aa, Methylovorus glucosotrophus
MGKATRLFNGGADQTLISRVTPTTEQREFLQEQWNSLADHVKKTLGKHGYTISTWLQGSYKYATLIKPVHSDEEYDVDVGIYFEWGEEQDIEPAPRQLREWVQKELIEYAKLCTDIKKIETPAKERCSRASYARQFHIDTPVYHFNKDSDSRRLACMSDKWELSDPKRLYKWFKDAVNGDDRDQLRRLVRYLKTWAAVSFDDVPDSRPSSIFLTVITTEAYKSLWGQRLFGIEDDDALIAIVKILHTRLFNDRQVINPIDKDENLNRMSSEAWDGFLPRLASLSNIAERAEAAEDEASAALIWSEAFSFLMPLPETDQVEIVEEISGRAVMPLPEIEIQVFAGNPSRLVMTHRNEVPSVSKGCSLSFKIVNPHVVPEFATVEWTVRNEGQEADQKSDLGHRRVGMRLLDAEEHTAYYGRHFMDCIVRMNGQIYAVRRIPVNVRNLDQPARNPPRPSYTKIRSFLRRRR

SEQ ID NO: 3085 - protein, 467 aa, Thauera sp.
MGHAAQLFAGNRDQTLIKRVTPTSEQRQFLQEQWNALADHLKQRLPDRHGYPVSTWLQGSYKYGTLIRPVHRGEEYDVDVGVYFHWTDEEVATPSPAQLREWVQEELVLYGRGNGDVKEVVAPPKERCSRVVYARQFHIDTPVYHLDPENDRRRLACLSDAWEDSDPKKLYKWFRNAASGENREQLRRLVRYLKAWASVSFDEAPESRPSSILLTVLATEAYQNLWETVLGIDDDDALIAVIKKVHNRLFDKKAVPNPVDRTEDLNRISDAGWEGFLPRLQGLLDVAERAEETEDEASAALVWSEAFSFLMPLPETDQVEIVDERSNRAVMVLPEIEVQVHGGNPKAVLATYRNEVPSVAKDCELTFRITNPHVVPEYATVEWTVRNEGEEADRVGDLGHRRAGLRMLTANEHTAYVGRHFMDCIVRLNGRVYSVRRVPVNIRNLSYPQRNPPRPAYAKLRSILRRR

SEQ ID NO: 3086 - protein, 470 aa, Rhodoferax saidenbachensis
MGRASSLFNGAGEQTLINRVSPTTRQREFLQTSWNDLAEYLKVSLKAKHGYAISTWLQGSYKYGTLIKPVLADEEYDVDLGVYFDWGNGESIEPTAEQLRRWVQQELIEYHDQCADMRSVAEPPKERCSRASYEHQFHIDTPVYHLNSDTDKRRLACLTKGWEASDPKTFYKWFRDALTGGEREQVRRVIRYLKAWAALSFDDIPDSRPSSIFLTVLATEAYPDIGLALLLGVSDDDALISIVRTIHGRLNGSQRVQNPATRVEEDLNRMSDEAWAAFLPRLDALLDIVERAAEAADEVAAALIWSEAFSFLMPLPEVDEVELVDEQTSRALMQVPEIDIAVYTGSGRQRRFVSKHRNQVAGVAKDCALVFTIVNPQVVPMFATVEWTVRNKGLDADESSDLGHRRVGMRMLQNEERTLYLGTHHMDCIVRVNGQVYAARRVPVTIRDVHHHVHNPAAPAYTKLRIKRRR

SEQ ID NO: 3087 - protein, 470 aa, Zoogloea sp.
MGHASSLFNGAGDQTLISRVSPTTQQREFLQASWNDLAEHLKVSLKAKHGYSISTWLQGSYKYGTLIKPVHSGEEYDVDLGVYFEWGKGEDIEPTADQLRCWVQQALIGYRSQCAEIRSVAEPPKERCSRTSYQHQFHIDTPVYHLNTDTDKRRLACLTKGWEASDPKAFYKWFRDALTGGEREQVRRLIRYLKAWAAVSFDDIPDSRPSSIFLTVLATKAYSDTWFARLLGLPDDDALIAIIREIHGRLNRDRRVQNPTTKEEENLNRMSDEAWVAFIPRLDTLLDVAERAADAADEGAAALIWSEAFSFLMPLPNVDEVELVDERTSRALMQLPDIDIAVYTGSGEQRRLVTNHRNQVAGVAKGSTLVFTIANPHIVPQFATIEWTVRNKGLDADSTSDLGHRRIGMQLLQAEEHAQYFGTHHMDCIIRVNGQVYAARRVPVTICDVQHKVPAPAQPTYTRLSMKRRR

SEQ ID NO: 3088 - protein, 462 aa, Stenotrophomonas maltophilia
MGVAANLFFSNDDAESLNRRVRPTDGQLGFLRENKDALEQWLLNNLADSGYGVSTFLQGSYRFHTLIKPVMPGAEYDVDVGFYFIGGRAEPDSADLRGLLRSSLEEFAGICDKVKQLDAPKERCSRVRYERKFHIDVPVYHKASDSGAVRLATLSNGWERSNPAAMLDWFQEALDGDDLQKARIRRLVRYMKAWAALKFTDSGGIPSSLLLTVLVVDAAQRLDGEDDDDALRIVVDSIYERLLADSEVRNPVGGDSDTNLNRLDEDDFDAFMEELARFKDSSSRATDCEDEAEAAVVWCEAFEHLFPLPEGVDGLALEVADTGLAIQSPVINIAVLDGDGHSVLRNYIGRVPIARIGEKLRFMITNPEVIPSNARVTWVVRNTGAGAHEESDLGHSGVDDGSRVWTRGVAYIGRHFMDCEVRVHGQLRSVTRVAVDVNRAATPPRHPVSRPPYVKLFGRRRR

SEQ ID NO: 3089 - protein, 484 aa, Sphingobium sp.
MRPRHSLSSTLSFECPMSTAARLFHSKSDQTLYDRITPSTDQFATQQARWNDLADFLKSRMKDDTGYPISTWLQGSYKFDTQIRPLTTGAQFDIDLGLYFEWAGSDDDGDYDPEGFKELIQNALLDYADDEDNDASRVEEPKERCCRIAFNPDFHIDVPCYHLDRTKDRRALATESKGWEASDPKAIYVWFKDLHDDKTIRAQLRRLVCYFKMWAALKIEDEASRPSSITLTVLVAEALSEIDLSETSDDDDVLEGIITIIADRLDDDTEVANPIDNDEDLNRLSDEANDNLRARLREFEDTARRANAATSEATAAEIWTEAFEHFFPMPEDVEGEANANTAARSDIAKNHALVAYSFDPEIHVRAWSQNNENYERFGVNELPTILKDCSIDFTLVNATSLPVGASVRWTVRNRGHEAWTKNDIGHCSGDGYEVSEHSAYNGNHAMDLTVYQWGRIIGRRRIEINVRGTALAARQLPAKRRFRR

SEQ ID NO: 3090 - protein, 468 aa, Sphingobium sp.
MSTAARLFHSKSDQTLYDRITPSTDQFATQQARWNDLADFLKSRMKDDTGYPISTWLQGSYKFDTQIRPLTTGAQFDIDLGLYFEWAGSDDDGDYDPEGFKELIQNALLDYADDEDNDASRVEEPKERCCRIAFNPDFHIDVPCYHLDRTKDRRALATESKGWEASDPKAIYVWFKDLHDDKTIRAQLRRLVCYFKMWAALKIEDEASRPSSITLTVLVAEALSEIDLSETSDDDDVLEGIITIIADRLDDDTEVANPIDNDEDLNRLSDEANDNLRARLREFEDTARRANAATSEATAAEIWTEAFEHFFPMPEDVEGEANANTAARSDIAKNHALVAYSFDPEIHVRAWSQNNENYERFGVNELPTILKDCSIDFTLVNATSLPVGASVRWTVRNRGHEAWTKNDIGHCSGDGYEVSEHSAYNGNHAMDLTVYQWGRIIGRRRIEINVRGTALAARQLPAKRRFRR

SEQ ID NO: 3091 - protein, 424 aa, Sphingobium yanoikuyae
MKDDTGYPISTWLQGSYKFDTQIRPWTTGAQFDIDLGLYFEWAGSDDDGDYDPEGFKELIQNALLDYADDEDNDASGVEEPKERCCRIAFNPDFHIDVPCYHLDRAKDRRALATETKGWEASDPKAIYVWFKDLHDDKAIRAQLRRLVCYFKMWAALKIEDEASRPSSITLTVLVAEALDGIDLSETRDDDDVLAEIITIIADRLDDDTEVENPIDTQENLNRLSDDANDNLRERLREFEDTARRANAATSEATAAEIWTEAFEHFFPMPEDVEGEANATTAARSDIAKNHALVAYSFDPEIHVRAWSQNNENYERFGVNELPTILKDCSIDFTLVNAASLPVGASVRWTVRNRGHEAWTKNDIGHCSGDGYEVSEHSAYNGNHAMDLTVYQWGRIIGRRRIEINVRGTALAARQLPAKRRFRR

SEQ ID NO: 3092 - protein, 451 aa, Sphingobium yanoikuyae
MSTAARLFHSKSDQTLYERITPSTDQFATQQARWNDLADFLKSRMKDDTGYPISTWLQGSYKFDTQIRPWTTGAQFDIDLGLYFEWAGSDDDGDYDPEGFKELIQNALLDYADDEDNDASGVEEPKERCCRIAFNPDFHIDVPCYHLDRAKDRRALATETKGWEASDPKAIYVWFKDLHDDKAIRAQLRRLVCYFKMWAALKIEDEASRPSSITLTVLVAEALDGIDLSETRDDDDVLAEIITIIADRLDDDTEVENPIDTQENLNRLSDDANDNLRERLREFEDTARRANAATSEATAAEIWTEAFEHFFPMPEDVEGEANATTAARSDIAKNHALVAYSFDPEIHVRAWSQNNENYERFGVNELPTILKDCSIDFTLVNAASLPVGASVRWTVRNRGHEAWTKNDIGHCSGDGYEVSEHSAYNGNHAMDLTVYQWGRIIGRRRIEINVR

SEQ ID NO: 3093 - protein, 468 aa, Sphingobium yanoikuyae
MSTAARLFHSKSDQTLYERITPSTDQFATQQARWNDLADFLKSRMKDDTGYPISTWLQGSYKFDTQIRPWTTGAQFDIDLGLYFEWAGSDDDGDYDPEGFKELIQNALLDYADDEDNDASGVEEPKERCCRIAFNPDFHIDVPCYHLDRAKDRRALATETKGWEASDPKAIYVWFKDLHDDKAIRAQLRRLVCYFKMWAALKIEDEASRPSSITLTVLVAEALDGIDLSETRDDDDVLAEIITIIADRLDDDTEVENPIDTQENLNRLSDDANDNLRERLREFEDTARRANAATSEATAAEIWTEAFEHFFPMPEDVEGEANATTAARSDIAKNHALVAYSFDPEIHVRAWSQNNENYERFGVNELPTILKDCSIDFTLVNAASLPVGASVRWTVRNRGHEAWTKNDIGHCSGDGYEVSEHSAYNGNHAMDLTVYQWGRIIGRRRIEINVRGTALAARQLPAKRRFRR

SEQ ID NO: 3094 - protein, 411 aa, Sphingobium yanoikuyae
QGSYKFDTQIRPLTTGAQFDIDLGLYFEWAGSDDDGDYDPEGFKELIQNALLDYADDEDNDASRVEEPKERCCRIAFNPDFHIDVPCYHLDRTKDRRALATESKGWEASDPKAIYVWFKDLHDDKTIRAQLRRLVCYFKMWAALKIEDEASRPSSITLTVLVAEALSEIDLSETSDDDDVLEGIITIIADRLDDDTEVANPIDNDEDLNRLSDEANDNLRARLREFEDTARRANAATSEATAAEIWTEAFEHFFPMPEDVEGEANANTAARSDIAKNHALVAYSFDPEIHVRAWSQNNENYERFGVNELPTILKDCSIDFTLVNATSLPVGASVRWTVRNRGHEAWTKNDIGHCSGDGYEVSEHSAYNGNHAMDLTVYQWGRIIGRRRIEINVRGTALAARQLPAKRRFRR

SEQ ID NO: 3095 - protein, 461 aa, Agrobacterium vitis
MPQSAKLFYQAGSESETLHRRITPTAHQFTAQKDRWNDLAEFFVKRLTEDSGYSIRTWLQGSYKFRTQIRPWVVGAEFDIDLGIYFEWKGEPEDGDHTPGKLKTLVQKALVDYQDDENNDATGVADPKERCCRIVFAPDFHIDVPCYHLDSERDARTLATETKGWEVSDPKQIYEWFKNCQDDVPRKKLRRLIRYLKMWAALRIEEAERPSSILLTVLAAEAFDSFDLDVVVDDDEILEQAATVIADRLDGDPIVPNPVNSHEDVNRLEVGAVVKLVAKLRDLASVGERARLAADISAAAEIWSEAFDQFFPMPEDTEEGMQALAKSQAIAVYAYAPDIVITATPRNNRDVKPIQGFNEIRPVPKDCDINFTIARPDLLPAGCTLKWTVRNHGREAAMENDMGHVAGTGISVERHTAYNGDHAMDLTIFLDGRPVGRRRITVKVRGPAIPPRNPPRRQYGR

SEQ ID NO: 3096 - protein, 461 aa, Rhizobium phaseoli
MSQPAKLFYQAGSESETLHRRITPTPDQFTAQKDRWNDVAEFLVKRLSEDSGYAIRTWLQGSYKFRTQIRPSRGGAEFDIDLGIYFEWNGGPEDGNHTPEELKGFVQNALVDYQGEEDNEATGVAAPKERCCRIAFAPDFHIDVPCYHLDSGRDARSLATETKGWEVSDPKQIYVWFKNCQDDERRKKLRRLIRYLKMWAALRIAETERPSSILLTVLAAEAFNSLDLDVVVDDDDILEQAATLIADRLDDDPTVPNPVNSHEDVNRLEVGAVVKLVAKLRDLASIGERARLAADISAAAEIWSEAFDQFFPMPEDTEEGTQVLAKCQGIAVYAYTPDIIVTATPRDNRDVRPIQGLNEIRPVPKDCDINFTIARPDLLPAGCTLKWTVRNHGLEAAMENDMGHVAGTGVSVERHTAYNGDHAMDLTIFLGGRPVGRRRITVKVRGPAIPPRNPPKRIYGR

SEQ ID NO: 3097 - protein, 248 aa, Tranquillimonas alkanivorans
MGIAAKLFYNPEDRQDTLAYRVRPSDEQIEEQQERWNDLAEVLKNGLRDVFGKPVSSWLQGSYKFGTQIRPARTGEEFDIDLGVYVEWQGSAESGEVKPLELKDRVQSILDDYAADGANDATSVANPKQRCNRICFLGDFHIDVPSYHLDRVADLRDLATQDGERESSDPKAIYVWWKDQFEGSERDRARRLARYLKMWAALTFEAPARPSSILLTVLVADAMKAINSERLSGDDEYFAQWLVRSRKD

SEQ ID NO: 3098 - protein, 462 aa, Paracoccus sp.
MGIAAKLFHNPEDRENSLAYRVRPSDEQVEEQRERWNDLAEVLKEGLRDVFDKPVTSWLQGSYKFGTQIRPARMGEEFDIDLGVYLEWQGSAESGDVEPLEFKDRVQLILEDYAAAEANDAIGTADPKARCNRIHFSGDFHIDVPCYHLDRAADARDLATQDDEWENSDPKAIYVWWKGQFEGGERDRARRMVRYLKMWAALTFENSSRPSSILLSVLAAKAIKAIDTEGLAGDDEYFRAVVDDLERRLRRTVVVRNPVNTSENLNRLTEDDCAAVIDKLSDLLSVADRALDAADEYESADIWSEAFKHFFPFPEEEEEAVAKATADTARNVLAVIRHDPDVHIVATSGKRRWEGLNAIGPIPKGCDIRFTIVDPKALPEGAKVNWTVRNEGAEAEWTNDLGHVAGSGLSNCESSAYRGSHFMDVVVKLNGRIIGQRRVKVQVSALGIPKRNSARPAWTRLR

SEQ ID NO: 3099 - protein, 463 aa, Caulobacter vibrioides
MGNAASLFFSTTTPTECLDWRIRPSDEQYDAQKERWNDLASYLLADLKERSGYTLSSWLQGSYKFGTQVRPPSKFEEFDIDLGVYFNWLGTPFDGGHKPSELKDFVQASLEAYVEDSENDAEGVSAPKPRCNRIHFADNFHIDVPSYHLDRDRDARALATQEDAWEPSDPKAFYGWWKDTISDSDRPRVRRLVRYLKMWAALAFEAEHRPSSIMLTVLAAQGYVTLDVEGFSGDDEYLRAVVNAALSRLRRNPAVANPVDTTENLNRLSKERSDAFVAGLDGLLSTADRALAAPTKSQAADIWAEAFHHFFPVPPEEEMLTEMARALTPVLFVPEVHVEATAPSGPVRTIRGLNSIGPLPKNSSIEFTLANAHELPAGSIVTWTVRNEGKEAEEENDLGHPVGVGLRAEENAAYTGRHFMDVAVRRNGVLVGHRRVPVTIYGLRMPKRNSARPGWVKFRQKRR

SEQ ID NO: 3100 - protein, 461 aa, Bradyrhizobium japonicum
MGIAANLFFNTDDAENCLDWRVRPSDEQYDTQKERWNDLAEHLKQDLAERSDCRISSWLQGSYKFGTQIRPARSDEEFDIDLGVYFLWSGQPEDGDHDPTDLKGFVQDSLTEYVEDDTNDASGVDEPRPKCSRVHFDGNFHIDVPSYHLDNGRDARSLATAKNEWENSDPKAIYAWWKVITGHADRARCRRLVRYLKMWAALRIDADARPSSILITVLVADAFDNLDRDQFSGDDEFLRETVANIASRLRDDAEVQNPANKKENLNRLDEEKSTALIEKLDELLSTADRALAAATKAASAEIWAEAFDHFFPVPEDDDQEETVLKESSRALATIQFNPIISVEAFVGNRVFRGVDRIGPIPKGCDIMFTLANAQQLPRGATVDWMVRNSGKEAELENDLGHRIGTGLTASRDSAYRGTHHMDVAVKLNGLLIGRKRIPVEITGLGIPKRNPSRPAWTQFRR

SEQ ID NO: 3101 - protein, 465 aa, Bradyrhizobium liaoningense
MGIAASLFFNTDEPENCLDWRVRPSDEQYDTQKERWNDLAVYLRDDLAKRSGCTIAWWLQGSYKFGTQIRPAGPDEEFDIDVGIYFQWSGEPEDGEHGPLDLKTFVQDSLVSYCDDAGNDASEVEDPPKARCSRVHFEDSFHIDVPSYHLDSDRDARALATADDKWEVSDPKAIYGWWKDAIKQADRPRCRRLVRYFKMWAALRFEESSRPSSILLTVLVGEAFQGLEKDDLSGDDEFLTATLRLVVDRLQRSFIVKNPANNNENLNRLPDEHCSSLLDKLEEFLAIAERGLVATTKTAASDAWSEAFDQFFPVPKEDDEEEALLKTAQSRALATLTFNPVVNVTATIGSRTFTDVDGIGPIPKGCEITFTLANAHALPRGAEVRWMVRNSGREAEEVNDLGHRAGDGISTSRDSAYRGDHYMDVSVRLNGRLIGSKRVKVIVSGLGLPKRNPPRPFWTTLRRKR

SEQ ID NO: 3102 - protein, 465 aa, Bradyrhizobium sp.
MGIAASLFFNTDEPEICLDWRVRPSGEQYNTQQERWNDLAIYLRDDLAKRSGCAIAWWLQGSYKFGTQIRPASPDEEFDIDVGIYFRWAGEPNDGEHSPLDLKTFVQESLVRYCDDDGNDASEVEDPPKARCSRVHFDDSFHIDVPSYHLDSDRDARALATAENEWENSDPKAIYEWWKDAIPQSDRPRCRRLVRYFKMWAALRFGEGSRPSSILLTVLVGEAFEELDKDKLSGDDEFLAATLRVVVDRLQQSAIVKNPANKEENLNRLSQEDSSSLLDKLEGFLSIAERGLVTTTKTAAADVWSEAFDQFFPIPEEDDEEEAVLKAAQNRALATLIFNPLVNVTATVGSRTFTGVDGIGPIPKGCEITFTLANAHALPPGAEVRWMVRNSGRGAEEVNDLGHRAGEGISTSRDSAYHGDHYMDVSVRLNGRLIGSKRVKVLVSGLGLPKRNPPRPAWTTLRKRR

SEQ ID NO: 3103 - protein, 463 aa, Bradyrhizobium erythrophlei
MGIAASLFYSTSDTENCLDWRVRPSDEQYDAQKERWNDLADYLRDDLAERSDCSIASWLQGSYKFGTQVRPAGPEQEFDIDLGVYFRWSGEPEDSDHDASDLKKMVQASLKDYSSNDDNDAASVGEPRAKCSRVHFDDGFHIDVPAYHLDGTRDARALATAENKWEDSDPKAIYNWWKDTTGDADRARCRRLVRYFKMWTALRFEEEARPSSILLTILVAEAFQQLDKGNFTGDDEFLREITQEIVNRLNGSYRVPNPANTEENLNRLSSDNCSAFVGKLEDLLAIADRALAAQTKTASAEVWSEAFDHFFPVPAAGDEEEAVLKIAESRSLATLKFDPIVNVRATNRGRVFTGLDGIGPIPKGCEIKFTLANYQALPAGATVSWMVRNSGKEAEDINDLGHRAGEGISVARDSAYRGTHFMDVAIKLNGLLIGSKRIPVTVTGLGMPPRNLPRPAWTKLRRQ

SEQ ID NO: 3104 - protein, 464 aa, Methylocystis sp.
MGSAATLFFNANDSEKQTLHRRITPSDEQFEEQQERWNVLADHLTSDLKERSGHSIRTWLQGSYKFGTQIRPVHVGHEFDIDLGIYYQWEGEPEEGAHGPCTLKSFVQNSLKDYARDNADSVLEVCPPKTRCCRIRYNNSFHIDVPAYHLDPDRDARTLATEERWEGSDPKAIYVWFKDQFEDAIRARVRRQIKYLKSWAALKFDEDGRPSSILLTVLVADAAKSIGAAGIVADDDTLRNILESLVARLDGDKHVPNPVSETENLARLSDTEMKSFIERLKGLLEVANRAVASSTELAAADVWQEAFEHLFPMPAVTEVLTEAARLLPVPLTMPEIRVTAISRDNAALGKYNGVNKIGPIPRNCDIRFEIINGHALPRGAQIFWIVRNEGREAENINDLGHLAGTGLVSTEHSAYRGTHYMDCVVKVAGQTVALRRVPVDITGRELPRRNPLQRPDWVRLRGRR

SEQ ID NO: 3105 - protein, 462 aa, Devosia sp.
MGSASSLFYSSNDKEKQTLHRRITPSSEQFEEQQERWNALADHLTTDLRERSGHSIRTWLQGSYKFGTQTRPVRLGEEFDIDLGVYYVWKGSRDDGYHDPQTLKGFVRDSLVAYAADNPDDVLEVAPSKPRCERIRFKGDFHIDVPAYHLESDLDARSLATRDGWEDSDPKAIYIWFRDSFDDIERAKVRRQIRYLKAWVALKFAETDRPSSILLTVLIAEAARDLGQLLADDEAMRDLVEHITERLEDDWQVPNPVDPDENLVRMSSQQMQVFTRALSDLLDVASRACEAETDFAAADIWQEAFEHLFPMPEGQQALVEMARWLPVRSVMPEIRVTAVSRNNPQGGRFTDMNRIGPIPKDCDIYFEVVNPGQLPANSSVAWMVRNEGGEAENTNDLGHFAGLGLTANERSAYRGTHYMDCVVKVGSQTVAMRRVPVTITGIAMPRRNPAAKPDYVRLRGRK

SEQ ID NO: 3106 - protein, 462 aa, Unknown
  Description of Unknown: Ochrobactrum sequence
MGSASSLFYSSNDKEKQTLHRRITPSSEQFEEQQERWNALADHLTTDLRERSGYSIRTWLQGSYKFGTQTRPVRLGEEFDIDLGIYYVWKGSRDDGDHDPQTLKGFVRDSLVAYAADNPDDVLEVAPSKPRCERIRFKGDFHIDVPAYHLEPDLDARSLATRDGWEDSDPKAIYIWFRDSFDDIERAKVRRQIRYLKAWVALKFAETDRPSSILLTVLIAEAARDLGQLLADDEAMRDLVEHITERLEDDWQVPNPVDPDENLVRMSSQQMQVFTRALSDLLDVASRACEAETDFAAADIWQEAFEHLFPMPEGQQALVEMARWLPVRSVMPEIRVTAVSRNNPQGGRFTDMNRIGPIPKDCDIYFEVVNPGQLPANSSVAWMVRNEGGEAENTNDLGHFAGLGLTANERSAYRGTHYMDCVVKIGSQTVAMRRVPVTITGIAMPRRNPAARPDYVRLRGRK

SEQ ID NO: 3107 - protein, 450 aa, Unknown
  Description of Unknown: Nostocales sequence
MGITASLFYNSSTEKQTLHRRITPSNEQKEAQKQRWNELADYLKAELKIISGYSIYSWLQGSYKFKTQLRPLFNGDEFDIDLGIYFQWQGEPHDGEFSPLQLKKMVQECMEAYRQHQNDIKKVASPKMRCNRIHYEGDFHIDVPTYHLDNSRDARALATEEDEWEESDPKAIYVWFKQQFPDEDIRHNVRRLIRYLKAWGILNLKEGEGKPSAILLTVLVTESYELLSEEERSSDDNALTGILRLILARLTQDSTVYNPVNHAEIMSDRLGKNGITALKKHIEQFATLAQQALNAKTEVEAADIWSTVYKHFFPLPEAREEIVKFSESRQDSLLRQVFTPTIFVTAERKKPLSQRTNNWSGIDSIGPIPKNCSITFKLVNTSSLPPYVTVEWTVRNEGAEAEIENDLGHPAGRGHSATENSAYKGVHYMDCVLRQYGRIIGVKRVKVVIN

SEQ ID NO: 3108 - protein, 328 aa, Bacteroidia bacterium
MANNQEQFNAFHDTINATKKRRSTLKTNRDALRDRVRKYFKNNHADYIQPNFYWQGSYAMHTILTPIKDENGLGAYDLDDGIYFVGKSEDERKDLEWYHKEVLKAVENHTTRGAEDNAPCVTVLYADGHHIDLPIYFMVDGDEHPRLAHRKDPWMDSDPRELIDWFCEECGEKPMLRRLVRYLKAWCEYINNEKDFKMPTGCIMTMLAAEYYNDNVDSREDIAMRDLLTAMHDALSEDNGFHCWRPTHPYEDLFEYYKKTRKDKFLAELKSFKDDATRAIESKNPHEACIKWQKHFGNRFSCSTAKDEDEDAQTKSFSGTLKTNSRFA

SEQ ID NO: 3109 - protein, 326 aa, Unknown
  Description of Unknown: Bacteroidales sequence
MANNHEQFIAFNDTIKASKSRRDTLKKNRESIRKKIRNYFKNNWPDKIQPQFHWQGSYSMYTLLNPIKDEDGLGAYDLDDGIYFIGSSEDERETVQWYHNQIYEAVKDHTTQGAKDNNPCVTVYFADNHHIDLPAYFMVDGDEHPKMAHKKNPWMDSDPRETTNWFNGKSEHPQLRRIVRYVKAWADYVNNQGKGKMPTGCILTILVEKNFTSNDRDDIALRDVLVKMNNSLSAKDGFHCYRPTFPVGEDLFEHYKTSRKDFFLKELNSFASDADKAVNSSNQKDGCLKWQNHLGERFSCSTAKDEDEDAQKKNLSGTLKTNSRFA

SEQ ID NO: 3110 - protein, 322 aa, Unknown
  Description of Unknown: Parabacteroides sequence
MANNHEQFIAFNKTINSNKRATLKKNRDALRERIKNYFSREYPDEIQPKFHWQGSYAMHTILNPLKDENNLGVYDLDDGVYFIGKSEDERHSVQWYHDRIYEAVDGHTSIKPDDNKPCITVNYGDGHHIDLPIYFMVEGDKHPLLAHKTKSWLDTDPRELLNWFNGRDEHPQLRRIVRYLKAWCEYIRFKKEIKMPTGCSLTMLAVKNFKSNERDDIAMKNILVAIHNSLSSKFECLRPTFPKNEDLFEEYSETRKNNFMQELKSFRGDAERAIESKNPHEACMKWQKHFGDRFSCSTAKDEDEDAQTKSFSGTINTNSRFA

SEQ ID NO: 3111 - protein, 325 aa, Bacteroides sp.
MANNHDQFIAFDKAITASSSRRDTLKTNRDALRKKIRKHFKDNWPDKPQPSFYWQGSYAMFTLLSPITDESGLGAYDLDDGIYFIGKEDERETIEWYHQEIFKAVKTHTKQGAKDNKPCVTVYYADGHHIDLPAYFWAEKEDHPQLAHKSSDWTDSDPRELSDWFKGRSEHPQLRRVVRYLKAWADYVDDSTSKKMPTGCALMMLAVEHYKANDRDDIVLRDILVSMHESLSKEDGFHCYRPTFPKNEDLFDGYSATRKKDFLAELKSFKEDAERAVNSKNPHDACLKWQNHFGDRFCCSTAKDEDEDAERQSTSGILTNNNRFA

SEQ ID NO: 3112 - protein, 327 aa, Prevotella sp.
MANNHEQFMAFHDAIKATSTRRKTLKTNRDALRSKIKKYFKDTHSDYIQPTFYWQGSYAMCTLLNPIKDESGLGAYDLDDGIYFESDDINDRKSIDWYHQEVYKAVKDHTENGADDLDPCVRVQYADGHHIDLAIYFLHTTEDKTMLAHRAEPWHESNPDEMIDWFKDECNNKTKMRELVRFMKAWCEYKRNEGIKMPSGCIMSMLTSKYYQWNDENRYDIAMRDILKNMYDDLSIEDYFHCWRPVSPYEDLFDNYTKGRKVSFLKELKSFKEDAERAIASKNQHDGCVRWQKHFGDRFSCSTAKDIDEDASQQRFSGTINKNSQYA

SEQ ID NO: 3113 - protein, 327 aa, Prevotella enoeca
MANNHEQFVAFQNAIKATSTRRKTLKTNRDALRAKIKKYFKETHRDYIQPTFYWQGSYAMCTLLNPIKDESGLGAYDLDDGIYFESDDINDRKSIDWYHQEVYEAVKDHTENGADDLDPCVRVQYADGHHIDLAIYFLHTTEDKTMLAHRAEPWHESNPDEMIDWFKDECNNKTKMRELVRFMKAWCEYKRNEGIKMPSGCIMSMLTSKYYQWNDENRYDIAMKDILKNMYDDLSIEDHFHCWRPVNPYEDLFDNYTKGRKDSFLKELKSFKEDAERAIASKNQHDGCVRWQKHFGDRFSCSTAKDIDEDTSQQRFSGTINKNSQYA

SEQ ID NO: 3114 - protein, 327 aa, Bacteroides vulgatus
MANNHEQFKAFHDVIKAISTRRKTLKTNRDALRAKIRKYFKDNHSDYIQPTFYWQGSYAMHTLLNPIKDENGLGAYDLDDGIYFESDNINDRKSINWYHREVYEAVKDHTINGADDINPCVRVQYADGHHIDLAIYFLDTANDKTMLAHRAEPWHESNPDEMIDWFSKECNDKTKLRELVRFMKAWCENKRNEGTKMPSGCIMSMLVSKHYQWNDENRYDVAMRDILKNIYDELSIEGNFHCWRPVAPYEDLFDNYTKSKKDAFLKELKSFKEDAEKAIASKNQHDGCVRWQKHFGDRFSCSTAKDVDEDASQQRFSGTINKNSQYA

SEQ ID NO: 3115 - protein, 327 aa, Prevotella ruminicola
MANNHEQFKAFHDSIKATATRRNTLKKNRDALRDKIKKYFKENHSDYIQPTFFWQGSYAMHTLLNPIKDEDGLGAYDLDDGIYFESDDINDRKSIEWYHNEVYEAVKDHTDNGAEDLKPCVRVQYADGHHIDLAIYFLYTEEDKTMLAHKAEPWHESNPDEMIAWFSDECKSKTKFRELVRFMKAWCEYKRSEGVKMPSGCIMSMLTSEYYQWNDENRYDIAMRDILKNMYDDLSKDGHFHCWRPVAPGEDLFDNYTKSRKDTFLKELKSFKEDAEKAIESKNPHDACIRWQAHFGDRFSCSTAKDEDEDASKKEFSGKMRYNSQYA

SEQ ID NO: 3116 - protein, 339 aa, Bdellovibrionales bacterium
MSIQQYFTRFHKEIKVETEELREKRDILVEKIRASLKKAGQPLPVALNQGSYIYGVGVKPLGDIEYDIDVGLDFPIQAFDYEAKTVRKWVYDAIADHTKNVEDRGPCIRVRYAAGYHVDLVVYARFKDQDDVENYQLAHKDGSWKPAEPKKLKDYISDARKPFVGTKDSSGSDQLQRLTRYLKRWNDIDIPDDSPDKPFGLATLLLVINKLNTPFLDQNGDSNDLEALIAVACAVKNTYGRVSIRKPTQEFEDVFAKLSDKAMERLKSRFGSLLSDLESARYKSDDDAAKILRRQFGSDFPESLRKFEDSSTDSRVHAIRDMEAAAPAFINPSKPWCRW

SEQ ID NO: 3117 - protein, 336 aa, Legionella pneumophila
MSIQALFETFHKKIKVETDELRDKRDILSAKIKSSINKNGHPTPDIINQGSYIYGVGIKPLNDQEYDIDVGFIFPIHAQNHTPTKVRAWVYDAIKQHTNSVEDRGPCIRVRYAAGFHVDLVIYAKYYNSDNENYQLARNNDTWVPSQPKELKSHIVDARQRFIETRDSTGADQIQRITRYLKRWNDLDIPDDSPNKPSGLATLLLVINSLPAPVMDNNGKSNDLESLILIAQQVTHSLGRIVVKKPTIPYEDLYEKLDDKAMHHLKKRFSSLLSDLEACRKISLTDAVSLLAIQFGSDFPTNFNNSQPEANNTSDLIEDMKKAIPTFKNPAKPWSN

SEQ ID NO: 3118 - protein, 336 aa, Legionella pneumophila
MSIQALFEIFHKKIKVETDELRDKRDILSTKIKSSINKNGHPTPDIINQGSYIYGVGIKPLNDQEYDIDVGFIFPIHAQNHTPTKVRAWVYDAIKQHTNSVEDRGPCIRVRYAAGFHVDLVIYAKYYNSDIENYQLARNNDTWVPSQPKELKSHIVDARQRFIETRDSTGADQIQRITRYLKRWNDLDIPDDSPNKPSGLATLLLVINSLPAPVMDNNGKSNDLEALILIAQQVTHSLGRIVVKKPTIPYEDLYEKLDDKAMHHLKKRFSSLLSDLEACRKISLTDAVSLLAIQFGSDFPTNFNNSQPEANNTSDLIEDMKKAIPTFKNPAKPWSN

SEQ ID NO: 3119 - protein, 340 aa, Legionella drozanskii
MSIQKQLELFHQKIKVDTETLREKRDILINKIKQSLKASGHSTCDTINQGSYIYGVGVIPLGSQEYDIDVGLVFPIRAIDYKPKNVKNWVYEAVKNHTSNVEDRGSCIRVRYTAGYHVDLVVYAQFYDDVNHENYQLARKDGTWNQSDPKTLKKYIENARQNFISTKDRSGADQIQRVTRYFKRWNDLVIAKESPDKPTGLAMLLLVIQYLSAPCINDVGASEDIGALLLIAREISRLSGRIIINKPTPQYEDVFSKLDEQAMIQLKERFRLLQEDLEQISNMSEMNAINVMAKHFGDDFSKIIQPQAKQLTNEELKAADILDMEKAIPSYKNPAKPWAQ

SEQ ID NO: 3120 - protein, 327 aa, Elusimicrobia bacterium
MANVQKQFEEFHNKIRVDDYDSLREKRDIVLKRLRKHLKENKRPGFDELLQGSYAMGVGITPIKELEYDMDIGLRFEINYQDYNAAEISKWVYEGVEDHTDKVEQKGPCIRVTYAQGGYHLDLVCYAWEKNSNSGIFKLAHKTKGWKPADPPGLLEFVEKTRKPFDIAKDSATQTDQFRRSVRYLKRWNDEAIPRESDTKPTGLSFILLCAEHLSPTVAASGQSDDLTALRNFALLMANTTGRLVAKKPTPEYEDILAKLPDAEMNALKSRFESLVKILGNAAKETDPIKACELLQTVFGKDFPVPTAEETAARTSAPAIITSSSSA

SEQ ID NO: 3121 - protein, 327 aa, Elusimicrobia bacterium
MQKQFEEYHDKIRIDFDMSQPLRDKRDIIVKRIKKYLADKELPSFEKLDQGSYAYGTGIKPIAKLQYDIDVALRFEISSTKYSAVTVRGWVHDAVQGHTEDVDDRGPCTRVTYAEKDYHVDLVSYAWQKSNGTETFQLAHKTTGWRPANPPEILAYVAGIRKPFLNITDDAATKTDQFRRAVRSLKRWNDEAIPTESDDKSTGLAFVLLCAQHLKVTLSADGKPDDLRALLNVASAAAQTVGRIVLKKPTPEYDDVMAKLSNKAMDELKSRFAELAKVLEKAGKEPDPVVACKLLRKVFGEDFPVPVAEETAKKTAAPAIITSSSSA

SEQ ID NO: 3122 - protein, 463 aa, Elusimicrobia bacterium
MAYIQNYLEQFHEKIRMDYELNSILAEKRDIILNRIRDYLKDKGKPSFQEMLQGSYIMKTGVKPIENLGYDIDVALRLSINENDYTASEVRGWIYDAVKDHTEKVVSKGPCIRVIYKDGYHVDLVTYAVHENIFKETVFKLAHKQNGWKDANPQGLLDYVDNIMTQFKDTEDSATKTNQFRRLVRYIRRWDDESLPIESGAKPSGLAYILLVNNLLNSKVINDNKSDDLSALIQICNGAGLISGRISIKKPTPEYEDVFGKINNDDMDGLKNRLKALAVILEQVDAESDEIKACQLMKKHFGRDFPIPEAKKSNSFETIGSFLRNSLEKTKSIFAVSHRKQPKWSVNIEGRANITASYICKGFRPQQFQSDGDPLPKKCSLQFKADTNVSWPYEVYWQVVNTGDEAELANSLRGDFYDGEYERAGRFVRKESTLYKGKHWVECFVVKDGICLARSGEFVVNIQ

SEQ ID NO: 3123 - protein, 235 aa, Psychrobacter sp.
MADLQTQFLAFHAEIKLGTYEGKHANGVLREKRDLIINQLKASLKAKEEEGYPQFVKRFNQGSYALNTGIKPIRTGDYDIDVGVLLDCHKEEYKPVELKELVAECIQYTNRDVNVSRSCVTVTYMKDGEPDYHVDLPIYAKSNNEYDDTYYLAKGKKGLTEDKRFWQESDPEGMTSLINDLYKDNDIYEDNGSDQRKQFRRCDPCRQIRTVKLGRFESSSLTIIVKPHLSWRLIA

SEQ ID NO: 3124 - protein, 235 aa, Psychrobacter sp.; identical to SEQ ID NO: 3123

SEQ ID NO: 3125 - protein, 340 aa, Psychrobacter sp.
MADLQKQFLEFHNAIKLGTYEENDFLREKRDLIIDKLKSKLAERKDDGYPQYERSFNQGSYALNTGIKPVRTGDYDIDVGVLLDCHKEDYKPVELKELVADCIKHNNRTVEVSRSCVTVTYMKDGKPDYHVDLPIYAKSSNVYDDTYYLAKGRKGLAEAKRVWQAADPEGINSIINGLYKGNDTYEDNGSDQRKQFRRCVRYLKRWRHHKSVEIHSIGLTMAAYHWLEPGVDTQNDGEVLLELVETILSNFDYFGRLSINLPITPGGDLLKSVSDEDMAIIKERFETLRDNLQSAVNEPDAHEASKTLRKIFGDDFPVVDKTDKAKKSNEAPYVSTGSSA

SEQ ID NO: 3126 - protein, 337 aa, Unknown
  Description of Unknown: Acinetobacter sequence
MANPQKHYAKFHTNIRLGRYDEESTLREKRDLLISTLKDELKKDPNGPQFVEYFNQGSYALGTGIKPKNGDYDIDVGVLLDCDKEEYGSVEIKKIVRDALTHSNRTVTIKRPCVTVTYLKNGSPDYHVDLPIYAEDDKGNMYLARGKEFSSEDLKTWDISNPTELTDTILGKFEDDSDLRHQFRRCTRYLKQWRNEKGLDFFKSIAITTAVYEHITAEDYENDNKVLLSIVNNVLDQFTTFSIDPENNEYYFRLVINLPAHQGVDLLEKLTRKQMEHLKSKLEDLKSSLEAVNEETDTVEACKILNKTFGRQFPIPEIQEVSEPVVQTYYTQEGKSA

SEQ ID NO: 3127 - protein, 337 aa, Acinetobacter sp.
MANPQKHYAKFHTNIRLGRYDEESTLREKRDLLISTLKDELKKDPNGPQFVEYFNQGSYALGTGIKPKNGDYDIDVGVLLDCDKEEYGSVEIKKIVRDTLTHSNRTVTIKRPCVTVTYLKNGSPDYHVDLPIYAEDDKGNMYLARGKEFSSEDLKTWDISNPTELTDTILGKFEDDSDLRHQFRRCTRYLKQWRNEKGLDFFKSIAITTAVYEHITAEDYENDNKVLLSIVNNVLDQFTTFSIDPENNEYYFRLVINLPAHQGVDLLEKLTRKQMEHLKSKLEDLKSSLEAVNEETDTVEACKILNKTFGSQFPIPEIQEVSEPVVQTYYTQEGKSA

SEQ ID NO: 3128 - protein, 360 aa, Acinetobacter lwoffii
MANPQKHYAKFHTNIRLGRYDEESTLREKRDLLISTLKDELKKDPNGPQFVEYFNQGSYALGTGIKPKNGDYDIDVGVLLDCDKEEYGSVEIKKIVRDALTHSNRTVTIKRPCVTVTYLKNGSPDYHVDLPIYAEDDKGNMYLARGKEFSSEDLKTWDISNPTELTDTILGKFEDDSDLRHQFRRCTRYLKQWRNEKGLDFFKSIAITTAVYEHITAEDYENDNKVLLSIVNNVLDQFTTFSIDPENNEYYFRLVINLPAHQGVDLLEKLTRKQMEHLKSKLEDLKSSLEAVNEETDTVEACKILNKTFGSQFPIPEIQEVSEPVVQTYYTQEALLHKDLKCKAPLIEPNLRRNLGKWST

SEQ ID NO: 3129 - protein, 337 aa, Acinetobacter sp.
MANPQKHYAKFHTNIRLGRYDEESTLREKRDLLISTLKDELKKDPNGPQFVEYFNQGSYALGTGIKPKNGDYDIDVGVLLDCDKEEYGSVEIKKIVRDALTHSNRTVTIKRPCVTVTYLKNGSPDYHVDLPIYAEDDKGNMYLARGKEFSSEDLKTWDISNPTELTDTILGKFEDDSDLRHQFRRCTRYLKQWRNEKGLDFFKSIAITTAVYEHITAEDYENDNKVLLSIVNNVLDQFTTFSIDPENNEYYFRLVINLPAHQGVDLLEKLTRKQMEHLKSKLEDLKSSLEAVNEETDTVEACKILNKTFGSQFPIPEIQEVSEPVVQTYYTQEGKSA

SEQ ID NO: 3130 - protein, 296 aa, Acinetobacter baumannii
KKDPNGPQFVEYFNQGSYALGTGIKPKNGDYDIDVGVLLDCDKEEYGSVEIKKIVRDALTHSNRTVTIKRPCVTVTYLKNGSPDYHVDLPIYAEDDKGNMYLARGKEFSSEDLKTWDISNPTELTDTILGKFEDDSDLRHQFRRCTRYLKQWRNEKGLDFFKSIAITTAVYEHITAEDYENDNKVLLSIVNNVLDQFTTFSIDPENNEYYFRLVINLPAHQGVDLLEKLTRKQMEHLKSKLEDLKSSLEAVNEETDTVEACKILNKTFGRQFPIPEIQEVSEPVVQTYYTQEGKSA

SEQ ID NO: 3131 - protein, 337 aa, Acinetobacter baumannii
MANPQKHYAKFHTNIRLGRYDEESTLREKRDLLISTLKDELKKDPNGPQFVKYFNQGSYALGTGIKPKNGDYDIDVGVLLDCHNEEYGSVEIKKIIRDALTHTNRTVTIKRPCVTVTYLKNGTPDYHVDLPIYTEDDKGNMYLARGKEFSSEDLKIWDISNPNELTNTILGKFEDDSDLRHQFRRCTRYLKQWRNKKGLDFFKSIAITSAVYEHIIDDDYENDNKVLLSIVNKLLNEFIHFSIDPETSDSYFRLVINLPAHEGVDLLEKLTKKQMEYLKSKIEDLKYSLEAVNEELDTLEACKILNTTFGTEFPIPEIHEVSEPVTQTYYTQEGKSA

SEQ ID NO: 3132 - protein, 337 aa, Acinetobacter rudis
MANPQKHYAKFHTNIRLGRYDEESTLREKRDLLISALKDELKKDPNGPQFVEYFNQGSYALGTGIKPRNGDYDIDVGVLLDCDKEEYGSVEIKKIVRDALTHRNRTVTIKRPCVTVTYLKNGIPDYHVDLPIYTEDDKGNMYLARGKEFSSEDLKTWDISNPNELTNTILGKFEDDSDLRLQFRRCTRYLKQWRNEKGLDYFKSIAITSAVYEHITDEDYDNDNKVLLSIVNKLLNEFIHFSIDPETSEPYFRLVINLPAHEGVDLLEKLTKNQMEYLKSKIEDLKSSLEAVNEELDTLEACKILNKTFGTEFPIPEIHEVSEPVTQTYYTQEGKSA

SEQ ID NO: 3133 - protein, 337 aa, Acinetobacter baumannii
MANPQKHYAKFHTNIRLGRYDEESTLREKRDLLISTLKDELKKDPNGPQFVEYFNQGSYALGTGIKPKNGDYDIDVGVLLDCDKEEYGSVEIKKIVRDALTHTNRTVTIKRPCVTVTYLKNGTPDYHVDLPIYTEDDKGNMYLARGKEFSSEDLKTWDISNPNELINTILGKFEDDSDLRLQFRRCTRYLKQWRNEKGLDFFKSIAITSAVYEHITGEDYDNDNKVLLSIVNKLLNEFIHFSIDSETSEPYFRLVINLPAHEGVDLIEKLTKKQMEYLKSKIEDLKSSLEAVNEEPDTLEACKILNTTFGTEFPIPEIHEVSEPVTQTYYTQEGKSA

SEQ ID NO: 3134 - protein, 308 aa, Vibrio vulnificus
MLRDKRDLLINELKESLRDEKIPNTEKKLTFSKIDQGSYSMHTGVKPLDDDYDIDVGVIFDINTDDYDSKELKKLVRDKLDKQSNRDVSYNRPCVSVNYTAGYHVDIPVYAKNGGNIHIAWGKETSSEHVWYESDPEGLKQWVKDVSNDSEQRAQFRRCVRYLKRWKNNKFTSNGNTAPPSIGLTIQARTSFIFKKEDDLSCLVGMAKGIRDSFTSSFSIDDMKFYQVVDVALPVAPYKNVYYKMTKKQLDNFYRKIDELVEALEAAQVEESLSECSKILNKVFGDFPEISDAVKSNKQPYLPTGMSA

SEQ ID NO: 3135 - protein, 332 aa, Vibrio vulnificus
MADIQKAFIDYHDQIKLGTYDENQTLRDKRDLLINELKESLRDEKIPNTEKKLTFSKIDQGSYSMHTGVKPLDDDYDIDVGVIFDINTDDYDSKELKKLVRDKLDKQNNRDVSYNRPCVSVNYTAGYHVDIPVYAKNGGNIHIAWGKETSSEHVWYESDPEGLKQWVKDVSNDSEQRAQFRRCVRYLKRWKNNKFTSNGNTAPPSIGLTIQARTSFIFKKEDDLSCLVGMAKGIRDSFTSSFSIDDMKFYQVVDVALPVAPYKNVYYKMTKKQLDNFYRKIDELVEALEAAQVEESLSECSKILNKVFGDFPEISDAVKSNKQPYLPTGMSA

SEQ ID NO: 3136 - protein, 332 aa, Vibrio vulnificus
MADIQKAFIDYHDQIKLGTYDENQMLRDKRDLLINELKESLRDEKIPNTEKKLTFSKIDQGSYSMHTGVKPLDDDYDIDVGVIFDINTDDYDSKELKKLVRDKLDKQSNRDVSYNRPCVSVNYTAGYHVDIPVYAKNGGNIHIAWGKETSSEHVWYESDPEGLKQWVKDVSNDSEQRAQFRRCVRYLKRWKNNKFTSNGNTAPPSIGLTIQARTSFIFKKEDDLSCLVGMAKGIRDSFTSSFSIDDMKFYQVVDVALPVAPYKNVYYKMTKKQLDNFYRKIDELVEALEAAQVEESLSECSKILNKVFGDFPEISDAVKSNKQPYLPTGMSA

SEQ ID NO: 3137 - protein, 332 aa, Vibrio cyclitrophicus
MADIQKAFIDYHDQIKLGTYDENQTLRDKRDLLINELKESLRDKKIPNTEKKLTFSKIDQGSYSMHTGVKPLDDDYDIDVGVIFDINTDDYDSKALKKLVRDKLDKQNNRDVLYNRPCVSVNYAAGYHVDIPVYAKNGGNMHIAWGKETSSEHVWYESDPEGLKQWVKDVSNDCEQRAQFRRCVRYLKRWKNKKLTSNGNTAPPSIGLTIQARTSFVFKKEDDLSCLVGMAKGIRDSFTSSFSNDDMKFYQVVDVALPVTPYKNVYYKMTNKQLDNFYRKIDELVEALEAAQVEESLSECSQILNKVFGDFPEISDAVKSNKQPYLPTGMSA

SEQ ID NO: 3138 - protein, 332 aa, Vibrio sp.
MAEIQKAFIDYHDQIKLGTYDENQTLRDKRDLLINELKESLRDEKIPNTEKKLTFSKIDQGSYSMHTGVKPLDDDYDIDVGVIFDINTDDYDSKALKKLVQNKLDKQNNRDVLYNRPCVSVNYAAGYHVDIPVYAKNGGNMHIAWGKETSSEHVWYESDPEGLKQWVKDVSNDSEQRAQFRRCVRYLKRWKNKKFTSNGNTAPPSIGLTIQARTCFVFKKEDDLSCLIGMAKGIRDSFTSSFSIDDMKFYKVVDVPLPVAPSKNVYYKMTKKQLDNYYNKVDELVEALEAVKEEESLSESSKILNKVFGDFPVISDAVKSNKQPYLPTGMSA

SEQ ID NO: 3139 - protein, 332 aa, Vibrio alginolyticus
MADIQKAFIDYHDQIRLGTYDENQTLRDKRDLLINELKESLSDEKIPNTEKKLTFSKIDQGSYSMHTGVKPLDDDYDIDVGVIFDINTDDYDSKELKKLVRDKLNKQNNRDVSYNRPCVSVNYAAGYHVDIPVYAKNGGNIHIAWGKETSSEHVWYVSDPEGLKQWVKDVSNDCEQRAQFRRCVRYLKRWKNNKFTSNGNTAPPSIGLTIQARNSFVFKKEDDLSCLVGMAKGIRDSFTSSFSIDDMTLYQVVDVALPVAPYKNVYYKMTKKQLDNFYRKIDELVEALEAAQVEDSLSECSKILNKVFGDFPEISDAVQSNKQPYLPTGMSA

SEQ ID NO: 3140 - protein, 332 aa, Vibrio vulnificus
MADIQKAFLDYHDQIKLGTYDENQTLRDKRDLLINELKESLRDEKIPNTEKKLTFSKIDQGSYSMNTGVKPLNDDYDIDVGVVFDINTDDYDSRALKKLVRDKLDKQHNRKVSYNRPCVSVNYAAGYHVDLPVYAKNGGNFHIAWGKETSSEHVWYESDPEGLKQWIKDVSNDSEQRAQFRRCVRYFKRWKNKNFTSNGNTAPPSIGLTIQARTSFVYKKEDDLSCLIGIAKSIRDSFTSSFSIDDMKFYKVVDVPLPVAPGKNVYYKMTKKQLDNYYNKVDELVEALEAAQEEESLSESSKILNKVFGDFPVISDAVKSNKQPYLPTGMSA

SEQ ID NO: 3141 - protein, 332 aa, Unknown
  Description of Unknown: Pseudoalteromonas sequence
MADIQKAFIDYHDQIKLGTYDENKALRDKRDLLINGLKESLRDEKIPNTEKKLTFSKIDQGSYSMHTGVKPLDDDYDIDVGVIFDINTDDYDSKKLKKLVRDKLDKQNNRNVSYNRPCISVNYAAGYHVDIPVYAKNGGNIHIAWGKETSSEHVWYESDPEGLKQWVKDVSNDGEQRAQFRRCVRYLKRWKNKNFTSNGNTAPPSIGLTIQAKTSFVYKKEDDLSCLIGIAKSIRDSFTLSFSVDDMKFYKVVDVPLPVAPGKNVYYKMTKKQLDNYYNKVDELVEALEAAQEEESLSESSTILNKVFGDFPVISDAVKSNKQPYLPTGMSA

SEQ ID NO: 3142 - protein, 332 aa, Vibrio campbellii
MADVQKAFLDYHDQIKLGTYEENQTLRDKRDLLINELNESLSDERVPNTNQKLTFSKIDQGSYAMHTGVKPLDGDYDIDVGVVFDISIEDYDSRALKKLVRNKLNKQHNRSVSYNRPCISVNYANGYHVDLPVYAKNNGNLHIAWGKETSSEHVWYESDPDGLKQWVKNVSDDAEQRAQFRRCVRYLKRWKNNKFLSIGNVAPPSIGLTIQARNAFVYKSEDDLSCLIGIAKSIRDSFTSSLSIEDLTFYQVVEAPLPVAPYKNVYYKMTKKQLDNYYNKIDELVEALEAANQEESLAESTKILNKVFGDFPVITDAVKSSKQPYLPTGMSA

SEQ ID NO: 3143 - protein, 332 aa, Vibrio crassostreae
MADVQKAFLDYHDQIKLGTYEENQTLRDKRDLLINELNESLSDEKVPNTNQKLTFSKIDQGSYAMHTGVKPLDGDYDIDVGVVFDINIEDYDSRALKKLVRNKLNKQHNRSVSYNRPCISVNYANGYHVDLPVYAKNNGNLHIAWGKETSSEHVWYESDPDGLKQWVKNVSDDAEQRAQFRRCVRYLKRWKNNKFLSIGNVAPPSIGLTIQARNAFVYKSEDDLSCLIGIAKSIRDSFTSSLSIEDLTFYQVVEVPLPVAPYKNVYYKMTKKQLDNYYNKIDELVEALEAANQEESLAESTKILNKVFGDFPVITDAVKSCKQPYLPTGMSA

SEQ ID NO: 3144 - protein, 338 aa, Cycloclasticus sp.
MVNITMAKLQKEFRVLHDAIKLGTYDENATLRQKRDLLIDELRDKLKDEKIPGTDKSLTFTKYDQGSYAMNTGVKPKNDDFDIDVGIIFDITNDDYDSHKLKQLIFDKLDTQHNRTVEYNRPCITVKYSDGYHVDLAIYSDNDDDIHIAWGKKNSKERLWFKAEPKELTDWVADVSDECEESKQFRCNVRYLKKWKWRKFSSYGNAMPPSIGITIQARDSFIYKKDDDLAALVHIVESMINEFDDRWCKDSLEFKKCIVTKLPVAPYKDVYYKMSLKQTDEFYRKLETLLEALEAARDEASDYKASKILIKIFGDDFPEAEDVRKSYIVPAVHAGDNA

SEQ ID NO: 3145 - protein, 333 aa, Cycloclasticus sp.
MAKLQKEFRVLHDAIKLGTYDENATLRQKRDLLIDELRDKLKDEKIPGTDKSLTFTKYDQGSYAMNTGVKPKNDDFDIDVGIIFDITNDDYDSHKLKQLIFDKLDTQHNRTVEYNRPCITVKYSDGYHVDLAIYSDNDDDIHIAWGKKNSKERLWFKAEPKELTDWVADVSDECEESKQFRCNVRYLKKWKWRKFSSYGNAMPPSIGITIQARDSFIYKKDDDLAALVHIVESMINEFDDRWCKDSLEFKKCIVTKLPVAPYKDVYYKMSLKQTDEFYRKLETLLEALEAARDEASDYKASKILIKIFGDDFPEAEDVRKSYIVPAVHAGDNA

SEQ ID NO: 3146 - protein, 328 aa, Unknown
  Description of Unknown: zeta proteobacterium sequence
MAILQKEFKEFHNEIKLGTYEENKSLRDKRDLLINELTEKLKDEKVPDTDSKLTFTKFNQGSYAMNTGIKPRNDDYDIDVGIIFDITNEEYDSNKLKKLVRDKLDTQQNPTVVFNRPCITVKYSDGYHVDLAIYAGNNSDYHIAWGKEHSSKNREWYKSEPKKLTKWVDDVSNRTNESEQFRRCVRYLKNWKTKKFSCDGNAAPPSIGLTIQARNAFGYRSENDIDALINIVSAMKADFSGGIIFERSISVPLPVAPYKNVYYKMTSNQIDKFYEKLDALLEILETARDEDSAHEASKLLRKVFDGFPLVEDSKASNTAPIVLTGNNA

SEQ ID NO: 3147 - protein, 334 aa, Unknown
  Description of Unknown: Pseudoalteromonas sequence
MAILQTQFEKFNETIKMGTYDENSTLREKRDLLISELRNSLKDEKIPNTDKALTFSKIDLGSYAMNTGVKPISGHYDIDVGIIFDITNGEYDSNKLKKLVFDKLNKHHNRTVEFNKPCITVNYASGYHVDLAIYSKNNENYHIAWGKEYSVENRKWWIADPKGLKQWISDIATEAEHKKQFRRIARFLKKWKAKAFSDNGNNAPPSIGLTIQARKAFRYQTDSDLDALIIVVKDIKGSFNQAWDQESGTLKWCIDISLPVEPYKNVYYKMTLGQQDAFYTKVVNLLEALEAAKDEESEVESSKILRKVFSTDFPLVEDSKQSNTPPYVTTGNNA

SEQ ID NO: 3148 - protein, 334 aa, Pseudoalteromonas sp.
MAILQTQFEKFNETIKMGTYDENSTLREKRDLLISELRNSLKDEKIPNTDKALTFSKIDLGSYAMNTGVKPISGHYDIDVGIIFDITNGEYDSNKLKKLVFDKLNKHHNRTVEFNKPCITVNYASGYHVDLAIYSKNNENYHIAWGKEYSVENRKWWIADPKGLKQWISDIATEAEHKKQFRRIARFLKKWKANAFSDNGNNAPPSIGLTIQARKAFRYQTDSDLDALIIVVKDIKGSFNQAWDQESGTLKWCIDISLPVEPYKNVYYKMTLGQQDAFYTKVVNLLEALEAAKDEESEVESSKILRKVFSTDFPLVEDSKQSNTPPYVTTGNNA

SEQ ID NO: 3149 - protein, 180 aa, Desulfobacteraceae bacterium
MPNLQNEFIDFHDVIKLGTYKEEKVLRDKREILIKELKKGLKDEKIPGTDRKLIFSNFGQGSYAMHTGIIPPDNDYDIDVGVIFDIINQEYGSVKLKKMIRDTLTQHNRTVVIRRPCVTVKYSDGYHVDLAVYASNSDDYHIAWGKENAADPTWEKSKPKELIKWVKDISDDADKRRAWF

SEQ ID NO: 3150 - protein, 284 aa, Geobacillus thermoglucosidasius
MANIQKYFEEFHEKIKLEYEDNDTLREKRDILIDKLKKNMPEDAPSFSTFNQGSYAMFTGIKPLDGGQYDIDVGLWFNMSKEDYPDPLVPKQWVYDALKDHTHDVRIKHPCVTVTYKEDGEPAYHVDLTVYAADNPDKKVYLARGKKYSSEENKYWEESNPKELINRIQNHLNDENDRAQFRRVIRYLKRWKDIKFNNVDKKPSGIGLTVAALDYFSPKYTYDAFTNTSYPDDLQAVTDFVQALINAFKWVYSEEEEKWVSRLIVNLPVSPYTDLFEKMTNKPV

SEQ ID NO: 3151 - protein, 289 aa, Parageobacillus thermoglucosidasius
MANIQKYFEEFHEKIKLEYEDNDTLREKRDILIDKLKKNMPEDAPSFSTFNQGSYAMFTGIKPLDGGQYDIDVGLWFNMSKEDYPDPLVPKQWVYDALKDHTHDVRIKHPCVTVTYKEDGEPAYHVDLTVYAADNPDKKVYLARGKKYSSEENKYWEESNPKELINRIQNHLNDENDRAQFRRVIRYLKRWKDIKFNNVDKKPSGIGLTVAALDYFSPKYTYDAFTNTSYPDDLQAVTDFVQALINAFKWVYSEEEEKWVSRLIVNLPVSPYTDLFEKMTNKPVVLVEL

SEQ ID NO: 3152 - protein, 346 aa, Geobacillus thermoleovorans
MANIQKYFEEFHEKIKLEYEDNDTLREKRDILIDKLKKNMPEDAPSFSTFNQGSYAMFTGIKPLDGGQYDIDVGLWFNMSKEDYPDPLVPKQWVYDALKDHTHDVRIKHPCVTVTYKEDGEPAYHVDLTVYAADNPDKKVYLARGKKYSSEENKYWEESNPKELINRIQNHLNDENDRAQFRRVIRYLKRWKDIKFNNVDKKPSGIGLTVAALDYFSPKYTYDAFTNTRYPDDLQAVTDFVQALINAFKWVYSEEEEKWVSRLIVNLPVSPYTDLFEKMTNKQMEDFKQKLEKLLIALQEAKSEVDPVEACKTLQKQFGDDFPVPDIEKTGERKDRPAIITESSSA

SEQ ID NO: 3153 - protein, 346 aa, Geobacillus galactosidasius
MANIQKYFEEFHEKIKLEYEDNDTLREKRDILIDKLKKNMPEDAPSFSTFNQGSYAMFTGIKPLDGGQYDIDVGLWFNMSKEDYPDPLVPKQWVYDALKDHTHDVRIKHPCVTVTYKEDGEPAYHVDLTVYAADNPDKKVYLARGKKYSSEENKYWEESNPKELINRIQNHLNDENDRAQFRRVIRYLKRWKDIKFNNVDKKPSGIGLTVAALDYFSPKYTYDAFTNTSYPDDLQAVTDFVQALINAFKWVYSEEEEKWVSRLIVNLPVSPYTDLFEKMTNKQMEDFKQKLEKLLIALQEAKSEVDPVEACKTLQKQFGDDFPVPDIEKTGERKDRPAIITESSSA

SEQ ID NO: 3154 - protein, 346 aa, Geobacillus sp.
MANLQKYFEDFHKKIKLEYEDNDTLREKRDILIDKLKKNMPEDAPSFSTFNQGSYAMFTGIKPLEGGQYDIDVGLWFNMSKEDYPDPLVPKQWVYDALKDHTHDVRIKHPCVTVTYKEDGEPAYHVDLTVYAADNPDKKVYLARGKKYSSEENKYWEESNPKELIDRIQNHLDDENDRAQFRRAIRYLKRWKDIKFNNVDKKPSGIGLTVAALDYFSPKYVYDAFTNTRYPDDLQAVTDFVQALINAFKWVYSEEEEKWVLRLIVNLPVPPYTDLFEKMTNKQMETFKEKLEKLLTALQEAKSEVDPVEACKTLQKQFGDDFPVPEIEETGERKDRPAIITESSSA

SEQ ID NO: 3155 - protein, 346 aa, Unknown
  Description of Unknown: Bacillus cereus group sequence
MATIQFYFSKFHEDIKLKNTEENAILKSKREIIIKKLREKISVDAPSFTITNQGSYAMKTGVKPLDGDYDIDVALLFEMSKDQFKPVEAKKWVYDALVGHTKEVKVKVPCVTVTYQKGEEPVFHVDLTVYANVNSDNETYIAKGKINSLEQNKYWEISNPKRLINEIENRFTSGDERDQFRRIIRYLKRWKDIHFKEKGSGKPSGIVFTACAMQYMTLYIKDAFTGEKAINDLQALISLLEKILNNFTLNFNINTNQNEERLKISLPVPPGNDLLEKMTNIQMSNFKAKLESLLDVLKEVNTEPDIIEATKLLNSVFGDSFPVATNEETAVAKRLAIATDSPSAKL

SEQ ID NO: 3156 - protein, 359 aa, Bacillus thuringiensis
MNKVLGYSLGGLDMAECRSQFAEFHDNIKLKEENEILSSKRDIIIKRIKDKLPDETDYNFEVFNQGSYAMHTGIKPLDSDYDIDVGLYFDMSKDDINPVDAKKWIYNALVGHTSDVKIKTPCVTVTYAAGYHVDVTVYASNNSDGKVYLAKGKPTSKSDDKYWDESNPKNLIKEIRDHLSDKEDRKQFRRVVRYLKRWKDIKFTSVNGKPTGIALTSCVYHWLTVQRETDYFTGKTTYKDLDALINIVSNMISNFKDEYVIIDEEYQFMPRLRVYLPVEPKPELFEKMSYKQMKTFKEKLETLLEALEEAKGKTDPTDAAEILKEQFGDDFPVPEKSTTGKKAMAAAVISSSESASEER

SEQ ID NO: 3157 - protein, 346 aa, Unknown
  Description of Unknown: Bacillus cereus group sequence
MAECRSQFTEFHDNIKLKEENEILSSKRDIIIKRIKDKLPDETDYSFEVFNQGSYAMHTGIKPLDSDYDIDVGLYFDMSKDDINPVDAKKWIYNALVGHTSDVKIKTPCITVTYAAGYHVDVTVYASNNSDSKVYLAKGKPTSKSDDKYWGESNPKDLIKEIRDHLSDKEDRKQFRRVVRYLKRWKDIKFTSVNGKPTGIALTSCVYHWLTVQKETDYFTGKTTYKDLDALINIVSNMISNFNDEYTIIDEEYQFMPRLKVYLPVEPKPELFEKMSYKQMKTFKEKLETLLEALEEAKGKTDPTDAAEILNEQFGNDFPVPEKSTTGKKAMAAAVISSSESASEER

SEQ ID NO: 3158 - protein, 346 aa, Bacillus wiedmannii
MAECRSQFTEFHDNIKLKEENEILSSKRDIIIKRIKDKLPDETDYSFEVFNQGSYAMHTGIKPLDSDYDIDVGLYFDMSKDDINPVDAKKWIYNALVGHTSDVKIKAPCITVTYAAGYHVDVTVYASNNSDSKVYLAKGKPTSKSDDKYWGESNPKDLIKEIRDHLSDKEDRKQFRRVVRYLKRWKDIKFTSVNGKPTGIALTSCVYHWLTVQKETDYFTGKTTYKDLDALINIVSNMISNFNDEYTIIDEEYQFMPRLKVYLPVEPKPELFEKMSYKQMKTFKEKLETLLEALEEAKGKTDPTDAAEILNEQFGNDFPVPEKSTTGKKAMAAAVISSSESASEER

SEQ ID NO: 3159 - protein, 346 aa, Bacillus cereus
MAECRSQFTEFHDNIKLKEENEILSSKRDIIIKRIKDKLPDETDYSFEVFNQGSYAMHTGIKPLDSDYDIDVGLYFDMSKDDINPVDAKKWIYNALVGHTSDVKIKTPCITVTYAAGYHVDVTVYASNNSDSKVYLAKGKPTSKSDDKYWDESNPKDLIKEIRDHLSDKEDRKQFRRVVRYLKRWKDIKFTSVNGKPTGIALTSCVYHWLTVQKETDYFTGKTTYKDLDALINIVSNMISNFNDEYTIIDEEYQFMPRLKVYLPVEPKPELFEKMSYKQMKTFKEKLETLLEALEEAKGKTDPTDAAEILKEQFGNDFPVPEKSTTGKKAMAAAVISSSESASEER

SEQ ID NO: 3160 - protein, 346 aa, Bacillus cereus
MAECRSQFTEFHDNIKLKEENEILSSKRDIIIKRIKDKLPDETDYSFEVFNQGSYAMHTGIKPLDSDYDIDVGLYFDMSKDDINPVDAKKWIYNALVGHTSDVKIKTPCITVTYAAGYHVDVTVYASNNSYSKVYLAKGKPTSKSDDKYWDESNPKDLIKEIRDHLSDEEDRKQFRRVVRYLKRWKDIKFTSVNGKPTGIALTSCVYHWLTVQKETDYFTGKTTYKDLDALINIVSNMISNFNDEYTIIDEEYQFMPRLKVYLPVEPKPELFEKMSYKQMKTFKEKLETLLEALAEAKGKTDPTDAAEILKEQFGNDFPVPEKSTTGKKAMAAAVISSSESASEER

SEQ ID NO: 3161 - protein, 346 aa, Unknown
  Description of Unknown: Bacillus cereus group sequence
MAECRSQFAEFHDNIKLKEENEILSSKRDIIIKRIKDKLPDETDYNFEVFNQGSYAMHTGIKPLDSDYDIDVGLYFDMSKDDINPVDAKKWIYNALVGHTSDVKIKTPCVTVTYAAGYHVDVTVYASNNSDGKVYLAKGKPTSKSDDKYWDESNPKNLIKEIRDHLSDKEDRKQFRRVVRYLKRWKDIKFTSVNGKPTGIALTSCVYHWLTVQRETDYFTGKTTYKDLDALINIVSNMISNFKDEYVIIDEEYQFMPRLRVYLPVEPKPELFEKMSYKQMKTFKEKLETLLEALEEAKGKTDPTDAAEILKEQFGDDFPVPEKSTTGKKAMAAAVISSSESASEER

SEQ ID NO: 3162 - protein, 346 aa, Bacillus onubensis
MADCRTQFNKFHENIKLKEENEILKDKRDIIIKKLNEKLSEQTDYEFSVFNQGSYAMHTGIKPLDDDYDIDVGLYFEISKDDVDPIPAKMWVYNALEGHTKDVKIKKPCVTVTYAAGYHVDVTVYAANNSDGKVYLAKGKPTSNAEDKSWDESNPKDLIKEIRDNLTIEDDRKQFRRVVRYLKRWKDIKFTSVNGKPTGIALTSCVYHWLNIQKETDLFDGKVTYKDLDALINIVSNMISNFVDEPVLVDGEYQYMPRLRVYLPVDPKPELFEKMTHKQMKTFKEKLEDLLEALEDAKEKTDPTEAAEILQNQFGDDFPIPTKSATGKKATAAAVITSSESASEMG

SEQ ID NO: 3163 - protein, 346 aa, Amphibacillus marinus
MADLKSQFNSFHDTIKLKEETEVLSSKRDIIINRIKDKLPENTDYSFEIFNQGSYAMHTGIKPLDSDYDIDVGLYFDMSKEDVKPVESKNWIYNALKDHTLDVKIKKACVTVTYAAGYHVDVTVYSANNNDGKVYLAKGKPTSNTADKYWDESNPKDLIKEIRDRYSDKEDRKQFRRIVRFLKRWKDNTFSSVNGKPTGISLTSCAYHWLSIQKETDLFSGVTTYKDLDALICVVSIMISNFREELVLIDEEYTWVSRLKVELPVEPKPDLFEKMTSKQMETFKSKLETFLEALEEAKAATDPTDAAELLEKQFGSDFPIPSKSSTGKKAMAAAVIPSSESAFELL

SEQ ID NO: 3164 - protein, 344 aa, Bacillus amyloliquefaciens
MVLCKTQFNQFHDAIKLKEENATLKEKRDIIINKIKEKLPDEASYGFTIFNQGSYAMNTGIKPLDDDYDIDVGLYFDMSKEDVEPVAAKQWIYDALKGHTDDIKIKVPCVTVTYQAGYHVDVTVYAANNDNDKVYLAKGKPESLGENKCWDESNPKDLIKEVREHLEDKEDRKQFRRVVRYLKRWKDVKFNAGGGKPTGIALTSCVYHWLTIQKDVDPFDKTRTYRDLDALINIVSQMLTMFVDEFVEVDGEPKLVPRLKVNLPVEPKSELFEKMTYNQMVTFKERLEVFLKKLQEARDHSDPTDAAEILRTQFGDDFPVPPKSTTGKRAYVAPVIPSSESALN

SEQ ID NO: 3165 - protein, 344 aa, Unknown
  Description of Unknown: Bacillus cereus group sequence
MVLCKTQFNQFHEAIKLKEENATLKEKRDIIINKINEKLPDEARYSFTIFNQGSYAMNTGIKPLDNDYDIDVGLYFDMSKEDVKPVAAKQWIDDALEGHTSDIKIKVPCVTVTYKDGYHVDVTVYASSNDDGKVYLAKGKPGSLEVNKYWDESNPKDLINEIRDHLSDKDDRRQFRRVVRYLKRWKDLKFNKGSGKPTGIALTSCVYHWLTIQKDVDLFDQTKTYKDLDALIDIVSQMISRFVDEYVEVDGEYKFMPRLKVYLPVEPKPELFEKMTSKQMVTFKEKLGVLLEKLKEAREHSDPTDAAEILRTQFGDDFPIPPRSTTGRRAYVAPVIPSSESALD

SEQ ID NO: 3166 - protein, 341 aa, Bacillus selenatarsenatis
MVLCQTQFISFHEAIKLKEENEELASKREIILKRLRDCMPEEAKSFDVFTQGSYAMNTGIKPLDGDFDIDVGLWFDMSREDAGPVEAKEWVFKALEGHTKDVKMKTPCVTVTYAAGYHVDVTVYSATNENCKVYLAKGKTTSKREEKYWDESNPKDLIKEIRDHLTDKDDRRQFRRVVRYLKRWKDVNFKSATGKPSGIALTSCVYHWLDIQKDIDLFNGKVTYRDLDALISLIRSMISRFQTVYEVEGGELVSYPRINVELPVSPWPNLFELMTNKQMVTFKEKLECLLDALEEAKAKSDPTDACEILRKQFGDDFPVPPRPMTGKRSVAPAVLPSTESA

SEQ ID NO: 3167 - protein, 344 aa, Jeotgalibacillus malaysiensis
MALCQKQFTDFHETIKLKLENKVLSEKRDIIIKRIKENLSEDEHKPFTIFNQGSYAMNTGIVPLDENYDIDVGLYFDMSQDDAKPVEAKKWVYKAVEGHTDDVNYKNPCVTVSYKAGYHVDITVYAATNNNGKVYLAKGKPTSSAEKKVWDESNPKDLIKEIKDYLSDEDDRKQFRRLVRYLKRWKDENFSAGNGKPTGIALTSCVHRWLSVKKDVDIFNGKRTYKDLEALIHVVQQMIWNFSDEYVEVDGEYKWMPRLKIQLPVEPRPDLFEKMTPSQMKRFKEKLESLLKGLEAAKEKVDPVDAAELLQKHFGSDFPIPPRSDTGKKSVATAVVPSSESASE

SEQ ID NO: 3168 - protein, 345 aa, Oceanobacillus picturae
MVLCIKQFNKFHDNIRLLEENEVLKEKRDIIINTIKNNLPKETSKSFTIFTQGSYAMHTGIKPLDNDYDIDVGLYFDISKEDIKPVQAKQWILNAVEGHTKDVKMKNPCITVAYAAGYHVDITVYAAENADGKVYLAKGKPTSNGEDKCWEESNPKDLIKEIRDHLSDSEDRKQFRRIIRYLKRWKDEKLIKGNGRPTGIALTSCAYNWFAVEKDVDPFSGDRTYKDLDALIALIRQMINGFSSEVERDENGELNTFYRLKVELPVEPYSDLFEKMSNKQMNTFKQKLERLLESLEEARSKEDPTDAAEILQKQFGKDFPVPPRPTTGKRATQKAVIPSSESAKK

SEQ ID NO: 3169 - protein, 349 aa, Staphylococcus nepalensis
MALCNTQFKEFHDNIRLSEENKILKEKRDIIIDVIKKNLPNESSKSFTIFNQGSYAMKTGIKPLKKDYDIDVGLYFEMSKEDVNPVDVKQWIMNAVEGHTNNVKMKKPCITVTYVDGYHVDITVYAAENSDGKVYLAKGKSTSEKENKYWEESNPKKLIKEIREHLSDEDDRKQFRRIIRYLKRWKDQKFLQDNNAKPTGIALTSCAYMWFEAKKEEDLFSKERTYNDLEALISLVQKIITEFYNKPTRDEYGKHITTERLKIELPVEPYPDLLDKMSDKQMEDFKSKLEVLLEKLEEAKEKFDLRDAAIILQSQFGKDFPVPPKPDKGKRATRQAVIPSSESAKEWYK

SEQ ID NO: 3170 - protein, 342 aa, Bacillus sp.
MPHNQNQFESFHEAIKLSDEDSILREKRDIIIKRLSEKMPETAKSYTTFNQGSYAMKTGIKPLDGDYDIDLGLFFDMSKEYVSPVEAKKWVYDALVDHTNDVQMKKPCVTVSYTAGYHVDVTIYAAENTDGKVYLAKGKLTSSAENQCWDESNPKNLIKEIRQKYSDAEDRKQFRRLVRYLKRWKDIQFNNSANGKPTGIALTSIVYHNMQVKTEMVDFFSGEKKYRDSEALIHLITTFLSTFTTRWEFEDDTLVEYPYVEVKLPVAPYPNLLEKMTLKQIKVFKEKMEKLLCCLIEARDELDSSDGAAILRKQFGDDFPVPSKDPGKRAVVPAVIPTSESA

SEQ ID NO: 3171 - protein, 343 aa, Paenibacillus sp.
MPHNQSQFEGFHEAIKLSDESSILKEKRDIIIERLSTKMPEAAKTYTTFNQGSYAMKTGIKPLDGDYDIDLGLFFEMSKEDVGTPVEAKKWVYDALVGHTNDVLMKKPCVTVTYAAGYHVDVTIYATENSDGKVYLAKGKLASTVENQSWDESNPKDLIKEIRQKYSDKEDRKQFRRLVRYLKRWKDVQFKGSTYGKPTGIALTSIVYHHMQVKTEVVDFFSGEKKYRDSEALIHLISTFLSTFTSRWEFEDDKLIEYPYVEVKLQVAPYPNLLERMTLNQIKVFKDKLEKLLACLIEARDEVDSSDGATLLKKQFGDDFPVPSKDPGKRSVIPAVIPSTESA

SEQ ID NO: 3172 - protein, 346 aa, Paenibacillus sp.
MTLVPHNQSQFEGFHEAIKLSDESSILKEKRDIIIERLSTKMPEAAKTYTTFNQGSYAMKTGIKPLDGDYDIDLGLFFEMSKEDVGTPVEAKKWVYDALVGHTNDVLMKKPCVTVTYAAGYHVDVTIYATENSDGKVYLAKGKLASTVENQSWDESNPKDLIKEIRQKYSDKEDRKQFRRLVRYLKRWKDVQFKGSTYGKPTGIALTSIVYHHMQVKTEVVDFFSGEKKYRDSEALIHLISTFLSTFTSRWEFEDDKLIEYPYVEVKLQVAPYPNLLERMTLNQIKVFKDKLEKLLACLIEARDEVDSSDGATLLKKQFGDDFPVPSKDPGKRSVIPAVIPSTESA

SEQ ID NO: 3173 - protein, 343 aa, Halanaerobium congolense
MADLQKYFNEFHEIIRLSFDDNAELREKRDIILNKFFNNRADDVPKPESFNQGSYAMSTGVKPIDDDYDIDVGLEFNISKDDYKSLEVKNWVYDVLKDHTKSVEIKNPCVTVTYHKEDEPIYHVDLALYSNDNADGKMYLAKGKEYSNSKNKRWEPADPKGLIKAIQNKFSDKDDRAQFRRIIRYLKRWKDIKFSSDGNAAPLGIGITVAAYKWFNVSKEIEDIFSNKYKFNDLNALINFIEDLISRFNYMYYDEEYVERLQVELPFEPYDELFKNMTNKQMTKFKNKLEELISKLREASDEVDPVVACENLVKVFGDDYPIPEKEETAEKKNCAFTPSNSSA

SEQ ID NO: 3174 - protein, 346 aa, Geobacter uraniireducens
MADVQKYFETFHDAIKLKKFDENQILREKRDIVLDKLKSRLKTIFEEKDEPVPTYQTFDQGSYKMGTGIIPLDSDYDIDVGVSFNVSKDNYLDPVEVKEWVYDALNGHTKKVDMRRPCVTVFYQKGDEPVYHVDLAVYSDESCNSDGKKYLAKGKLNSSDDNKCWEISEPQKLADTVGDKHAGDDKKQFVMVIRYLKRWKDYNFSSNGNAAPIGIGLTIAAYNWFTPNKTLMDIVASTYKYNDLQATRGVVNGMLNNFGDRLRVYLPVEPYSELFEKMTDNQMATLKEKLGSLLEALDSAASEVDPVKACETLKKVFGDDFPVPEKPDTGEKKSRAISTASASAHA

SEQ ID NO: 3175 - protein, 353 aa, Nodularia sp.
MANVQYQMIKFHEAIKLKHFDENAVLREKRNRILERLDQGLDKIFRVCNLKPPKYETFDQGSYTMGTGNKPIDGHFDIDTGVVFRICKDDYLDPVKVKEWVYDALHKHTNLVEIRRPCVTVFYQQAGDPIYHVDLAIYSHPDCNPDGKMYLAKGKLNSAAEYRFWQESDPQALIQLIKNLFLDREDDKQFRRIIRYLKRWKDVKFSSDGNAAPIGIGITVAAYHWFNPVYTHDSFTNIKNYDDLEALRCFVNVVLTKFQNVYSNRNIVQRLIVELPISPHNDLFEKMTDNQMADFQEKLKFLLEVIKEAQQKADPVEACKILHKQFGDDFPIPNREDTAQKRPPAIISSSASA

SEQ ID NO: 3176 - protein, 353 aa, Unknown
  Description of Unknown: Calothrix sequence
MADVQKYMFKFHEEIKLKRFEENKVLREKRDRILERLDRELTKLFAKLGIEVIKYETFDQGSYAMGTGTKPVGGHYDIDTGVCFKICKDDYPDPVLIKEWVLNALQGHTKWVEIRRPCVTVFYQQDGEPIYHVDLAIYSDKDCNPDGKMYLAKGKLSSAVEHRIWQESDPLALIDLIKNHFSNGDDNKQFRRIIRYLKRWKDVKFSSDGNAAPIGIGITVAAYYWFNPVKTYKPFENTYDYNDLEALRNFISTMLGNFKQVYSNGAIVERLEVKLPVSPSCDLFEKMTDKQMGEFKEKLETLLDAIEEAQLHVDPVDACSLLHEQFGDDFPIPSRQDTAQKSSRPIISSSASA

SEQ ID NO: 3177 - protein, 336 aa, Lachnospiraceae bacterium
MVNVQSEFLTFHDKIKLSEENQELRNKRDILLNKLRKNISDKAASFTTFNQGSYAMGTGIKPDDGDFDIDVGLKFDIDHDDYSDPVQVKQWVKDALDGHTKSVKIRRSCVTVTYQKDKEPIYHVDFAVYAANNADKQMYIAKGKEYSTEEYRIWQLSDPQELLNYLNSLYDDSDDRAQFRRVVRYMKKWKNQHFITSGNNAPTGIALTALACSYFTPYYSKDFLTNKKAYDDFKALKRLVNNIQNAFNLTWDSDDGCFYRTITQSLPVQPGNNLFEKMSNKQMNNFYNQISAMYSKLTEEEGKSKKSEVCQLMIDIFGEAFPAAVDRSYVGTSESA

SEQ ID NO: 3178 - protein, 410 aa, Clostridium sp.
MNGQFRSLIGQLPVAWIILNLEIITESQKKFYIVKVLKIHDTDDLDLPIIRLHIITTYGIIIKNKPYILTFGGLIMPTLQTAFTDFHDAIKLDDENETLCEKREILLKKLKENISENAASYTTFNQGSYAMHTGIKPEDSDYDIDVGLKFDINKADYEDPIKVKKWVKDALEGHTKSVKIRRSCVTVQYQQNEEPLYHVDFAVYAANNDDLKLYIAKGKEFSEDDQKYWEVSDPQGLIELISNKYSGKDAEQFRRIIRYMKKWKIHNFSSSGNSAPTGISLTILAYNLFSPNSTYDPFTNTSSFNDFNALRNLVTSIKNQFSFIFDSESNEFCYSIITNLPTEPYNNLFEKMSLKQQDTFHSKIIAMNEKLDEVEGKETLSEKCTLLAELFGDDFPVLSERSIVGSTESA

SEQ ID NO: 3179 - protein, 333 aa, Papillibacter cinnamivorans
MSTLQTAFTQFHDNIKLEDENQTLRDKRDILLNKLKDEISTDAASYTTFNQGSYAMNTGIKPEDGDYDIDVGLKFDINKSDYTDPVVVKKWVRDALVGHTQSVSIRRSCVTVQYQQDNEPIYHVDFACYAADNDDGKLYIAKGKEFSNADEKHWEVSDPQGLIQLVQDKHSGKDAEQFRRVIRYVKKWKVRKFSSDGNGAPTGIALTVLAYNLFSPSSVYDPITASRSYNDFDALHNLIKNIKNKFSMIFKDSSIYYTISANLPVEPYNDLFDKMTLKQKTTFHDKIVAMDDKLEEVKKKTTLSEKCTLLQDLFGSDFPILTTRSMVGSSESA

SEQ ID NO: 3180 - protein, 348 aa, Siccationidurans arizonensis
MATVQKYFDLFHDKIKLGRFDEEDTLRDKRRIVREKLLANLPGVFEKHKEKNLVPTFRDQGSYAMNTGIKPLEGDFDIDQGVYFESSVTDYPDPVVLKERVHEALDGHTKKVEIRRPCVTVFYQDGYHVDLAVYSCASANADKQDYLAMGKVGSEEKYRVWQLSDPTALTDKLFERFDGDDTGRKQYRRVIRFMKRWKDVNFVSSGNGAPRGIGLTVNTHDYFQPNYDATSFKLDDLTALRDLAQAMLDAFTSTWVFAEWKFIRRLKAQLLVTPFNDVYEKMTSKQMETFEAKLQELCDALNAAIKEVDTRKACQLLRNVFGDDFDVPEESETARPTPPPVSTHSQSA

SEQ ID NO: 3181 - protein, 328 aa, Coleofasciculus chthonoplastes
MEKIQSQFIKFHDAIRIDFDGSQPLRDKRDLVVGDLRDGLKRVFYSSYTPSFSYFNQGSYNLATGVQPILYEDYDIDVGIVFNFSKNSYRPVQVKEWVYHALNTVAARTVEIKRPCVRVQYHKNAAKWFHVDLAIYSTDNYWGNELNHIAKGFIGSSEDKKIWELSEPFKLKELLKSKITDSSDREQFRRIVRYLKRWKSYNFSSTVTGRPTGIALTACCYNLFTPQKYYVYSSYNYQYNDLKALHNVVTGMIGMFTWNNQISVKLPVQPYNDLFEKMTNNQMLSLKEKLLVLRDTLSSAWFSAVNELDPLSACVKLRKVFGHDFPIL

SEQ ID NO: 3182 - protein, 327 aa, Leptolyngbya sp.
MANLQTQFNNFHNTIKVDFDDSQPLRNKRDLIVGNLKDGLKKLFPTNTPTFRFFNQGSYDLATGVEPLSGEDYDIDVGIIFNFSKSIYKPVQVKEWVYNALNTGSRTVEIKRPCVRVQYHSNGAKWFHVDLAVYSTDKDYLGNEVNYIAKGFIGSSEDKKIWEISEPFRLKELLKSKITDGSDREQFRRVIRYLKRWKDYNFSSTVAGRPTGIALTACCHNLFTSQKDRVYNPYTYSYAYQYNDQRALQNVVSGIVGMFTWNNKISVKLPVQPYNDLFEKMSDSQMLLMKMKIVTLRDVLLAASNETSSLNACIKLQKVFGDKFPIS

SEQ ID NO: 3183 - protein, 328 aa, Geminocystis sp.
MVNLQTQFSKFHETIKIDFDESQYLRDKRDLIVNNLREGLKKLFAVQSLQPPIFHSFNQGSYDLATGVEPPTGQDYDIDVGIVFHFSRNHYQPVQVKEWVYHALSSFNRTVEIKRPCVRVQYHQNGEKWFHVDLAIYSSDQDNFGREINYIAKGYSNSSEDYKFWEVSEPFKLKELLKSKFPDQLDRDQFRRIIRYLKRWKDYNFSSTIAGKPTGIALTACCYNLFEPKKNYEYQSYPYQYKYNDLEALKNVVNGIISMFNWQNQIIVQLPVQPYNDLFEKMTDDQMKSFKNKLITLKNTLITASNEYDSSDACLKLQKVFGPDFPRY

SEQ ID NO: 3184 - protein, 335 aa, Beggiatoa sp.
MAILQTYFRQFHETIKLNNLDENSILREKRDIVLDKLRLRLKTFFQDKNEPIPTFDFFNQGSYAMGTGIQPLEGDYDIDVGLKFHISKEDYFDPVEVKQWVYDALYGHTQRVECRRPCVTVFYQRHDEPIYHVDLAIYSEPDYEGGPLYLAKGKLHSRYEERIWEQSEPQKLIELVKNQFGETEDREQFRRVIRYLKRWKDVQFSETASGKAAPIGIGITVAAYHWFNVIQSVDVFGKVTYDDASALKVFVNTLIGQFRNVYSDAGEWTQRLCVDLPVAPYCDLFEKMTDNQMTHFHKKLERLSETLQETEYEPEPHEACQKLQKQFGRYFPLPE

SEQ ID NO: 3185 - protein, 348 aa, Deinococcus indicus
MANVQTHFITFHTRIKLAQYDENKTLRDARDEVIDALRAGLKTLFQDKGKPVPTFTSFNQGSYAMNTGVKPLDSREYDIDVGLDFDLITDDHDPVEVKIWIRDALKLESITSEIRRPCVTVFKDGYHVDLAVYARPRYNTSLHLAKGKENSGAAHRVWQVSDPQGLKDLIANRFAGDDARQFRRTIRYFKRWRDENFSADGNAAPIGIGLTVAAYHWFQVQKTTSWMDNKVTYDDRLALERFVRTLTQNFTQVWDHDEQRRYPRLAVTLPVQPSSDLFERMTNKQMDAFKQKLDALLTALEQARQELDVHDACAILEAQFGEAFPVPDKQESSKTTRAGISGSGSSGC

SEQ ID NO: 3186 - protein, 306 aa, Cystobacter fuscus
MSFQPLFRRFHQAIQLKRFDENAELVEKRDRVLKRLRENLSISFDWFNQGSYAMGTGVKPVNGDYDIDIGLVFDVSHRSYAPSTVKKWVYDAVVHHTTRVEWRRPCITVYYQQAGEAIYHVDLAILVKESPYSNALYLAIGKEHSAAAQQEWQPDDRKGFIKAIENKFTGEDAEQFRRVIRYLKRWKDEHFSNQGRAAPTGLSLTVAAYYWFQLAKTSWYSAADYDDFSATASLVDMIKRNFYYGRRLSLQFPKAPQDDVLARMTDQQMREFYQRLEELSGWLDDARRTRSTAPLQQAFGADFPAQ

SEQ ID NO: 3187 - protein, 304 aa, Haliangium ochraceum
MTLQPLFRRFHDAIQLEDRKQNADLRDKRERIKKRLRENLRPHTFESFNQGSYAMGTGVRPLNGDYDIDVGIVFNKLYKQEVTPLQAKQLVYDAVKEHTARVDWKNPCITVYYQQSGKLKYHVDLVVFARDRHDANKLWLARSKQNAAPAQQEWQADDRKGFIAAVKDRSTGEDGYQFRRVIRYLKRWADLHFPHTGHAKPSGFALTVAAASWFRAHSRSGDYDDLAATLNLVETMRGRFSYNGRLSLRFSHEPRDDVFGRMNDQQMREFSQRLEALAGYLQEAQRTTLVAPLRDAFGDDFPAQ

SEQ ID NO: 3188 - protein, 355 aa, Myxococcus fulvus
MAVIQTQMIQFDDNIRLKRFSESKELREKRDIILDKLRAHFATLRLSGTAVPTFKHINQGSYEMGTGIHPADGDYDIDVGLKFNCATSEYPNPVELKILVADALEDHTELGTEIRRSCVTVKYQKQGEQAFHVDLAVYAYDNADNPTKLLIAKGKRGSGEKDRWWEESDPDGLADWVANRFSDSEQQVQFLRVIRALKRWKTEKFKTDGQNAPSGIGLTVAAGQWFKPQVHRDAFTGKITLDDIKAMRDFAATLLTSFQHIGWKDDGARLYRLRLPLPVAPRKDIFEKMTDGQMTTFRDRLTQLRDRLDQVMKETDPVEACKVMRKEFGEEFPVPDKGSTGQGGGRAVISSGVSA

SEQ ID NO: 3189 - protein, 357 aa, Archangium sp.
MADVQTQIVQFDEKIRLSWNNEEKTLREKRKIILERLRAQFDAMREAGAKIPSFSDFNQGSYKMDTGIHPAKGDYDIDVGLQFNCARSEYPNPVTLKGLVADALEGHTHLGTEIKLSCVTVKYMVDGVQAYHVDLAIYTYEDPRSATKRLFLAKGKRGSGEDDRWWEESDPQGLINWVEGRFQDPDQEKQFLRVIRCLKRWKSEKFKTDGNNAPSGIGLTVAAGQWFRPQVYRDAFAATTTFDDLKAMKALVDVMISRFVQIGWKQEDGSALYRLSVPVPVAPGTDIFERMTDGQMTTFRKHLLQLQDRLDEVTNEPDPVRACQLMRKDFGDDFPIPEKNVTGQIGGRAIASRGVSA

SEQ ID NO: 3190 - protein, 356 aa, Stigmatella erecta
MADIQKQFVQFDESIRLKRFEENQMLIEKRDAILDRLRAQFAKRRKEGETIPSFQHLNQGSYQMGTGIQPAQGDYDIDVGLCFNCSTRDYPNPVSLKVLVADALAEHTDLGTRIRRSCVTVYYKLGGEQAYHVDLAVYAYDNPQSRMPQLFLAKGYRDADAKSRSWESSDPKGLCAWVEGRFPDNDQELQFLRVIRALKRWKTEKFKLDGDNAPSGIGLTVAAGKWFSPRVTRDPFTQKTTFNDLEAMRHFVQALVGQFYSVGTKGDGNLLYRLQVPVPVPPGKDIFERMSPGQMTVFRERLTQLQDLLTRVARETDPVDACKLMRKEFCDEFPVPDRNDTGRSGPKAISTSGISA

SEQ ID NO: 3191 - protein, 354 aa, Cystobacter fuscus
MANIQKYFEQFDEDIRLKRFDENQMLREKRDAIHRRLREKFEAMRRAGADIPSFETFNQGSYQMGTGIQPAEGGEYDIDVGLRFNCDQTKYSNPVALKQVVADALEGHTSIPTRMRRSCVTVYYKQNGEQAYHVDLAVYVYAHANSSRLVIAKGEHGSGLGDRKWEESSPQELCDWVENRFSNKEEEAQFLRVIRALKRWKTEKFKTDGQNAPSGIGLTVAAGQWFVPSIKRPFSGPIAFDDRTAMRAFVDRMVREFHLAGHKTDGSSLYRLEVRVPVVPHGDIFERMTSGQMSTFRDRLIQLRDQLDAVEHELDPVDACTRMLKEFGEAFPVPDKSKTGAVRGIATTTSGTSA

SEQ ID NO: 3192 - protein, 329 aa, Nannocystis exedens
MTILQTEFNKFNDAIRLGWDNEEARLRERRDAVIDRIRERMGGPSFSHFNQGSYELRTGVKPVNGDYDIDVGLRFNTTRSEWPDPVALKQRVVDALSGYKVELRRPCVTVYYQRRNEPLYHVDLNVYVPAETEGMLHLAVGKVGDAAPLKEWRFTDPLALGAALDTTFAADDREQCRRVIRYLKRWKDSNFPAQGNAAPKGIGLTAAALQWFTPARERDGVANRVHHDDLKALSGLVWAMLAHATPRLVVKLPVPPHDDLFRRMSEQEMSIFVAKLGELDEGLRRALADADEGSASRTLREFFGEDFPAVTSSPTARRIGAIVSSGSAG

SEQ ID NO: 3193 - protein, 337 aa, Acidovorax sp.
MPAVQKQFEDFHKAICFDEDDEKAALREKRDIIIKALRDNLGDDVPTFTNFNQGSYSMHTGVVPLDGNFDIDVGLIFDCNQDKYPDPVVLKKKVRDAINTNFRTVDIRRPCVTVNYISGGKTAYHVDLAVYSQDASGTLYLAKGKENSAEEHRIWEASDPKGLTKLVCSAFEDSEEQAQYRRCIRYLKRWRHWQFSGPGAPLSIALTVAALKWFKPNFNTSGKPVDLLAMLDWVQAMLDNFVSEYREDGGWHMRLSVPLPVQPYTDLMSKRTAAQMKDFKERLESLRDALQKAYDEELPEDACKVLKKQFGDDFKVPEKAETAKMVAPAVISTGNSA

SEQ ID NO: 3194 - protein, 337 aa, Delftia lacustris
MPAVQRQFENFHSAICFDEDDEKAKLREKRDTIIKALKANLGDDVPTFTNFNQGSYSMHTGVVPLDGNFDIDVGIIFDCDQNKYPDPVVLKKKVRDAVNTNFRTVLIRRPCVTVNYLSDGKVAYHVDLAIYSRDANGTLYLAKGKENSAEEHRIWEISGPKELTKLVCGAFSDSDELAQYRRCIRYLKRWRQWQFTGSGAPLSIALTVAALKWFKPNFNTSGKPVDLLAMLDWVKAMLNQFTYEYSQADGTHQRLKVMLPVAPYSDLMAKRTAAQMKTFKEKLESLRDALSDAYDEELPEEACKLLKKQFGDDFKVPEKAQTAKTVSAAVISTGNSA

SEQ ID NO: 3195 - protein, 362 aa, Acidovorax soli
MHPLIAIGLFAGIASWLLSKEKEAKMPAVQREFENFHSAICFDEDDEKAKLREKRDTLVKALKANLGDDVPTFTNFNQGSYSMHTGVVPLDGNFDIDVGLIFNCDQDKYPDPVVLKKKVRDAVNTNFRTVLIRRPCVTVNYLSGGEVAYHVDLAVYSRDANGTLYLAKGKENSAEEHRIWEISDPKELTKLVCGAFSDSDELAQYRRCIRYLKRWRQWQFTGSGAPLSIALTVAALKWFKPSFNTSGKPVDLLAMLDWVNAMLHQFTYEYNQTDGTHQRLKVMLPVAPYSDLMAKRTAAQMKTFKEKLESLRDALSDAYDEELPEDACKLLKKQFGDDFKVPEKAQTAKTVSAAVISTGNSA

SEQ ID NO: 3196 - protein, 337 aa, Candidatus Accumulibacter sp.
MPAVQRQFEDFHSAICFDEDDEKATLREKRDTIVKALRDRLGNDVPSFVNFNQGSYSMHTGVVPLDGNFDIDVGLIFDSNQDKYPDPVALKKKVRDAANTNFRTVLIRRPCVTVNYMSSGEIAYHVDLAIYTKGDDGKLYLAKGKENSAVEHRIWEVSDPKELTKRVCGAFEAPYKLAQYRRCIRYLKRWRQVQFQGAGAPLSIALTVAALYWFKPNFGMSGKPVDLLAMLDWVNAMLGQFTYDHHPDDGMHLRMKVALPVEPYSDLMAKRTAAQMKNFKEKLESLRDALQMAYDEDLPEDACKHLKKQFGDDFKVPEKSETAKVVLPAVISTGNSA

SEQ ID NO: 3197 - protein, 337 aa, Methylibium sp.
MPAVQRQFEDFHSAICFDEDDEKATLREKRDIIVKALRDSLDNDVPSFTHFNQGSYSMHTGVVPLDGNFDIDVGLIFDCTKGKYPDPVTLKKKVRDATNTNFRTVVIRRPCVTVNYMSGGKIAYHVDLAVYTKGDDGKLYLAKGKENSSEEHRIWEVSDPKELTKRICGAFDDADELAQYRRCIRYLKRWRQVQFQGAGAPLSIALTVAALHWFKPIFGTSGKPVDLLAMLDWVKAMLGQFSYEYSHDDGLHLRLKVALPVEPHSDLMAKRTAAQMKNFKEKLEALRDALKKAYDEDLPEDACKHLKKHFGDDFRVPEKAETAKAVAPAVISTGNSA

SEQ ID NO: 3198 - protein, 337 aa, Pseudomonas sp.
MPSVQKQFEDFHSAICFDEDDEKATLREKRDTIVTTLREKLGDDVPSFVNFNQGSYSMHTGVVPLDGNFDIDVGLIFDCTKDEYPDPVVLKKLVRDAVNSNFRTVVIRRPCVTVNYMSGGDIAYHVDLAIYTKGVDGKLYLAKGKENSAEEHSIWEISDPKELTKRVCGAFEDSDKLAQYRRCIRYLKRWRQVQFQGTGAPLSIALTVAALHWFKPNFGTSGKPVDLLAMLDWVNTMLDQFTYELSQDDGLHLRLKVTMPVEPYYDLMATRTAAQMKKLKEKLESLRDALQKAYDEDLPEDACGYLKKQFGDDFKVPTKSETAKAVSAAVISTGNSA

SEQ ID NO: 3199 - protein, 337 aa, Pseudomonas aeruginosa
MPSVQKQFEDFHSAICFDEDDEKATLREKRDTIVTALREKLGDDVPSFVNFNQGSYSMHTGVVPLDGNFDIDVGLIFDCTKDEYPDPVALKKKVRDAVNSNFRTVVIRRPCVTVNYLSGGEIAYHVDLAVYTNGDDGKLYLAKGKEGSAEEHRIWEVSDPKELTKRVCGAFEDSSKLAQYRRCIRYLKRWRQVQFQSAGAPLSIALTVAALHWFKPNFGTSGKPVDLLAMLDWVNSMLGQFTYEFSQDEGLHLRMKVALPVEPYSDLMAMRTATQMKNFKEKLETLRDALQKAYDEDLPEDACKHLKKQFGDDFKVPEKSETARAVSPAVISTGNSA

SEQ ID NO: 3200 - protein, 337 aa, Pseudomonas sp.
MPSVQKQFEDFHSAICFDEDDEKATLREKRDTIVTALREKLGDDVPSFVNFNQGSYSMHTGVVPLDGNFDIDVGLIFDCTKDEYPDPVALKKKVRDAVNSNFRTVVIRRPCVTVNYLSGGEIAYHVDLAVYTKGDDGKLYLAKGKENSAEEHRIWEVSDPKELTKRVCGVFEDSDKLAQYRRCIRYLKRWRQVQFQGAGAPLSIALTVAALHWFKPYFGTSGKPVDLLAMLDWVNTMLGQFTYEFSQDDGLHLRLKVALPVEPYSDLMAMRTATQMKNFKEKLEALRDALQKAYDEDLPEDACKHLNKQFGDDFKVPEKSETARAVSPAVISTGNSA

SEQ ID NO: 3201 - protein, 337 aa, Pseudomonas bauzanensis
MPSVQKQFEDFHSAICFDEDDEKATLREKRDTIVTALREKLGDDVPSFVSFNQGSYSMHTGVVPLDGNFDIDVGLIFDCTKDEYPDPVTLKKKVRDAVNSNFRTVVIRRPCVTVNYISNGEIAYHVDLAVYTRGDDGELYLAKGKENSAEEHRIWEISDPKELTKRVCSVFEDSAKLAQYRRCIRYLKRWRQVQFPSTGAPLSIALTMAAFHWFKPSFGTSGKPVDLLAMLDWVNAMLGQFTYEFSQDDGLHPRLKVVLPVEPYSDLMAMRTATQMTNFKEKLEALRDALQKAYDEDLPEDACKHLKKQFGDDFKVPEKSETARAVSPAVISTGNSA

SEQ ID NO: 3202 - protein, 337 aa, Pseudomonas putida
MPSVQKQFEDFHSAICFDEDDEKATLREKRDTIVAALREKLGEDVPSFVSFNQGSYSMHTGVVPLDGNFDIDVGLIFDCTKDKYPDPITLKQKVRDAVNSNFRTVVIRRPCVTVNYLCGGEIAYHVDLAVYTQGDDGKLYLAKGKENSAGEHRIWEVSDPKELTKRVCGAFDDSDKLAQYRRCIRFLKRWRQVQFQGAGAPLSIALTVAALQWFKPNFGMSGKPIDLLAMLDWVKTMLSQFTYEPSLDDGLHLRLKVPLPVEPYSDLMAMRTATQMKTFKEKLEALRDALQKAYDEDLPEDACKHLTKQFGDDFKVPEKSETARAVPPAVISTGNSA

SEQ ID NO: 3203 - protein, 337 aa, Pseudomonas brassicacearum
MPSVQKQFEDFHSAICFDEDDEKATLREKRDIIVTTLREKLDDDVPSFVNFNQGSYSMHTGVVPLDGNFDIDVGLIFDCTKNKYPDPVVLKKKVRDAVNSNFRTVVIRRPCVTINYMSDGEIAYHVDLAVYAKGDDGKLYLAKGKENSAEEHRIWEASDPKELSKKVCGAFVDSEDMAQYRRCIRYLKRWRQVQFHGVDAPLSIALTVAALLWFKPNFGTSGKPVDLLAMLDWINTVLGQFTYEFSEDDGQHLRLKVPLPVEPYSDLMAARTAMQMKNFKEKLEALRDVLQKAYDEDLPEDACKHLKKQFGDDFKVPEKSETAKAVSAAVISTGNSA

SEQ ID NO: 3204 - protein, 337 aa, Chitinibacter tainanensis
MPAVQKQFEDFHRVICFDEDDEKATLREKRNTIIKALKAKLSDDVPSFTSFNQGSYSMHTGVVPLDGNFDIDVGLVFDCAPDKYPDPVALKKQVRDAVDSNFRTVVIRRPCVTVNYISDGEIAYHVDLAVYTKSSEGKLYLAKGKENSADEHRIWEVSDPQELTKLVCDKFEDSDKRAQYRRCIRYLKRWRQVQFKGAGAPLSIALTVAALHWFKPNFGTSGKPVDILAMLDWVNTMLGQFSYEFSQNDGMHLRLKVALPVEPYSDLMAKRTATQMKNFMEKLELLRDALQTAYDEDLPEDACKHLKKQFGDGFKVPEKSETAKAVSAAVISTGNSA

SEQ ID NO: 3205 - protein, 337 aa, Deltaproteobacteria bacterium
MPALQKHFEEFHSNIKLDEDDEKATLRKKRETLLQALRDNIDDDVPSFESFNQGSYSMHTGVVPVGGNYDIDVGLIFDCKQEQYPDPVTLKTKVRDALDSNGRTVQIRRPCVTVNYMRNGEPEYHVDLAVYAKRDDGLLDLAKGKEGSAKEFRVWEASDPKRLTEIICTAFKAPDELAQYRRCIRYLKRWRHVQFRNGGAPLSIALTVAAKQWFTPRFETSGKPADLLAMLDWSETMLSRFETAYTESEGWHERLKVMLPVTPNSDLMAGMSKGQMTTFKERFQTLRNALRDAYDEDLPEDACKLLNKQFGDDFKIPEKHETAKTVSAPVISTGNSA

SEQ ID NO: 3206 - protein, 337 aa, Ralstonia solanacearum
MPAVQKQFEDFHTNIKLDEDDEKAKLREKRDTLLKTLTANLGDNVPSFESFIQGSYSMHTGIVPLDGNYDIDVGLIFDCKRDQYPDPVQLKKMVRDALDSNGRTVVIRRPCVTVNYVRNGATDYHVDLAVYAKRDDDLLDLAKGKENSSDDFRVWEVSAPKNLTKVICSAFQNSDELSQYRRCIRYIKRWRNVQFRNGGAPLSIALTVAAKEWFKPRFSTSGKPTDLLALLDWVKAMLSRFENVYTNDDGWHERLKVTLPVTPFSDLMAGMSKGQMTTFKQKLEALRDALSDAYDEDLPEDACKLLNKQFGDDFKVPEKSETAKAVTAPFISTGHSA

SEQ ID NO: 3207 - protein, 362 aa, Burkholderia ubonensis
MHPLIGLGLFAAAVAWLCSDDKESKMPAVQKQFEDFHANIKLDDDDEKAKLREKRETLLRTLRASLGDEVPSFDNFNQGSYSMHTGVVPLDQNYDIDVGLIFDCKQDKYPDPVELKKKIRDALDSNGRTVAIRRPCVTVNYMRGDKPEYHVDLAIYTKRDDGLLDLAKGKENSGDSFRVWETSDPKRLTEIICTAFKDSSELAQYRRCIRYIKRWRNVQFRNGGAPLSIALTVAAKEWFRPRIETSGKPTDLLALLAWVKTMLSCFESVYTNDDGWHERLKVSLPVTPYNDLMAWMTKGQMSTFKEKLEGLHDALSDAYDEDLPEDACKLLTKQFGEEFKVPEKSETAKAVAAPVISTGNSA

SEQ ID NO: 3208 - protein, 336 aa, Pseudomonas sp.
MPAVQKQFEEFHTNIKLDEDDEKAKLREKRDNLLKALKANLADDVPAFENFNQGSYSMHTGVIPLDGNYDIDVGLIFDCKRDRYSDPVELKKKVRDALNSNGRTVAIRRSCVTVNYMRDGKPEYHVDLAVYVKRDDDLLDLAKGKENSGDDFRVWEGSNPKKLTESVCSAFKDTEQLKQYRRCIRYIKRWRDVQFRNGGAPLSIALTVAAKEWFQPRFETSGKPADLLALLDWIKAMLWRFEDAYTEDGWSKRLKVILPVTPYSDLMEGMTNGQMTAFKEKLETLRDALADAYDEDLPEDACKILNKQFGDDFKVPEKAQTARSVAAPIISTGTSA

SEQ ID NO: 3209 - protein, 335 aa, Janthinobacterium sp.
MPAVQKNFEDFHSKIKLDEDDEKATLREKRDTLLLALRKNLADDVPKFEEFHQGSYSMHTGVVPLDGNFDIDMGLIFDCKKDKYTDPVALKKKIRDALDTHGRSVNIRRPCVTVNYMRGDEIAYHVDLAVYAKRDDGSLDIAKGKENSEESKRVWEQSDPKKLTEIICTAFTNAYDLAQYRRCIRYLKRWRQVQFSSGAPLSIALTVAAQKWFKPYFEMSGKAGDLQALLNWVNAVLSQFQWASANGSSHLRLAVTLPVIPYGDLMGWMTEGQMSTVKAKFEVLRDALQEALDEDLPEEACKVLNKQFGSDFVVPEKAATARAGVSPVISTGNSA

SEQ ID NO: 3210 - protein, 336 aa, Pseudomonas sp.
MPAVQKQFEDFHTAIKLDNDDEKAKLREKRKVLVDALDANLDEDVPAFETFNQGSYAMHTGVVPLDGNYDIDVGIIFDCNQSKYSDPVVLKKKVRDALDTNGRTVLIRRPCVTVNYMRDGLPEYHVDLVLYTKRDDGLLAIGKGRENSAQEFRFWEAADPKKLTELICSTFTDDKELAQYRRCIRYVKRWRDVQFRNGGAPLSIALTVAAKQWFKPRFEASGKPADLLALLDWVTVILNQFQGAVTDEGYHERLAVYLPVTPGGDLMERMTKQQMETFQSKLEALQDALDEAYNEDLPEDACKVLTKQFGGDFKVPEKAETAKAAVAPVISTGNSA

SEQ ID NO: 3211 - protein, 334 aa, Massilia sp.
MAALQTQFDQFHASIKLGESDEKANLRVKRNTLIQALEARLPDDVPNWEYFHQGSYSMHTGVRPLDGNYDIDIGIVFDCTRDAYPDPVELKKKIRDALDTHGRTVNIRRPCVTVNYMRGGEIEYHVDLALYAKRADGLLDLAKGKEHSAAEHRVWEVSDPEQLTELICNRFEGLDVKQYRRCIRYMKRWRHVRFSSGGPLSIALTVAAYLWFKPYKTTSGTMIDIVALLDWTNAILQRFSYALTDEGFYPRLTVELPTAPYADLMQGMTKNQMDNFKAELELLRETLQAAYEETLPEEAAKKLVKFFGDNFPVPSKSSTAKAVGAAFIGTGNSA

SEQ ID NO: 3212 - protein, 336 aa, Massilia sp.
MYPLIGIAALGLGALLIDSRREKSPAAQAYFDRFHERIRLGEDNEKAELRKKRQILLDDLQANLPPGTPSFEWFNQGSYAMHTGTVPLNSDYDIDIGLIFDCTRAAYKDPVALKVAVRDALKRSRRTVRVRNSCVTAHYLREGQSAYHVDFAVYVKRADGLLDIAKGKEHSEPTRRLWEKSNPQNLTRRLANRFKKDELRQYRRCIRYLKRWRDLHFTSGAPVSIALTAAAYHWFEPRHQLVNSQPLDLLALHSWTKSILNQFKHIQTAEGRYMRLQVELPVEPKLDLLAKMTKAQMLGLQSRLTSLCESLDKAKRASTLDECIRLLSEQFGADFK

SEQ ID NO: 3213 - protein, 381 aa, Massilia namucuonensis
MLLMGESWLGACAYVVQPEPWRSYHWRLENRMWQILGLMGLAVWAFSSKERKRPAPVQLQFERFHNAIKLDADDEQRKLREKREVLLRSLADGLPQDFPKFAHFVQGSYAMRTGVVPLDGNYDIDVGLIFECTEREFPDPVALKRRVRDALAGYGRTVDIRRSCVTVTYIRNGRPDYHVDLALYVRGKSGSLLLAKGREFSGADQCKWVQAFPKELTAYILGRFSGGEQAQFRRCVRYLKRWRDHRFNSDGPISIALTVAAAHWFQPKHGPDGKPSDLEALHALVKKMLEKSGAALGVAGRVIIKIPGPGGCDLMAGMTNRKMAGFRERLSELDRALAQCYGQVDVSAACLELQGQFGVGFTNTVSQNKGVPARKGKLKRI

SEQ ID NO: 3214 - protein, 347 aa, Pelobacter sp.
MANLQKQMNNFHDKIRLKGFEKNERLKDKRDLLIKNLRDNLNSDEDDPKLYFKEFNQGSYAMHTGVKPFKQDQDEFDIDVGLVFDLNAEKHQAYIDDPVELKKRVLKALNHPARTVKVKRPCVTVSYAATNSESGYHVDLACYMTSNSIDGLLDLAKGKLNSAPTEKKWETNDPKGLIEKINNRFPGEDNTESRHQMRRVIRMFKRWRDKQALNKPISISLTCEVYERFQPVQETIPGSGTKPNDQQAFLNLVTDILNNVINDRVYSYLIVYPNSDLNELMTENQMETYISKLNNLKEALQQSIDFICPHEASKKLKNQFGDDFDVLPKEDTAQKAATAIGTTGANA

SEQ ID NO: 3215 - protein, 329 aa, Pseudodesulfovibrio indicus
MSLDLQKHFKKFHEAIELGNLDDTKILREKRDLLIAELNENLEDGLSFAHFNQGSYAMGTGIFPKDGDYDIDVGLLFNATTDDYKNSVELKEKVYDALDRASRNADIRRSCVTVQYVRENVPQYHVDLAIYAKDPNEYSNDIYIAKGKRNSDADKKFWEKSDPKGLLAKVNKYSDDPDERAQMRRVIRYLKKWRDKTLGGEKPYSIALTVCVLNHFIPKRNFNATYNDLEALILLVDTLLFVWGDGLKAMLPVEPFCDLNADLTDIQMSNFKKTMETLKGALLEAADCDLETDACKILRKQFGDDFPVPTEAETSQKTKRAVAPAGASA

SEQ ID NO: 3216 - protein, 336 aa, Halomonas pantelleriensis
MAKLHRYFLEFHKAIKLDDLDENDTLRSKRDTLLQNLKDKLPEGAPNILRTFNQGSYAMGTGTLPLDGDYDIDVGVVFDSTSDEEAPVGLKKIVRDALSHQGRTVNIRRSCVTVSYIKGEDVQYHVDMAIYVPDEQDNLYLAKGKETSLPENCFWEASDPQGLCKAIVNRHTEDNRAQFRRGIRYLKRWRDYKFSHKGVLSISLTVAAYHWFRPYQDWITQEYDDLEALLQLLNTMINQWQFCIHEGELVTRLKLSLPVEPYGDLLEKMTQKQMDDLKNKLIELRDALNDAKAEPAEAAACKTLTKFFGTDFPIPEDEDARAAKVKASVVGTGSSA

SEQ ID NO: 3217 - protein, 326 aa, Sorangium cellulosum
MQFDEAIRFDRDVEKAALAEKRERILRKLSEGIKRQRVEGTTIPSYEPFNQGSYAMNLGVKPIDGDFDLDVGLRFELSKADYPDPVVVKGWVHGALDGHTRKVEVRRSCVTVFYQEGGEDIYHVDLAIYSSGKRNADGKDYIAKGKPGQRADERRWEPSDPQELQNVILSGRSGEDAQQFRRVIRVLKRWKELRLSPQHGRKAPKGIALTVAAHHWFEVSVKKDVFGKTIGYDDLGALKSLVTQMLSRFETVWSAEERRSVVRLRILHPVSRDYDFCSNMSSASMLGFKERLEALLAALNTALGAQDPRAACQALREQLGDDFPLP

SEQ ID NO: 3218 - protein, 335 aa, Sorangium cellulosum
MADVQKYFVQFDEAIRFDRDTEKAILAEKRERILRRLSEGIKRQRVDGTKIPSYETPFNQGSYAMNLGVKPVDGDFDIDVGLRFDLSKDEYPDPVVVKSWVHKALDGHTKKVDVRRSCVTVYYQEGGEDAYHVDLAIYSSGKRNADGKDYIAKGKPGQKAEERRWEPSDPLELQNIIMSGRSEEEAQQFRRVIRVLKRWKELRLSKSHGRAAPKGIALTVAAHHWFQACGKTDVSGKITKYDDLGALSKLVSWMMSKFEPVWNAEERRSVPRLRIENPVSRTYDLCSNMSSASMIGFKAGLEQLLAALKRAEDAVDARAACEALREQLGADFPLP

SEQ ID NO: 3219 - protein, 332 aa, Chondromyces apiculatus
MAQVQKYFDQFDQTIKLRNHHEYAVLAEKRKNILNRLNEGIAQQRKAGAPIPAYRPFNQGSYDIGTGVKPIPGSGGEYDIDVGIEFDVARDAHPSVAVKTWVLNAVAEHTSSVEMRTSCVTVTYMESGKPKYHVDLAVYSSAARNPDRRMYLARGKPHASKEAQTWDLSAPEALTDLLNDRFTGDQGNQFRQAVRALKRWKDHRFPAQGHMAPRGIALAVAVFHWFSPMFTYEQGAPRHDILTALVRFVETLLSQFRHGVDAKGQASTRLQVCCPAEPHDDLCCRMSAEQMKQFHARLETLLSALRAAQTAPDAKTACETLRKEFGNDFPLP

SEQ ID NO: 3220 - protein, 350 aa, Chondromyces crocatus
MANVQKQFESFDETIKLRRYHENATLAEKRERILRRLSEGIKEQRNQGVDIPSYRDFNQGSYDIGTGVKPIGGGEYDIDVGIEFDLPTSDHTPVEVKKWVLRAVEDHTTSVEMRKSCVTVTYVEGGEPKYHVDLAVYSKAQRNPDGKMYLARGKEHSAKEHQEWSPSAPEELTDKINNRFIGDDGRQFRQAIRALKRWKDHRFSREGQSAPRGIALAVAALHWFTPATTMAEGDPQRDTLGALILFLDALLRQFSFTEDSQGERYPRLVVRCPVEPFDDLCARMTAEQMRQFHGRVETLLEALREAQSDPDPHTACMTLQREFGDDFPVPPKDDTGSPRRKAITHSGASG

SEQ ID NO: 3221 - protein, 352 aa, Deinococcus sp.
MADIQRHFETFVNTIKLSGEEEILRQKRTAIVDALRIGLERDFKARGEAVPTFTHFNQGSYSLKTGVKPEGSSNDYDIDVGIVFAEDPKDHADDPVKLKRWVRDALDGHTKDIRIKTPCVTVMYQVGYHVDLAVYAHPDKKTSGELPLSWGKEHAAVQEWQDNHPSKLADLIKQTFPDKEQRRQFRRVLRALKRWRDRKYKSATSHAAPVGVGLTVAGLTWFRPQIDTFNQTANDRLATELFVRQLLANFRDGVWSSKDEASGRRLVVKLPFTPYKDVFERINNSNMGKLEGFLKSLLADLETAGSASSTKDACAAMRRQFGPDFPEGDDTDGTTEGSKKHPPVIVPSHTSG

SEQ ID NO: 3222 - protein, 333 aa, Klebsiella pneumoniae
MATAQTQFENFHSKILMGYDDNEPLRDRRDTLIQELKDKLSSDVPNMKFFHQGSYALHTGINPLNGNPDIDIGIIFECDPNDEDYQDPLKLKKIVRDALNTKNRTVKIKRPCVTVEYLRDGEPIYHIDLALYSCEYGDSDGQTFLARGKETSSAEEIEWQISSARELTDVILNKYTDSSHKKQFRRIVRYLKRWKDEKLGHKNTPSIGLTVAAYEFFSANFDFVSGKAQDLLALLSLVNSMLNNWGGDDRLHIYLPVEPSTDLFERMSDNQMKDLKTKLEKLSAVLIEARDQPDTHEACKLLKAQFGDDFPVPDKSETTKSSSSSVVPAGRSA

SEQ ID NO: 3223 - protein, 333 aa, Unknown
  Description of Unknown: Enterobacteriaceae sequence
MATAQTQFENFHSKILMGYDDNEPLRDRRDTLIQELKDKLSSDVPNMKFFHQGSYALHTGINPLNGNPDIDIGIIFECDPNDEDYQDPLKLKKIVRDALNTKNRTVKIKRPCVTVEYLRDGEPIYHIDLALYSCEYGDSDGQTFLARGKETSSAEEIEWQISSARELTDVILNKYTDSSHKKQFRRIVRYLKRWKDEKLGHKNTPSIGLTVAAYELFSANFDFVSGKAQDLLALLSLVNSMLNNWGGDDRLHIYLPVEPSTDLFERMSDNQMKDLKTKLEKLSAVLIEARDQPDTHEACKLLKAQFGDDFPVPDKSETTKSSSSSVVPAGRSA

SEQ ID NO: 3224 - protein, 367 aa, Klebsiella pneumoniae
MFSQVIECYDFYFVVKNYQAIYYLYLLTKKDILIMATAQTQFENFHSKILMGYDDNEPLRDRRDTLIQELKDKLSSDVPNMKFFHQGSYALHTGINPLNGNPDIDIGIIFECDPNDEDYQDPLKLKKIVRDALNTKNRTVKIKRPCVTVEYLRDGEPIYHIDLALYSCEYGDSDGQTFLARGKETSSAEEIEWQISSARELTDVILNKYTDSSHKKQFRRIVRYLKRWKDEKLGHKNTPSIGLTVAAYELFSANFDFVSGKAQDLLALLSLVNSMLNNWGGDDRLHIYLPVEPSTDLFERMSDNQMKDLKTKLEKLSAVLIEARDQPDTHEACKLLKAQFGDDFPVPDKSETTKSSSFSVVPAGRSA

SEQ ID NO: 3225 - protein, 333 aa, Unknown
  Description of Unknown: Enterobacteriaceae sequence
MATAQTQFENFHSKILMGYDDNEPLRDRRDTLIQELKDKLSSDVPNMKFFHQGSYALHTGINPLNGNPDIDIGIIFECDPNDEDYQDPLKLKKIVRDALNTKNRTVKIKRPCVTVEYLRDGEPIYHIDLALYSCEYGDSDGQTFLARGKETSSAEEIEWQISSARELTDVILNKYTDSSHKKQFRRIVRYLKRWKDEKLGHKNTPSIGLTVAAYELFSANFDFVSGKAQDLLALLSLVNSMLNNWGGDDRLHIYLPVEPATDLFERMSDNQMKDLKTKLEKLSAVLIEARDQPDTHEACKLLKAQFGDDFPVPDKSETTKSSSSSVVPAGRSA

SEQ ID NO: 3226 - protein, 317 aa, Klebsiella pneumoniae
MGYDDNEPLRDRRDTLIQELKDKLSSDVPNMKFFHQGSYALHTGINPLNGNPDIDIGIIFECDPNDEDYQDPLKLKKIVRDALNTKNRTVKIKRPCVTVEYLRDGEPIYHIDLALYSCEYGDSDGQTFLARGKETSSAEEIEWQISSARELTDVILNKYTDSSHKKQFRRIVRYLKRWKDEKLGHKNTPSIGLTVAAYEFFSANFDFVSGKAQDLLALLSLVNSMLNNWGGDDRLHIYLPVEPSTDLFERMSDNQMKDLKTKLEKLSAVLIEARDQPDTHEACKLLKAQFGDDFPVPDKSETTKSSSSSVVPAGRSA

SEQ ID NO: 3227 - protein, 270 aa, Klebsiella pneumoniae
MFSQVIECYGFYFVVKNYQAIYYLYLLTKKDILIMATAQTQFENFHSKILMGYDDNEPLRDRRDTLIQELKDKLSSDVPNMKFFHQGSYALHTGINPLNGNPDIDIGIIFECDPNDEDYQDPLKLKKIVRDALNTKNRTVKIKRPCVTVEYLRDGEPIYHIDLALYSCEYGDSDGQTFLARGKETSSAEEIEWQISSARELTDVILNKYTDSSHKKQFRRIVRYLKRWKDEKLGHKNTPSIGLTVAAYEFFSANFDFVSGKAQDLLALLS

SEQ ID NO: 3228 - protein, 333 aa, Klebsiella pneumoniae
MATAQTQFENFHSKILMGYDDNEPLRDRRDTLIQELKDKLSSDVPNMKFFHQGSYALHTGINPLNGNPDIDIGIIFECDPNDEDYQDPLKLKKIVRDALNTKNRTVKIKRPCVTVEYLRDGEPIYHIDLALYSCKHGDSDGQTFLARGKETSSAEEIEWQISSARELTDVILNKYTDSSHKKQFRRIVRYLKRWKDEKLGHKNTPSIGLTVAAYELFSANFDFVSGKAQDLLALLSLVNSMLNNWGGDDRLHIYLPVEPSTDLFERMSDNQMKDLKTKLEKLSAVLIEARDQPDTHEACKLLKAQFGDDFPVPDKSETTKSSSSSVVPAGRSA

SEQ ID NO: 3229 - protein, 333 aa, Unknown
  Description of Unknown: Enterobacter cloacae complex sequence
MATAQTQFENFHSKILMGYDDNEPLRERRDTLIQELKDKLSSDVPNMKFFHQGSYALHTGINPLNGNPDIDIGIIFECDPNDEDYQDPLKLKKIVRDALNTKNRTVKIKRPCVTVEYLRDGEPIYHIDLALYSCKYGDSDGQTFLARGKETSSAEEIEWQISSARELTDVILNKYTDSSHKKQFRRIVRYLKRWKDEKLGHKNTPSIGLTVAAYELFSANFDFVSGKAQDLLALLSLVNSMLNNWGGDDRLHIYLPVEPSTDLFERMSDNQMKDLKTKLEKLSAVLIEARDQPDTHEACKLLKAQFGDDFPVPDKSETTKSSSSSVVPAGRSA

SEQ ID NO: 3230 - protein, 226 aa, Klebsiella pneumoniae
MFSQVIECYGFYFVVKNYQAIYYLYLLTKKDILIMATAQTQFENFHSKILMGYDDNEPLRDRRDTLIQELKDKLSSDVPNMKFFHQGSYALHTGINPLNGNPDIDIGIIFECDPNDEDYQDPLKLKKIVRDALNTKNRTVKIKRPCVTVEYLRDGEPIYHIDLALYSCEYGDSDGQTFLARGKETSSAEEIEWQISSARELTDVILNKYTDSSHKKQFRRIVRYLK

SEQ ID NO: 3231 - protein, 333 aa, Klebsiella pneumoniae; identical to SEQ ID NO: 3222

SEQ ID NO: 3232 - protein, 332 aa, Klebsiella pneumoniae
MATAQTQFENFHSKILMGYDDNEPLRDRRDTLIQELKDKLSSDVPNMKFFHQGSYALHTGINPLNGNPDIDIGIIFECDPNDEDYQDPLKLKKIVRDALNTKNRTVKIKRPCVTVEYLRDGEPIYHIDLALYSCEYGDSDGQTFLARGKETSSAEEIEWQISSARELTDVILNKYTDSSHKKQFRRIVRYLKRWKDEKLGHKNTPSIGLTVAAYEFFSANFDFVSGKAQDLLALLSLVNSMLNNWGGDDRLHIYLPEPSTDLFERMSDNQMKDLKTKLEKLSAVLIEARDQPDTHEACKLLKAQFGDDFPVPDKSETTKSSSSSVVPAGRSA

SEQ ID NO: 3233 - protein, 326 aa, Methylomonas methanica
MAHAQNQFENFHSEILLGYDESSVLRDRRETLLNDLKNNISKDAPKYDTFNQGSYALYTGITPIAGDPDMDIGVIFECAPEDYPDPLTLKKYVRDALTRHNRTVKIRRPCVTVTYFKDGEATHHIDLAVYSVNGNGQTQLARCRETDAKEDRVWEPSEARELTSKITDQFKDNDRKQFRRVVRALKRWRDNKIGHKNVPSIGLTVAAYHWFTPTYDSVDGKHIDLIAMRNLINQMLARWGFSRLTVKLPVAPDCDLFERMTDTQMKDFKERLETLRNALNEAESQPDTHEACKILQKQFGDDFPVPEKASTTKKTSSGVSVSGRSA

SEQ ID NO: 3234 - protein, 335 aa, Methylomonas methanica
MIRFLRRAKMAHAQNQFENFHSEILLGYDESSVLRDRRETLLNDLKNNISKDAPKYDTFNQGSYALYTGITPIAGDPDMDIGVIFECAPEDYPDPLTLKKYVRDALTRHNRTVKIRRPCVTVTYFKDGEATHHIDLAVYSVNGNGQTQLARCRETDAKEDRVWEPSEARELTSKITDQFKDNDRKQFRRVVRALKRWRDNKIGHKNVPSIGLTVAAYHWFTPTYDSVDGKHIDLIAMRNLINQMLARWGFSRLTVKLPVAPDCDLFERMTDTQMKDFKERLETLRNALNEAESQPDTHEACKILQKQFGDDFPVPEKASTTKKTSSGVSVSGRSA

SEQ ID NO: 3235 - protein, 326 aa, Janthinobacterium sp.
MAYAQTQFEKFHTEILLGFDESTTLRERRDALLNDIKNCISSDAPAYKHFMQGSYALSTGVTPLNGNPDMDIGLSFDCSPDDYEDPLTLKKFVRDALTRNNRTVTIRRPCVTVTYFKDGEATHHIDLAVYSSNSDGQTQLARGRESDPKAERVWDASEAEELTELIVDRFEGDDRNQFRRVVRALKRWRDEKIGHKNVPSIGITVSAYQWFSPSYDSVEGKPRDLIAIRNLANQMLANWNSSRLEVKLPVASYADLFERMTQIQMDDFKSKLETLRDALNEAEAQPDTHEACKILKKQFGNDFPVPEKADSTKKTSAGVSISGRSA

SEQ ID NO: 3236 - protein, 326 aa, Pseudomonas aeruginosa
MARAQTQFESFHRTILFGYDSSQDLRDRRDTLVADLKKNISADAPPYTTFTQGSYALDTGIHPLDGNPDMDIGVLFECSPDDYPDPLVLKKYVRDALERHNRTVNIRRPCVTVTYYRDEAPLHHIDLAVYCSNAAGQTQIAWCRESTSLADREWKPSEARELTEKITSQFSGSDRDQFRRCVRALKRWRDEKIGHKNTPSIGLTVAAYNWFVPRYDPIDGKPIDLIALRDLVDAMLARWTGSRLQVHLPVAPHSDLFERMTDNQMTDLKSRLEELRDALNEADAQADTHEACKILRKKFGEDFPVPEKSDTTKQTSAGVSTSGRSA

SEQ ID NO: 3237 - protein, 326 aa, Pseudomonas aeruginosa
MARAQTQFESFHRTILFGYDSSQDLRDRRDTLVADLKKNISADAPPYTTFTQGSYALDTGIHPLDGNPDMDIGVLFECSPDDYPDPLVLKKYVRDALERHNRTVNIRRPCVTVTYYRDEAPLHHIDLAVYCSNAAGQTQIAWCRESTSLADREWKPSEARELTEKITSQFSGSDRDQFRRCVRALKRWRDEKIGHKNTPSIGLTVAAYNWFVPRYDPIDGKPIDLIALRDLVDAMLARWTGSRLQVHLPVASHSDLFERMTDNQMTDLKSRLEELRDALNEADAQADTHEACKILRKKFGEDFPVPEKSDTTKQTSAGVSTSGRSA

SEQ ID NO: 3238 - protein, 326 aa, Shewanella putrefaciens
MARAQKQFESFHNTILFGYDSSEDLRNRRDTLLADLKENISEDAPPYTTFTQGSYALNTGIHPLNGNPDMDIGVLFECSPDDYPDPLVLKKYVRDALLRHNRTVNIRRPCVTVTYNRDGNPIHHIDLAVYSSNAAAQTQIAWCRESTPLDDREWKPSEARELTEKITNKFSGSDRDQFRRCVRALKRWRDEKIGHKNTPSIGLTVAAYYWFITRYDSIDGKPIDLIALRDLVDAMLAKWMGSRLQVHLPVAPFSDLFEGMTDNQMADLKCRLEDLRDALNEADAQADTHEACKILRKKFGEDFPVPEKSDTTKQTSAGVSTSGRSA

SEQ ID NO: 3239 - protein, 326 aa, Aeromonas hydrophila
MARAQTQFENFHRTILFGYSSSQDLRDRRDTLLADLKKNISKDAPPYQTFTQGSYALDTGIHPLGGDPDMDIGVLFECSPSDYTDPLVLKKFVRDALTRHNRTVNIRRPCVTVAYHTNGDPRYHIDLAVYSSNTNGQTQIAWCRESTPLPDREWKPSEARELTDKINNKFSGNDSDQFRRCVRALKRWRDEKIGHKNTPSIGLTVAAYNWFSPHYDLVDGKPVDLIALRDLVNVMLGRWVGSRLQVCLPVAPYSDLFERMTDTQMADLKSRLEELRDSLNEANAQPDTHEACKILRKKFGEDFPVPEKSDTTRQTSAGVSTSGRSA

SEQ ID NO: 3240 - protein, 267 aa, Pseudomonas sp.
MARAQAQFESFHQAILYGYDRSEELRDRRDTLLEDLNKNISEDAPPFTTFSQGSYALDTGIYPLGGNPDMDIGVLFDCSPSDYPDPLVLKKYVRDALERHNRVALIRRPCVTVTYYRAEVPLHHIDLAVYCTNAIGQTQIAWCRDTTPTSDREWKPSEAQELTATITNRFSGKDRDQFRRCVRALKRWRDAKIGHKNTPSMGLTVAAYNWFVPRYDGVDGRYIDLYALRDLGSVRKMPALGDASLKKASECSFTTRKLRFLSLFRLA

SEQ ID NO: 3241 - protein, 328 aa, Gallionellaceae bacterium
MSDAQSSFTSFHSTIRLDPKNNEMLREKRDTLLKNLKDKINPAAPSYSTFHQGSYELSTGVNPLGGDPDMDVGIIFDCQPEDYGDPVVLKRFVRNALEYINRTVRIRKPCVTVEYLKGGEREMHIDLAIYCTNSSGVTQLARGRESDPTNTDFRYWETSEPKKLNTTIIDAFSGADREQWRRVVRYLKRWRDIKIGHKNIPSIALTVEAIQQFKAVYDKVDGKHRDLIAMRDMLDRILSRWVGKRLQVGLPVEPYCDLLENVTDIQIEDFKTKLTKLRDVLNDADKEADTHEACKLLQGQFGVDFPVPEKSTTTQKTASAISCSGLSA

SEQ ID NO: 3242 - protein, 358 aa, Bacillus mycoides
MANIQKQFEEFHEEIKLKRFKENKELREKRDIITGKIKTGVKSKFEEMEKDVPSLEFIDQGSYAVDLGIVPEDKDYDIDEGVIFNLYKEDYTDSLELKRIIRDILKNHTKTLPKIKNPCVTITYSLDGEPAYHVDLPVYIKSKYDDNLYLAWGKEFAKEEDKYWNPADPEGLNNHIKNSFTDDAKKQFKRIVRYMKKWKDIRFDSSGNSQPPSVGITLAAVDLFSYKQSYDSLSGKFTDDDLCALKDFVSNLKNRFILKWDSELEKTFYAIEYNLPVQPNTNVFSKMSNKQMDSFYQKLNDLENALTEAEGKSDPHEACKILSPKYFGDKFPIPESKEARYKQVGLSSAPSSSSAKGV

SEQ ID NO: 3243 - protein, 358 aa, Virgibacillus chiguensis
MAEIQKQFEEFHDAIKLKRLKESKGLREKRDIITDKIKNGVKTKFEEKKKDVPSLEFIDQGSYAVDLGIVPEDKDYDIDEGVIFDLYKEDYTDSVELKTMIRDILENHTNTPPKIKNPCVTITYSLEDEPVYHVDLPVYLKSKYNNNLYLAWGKEFANKDSKYWDLADPEGLNDHIKNSFTEDAKKQFKRVVRYMKKWKDVCFNSSGNSRPPSIGITIAAVELFSHKQSYNSLSGKLKDDDLGALKDFVSKLKSKFILKWDYDLEKSFYTIEYKLPVQPYSNVFSKMSNNQMDSFYQKLCELEDALIEAEGKSDPHEACNILSPKYFGDKFPIPESKEARYEQVALSSAPSSNSAKGY

SEQ ID NO: 3244 - protein, 358 aa, Bacillus sp.
MADIQKQFEEFHDAIKLKRFKENKELREKRDIITDKIKNGVKTKFEEKEKDAPSLEFIDQGSYAVDLGIVPEDKDYDIDEGVIFDLYKEDYTDSVELKKMIRDILENHTNTPPKIKNPCVTITYSLDDEPAYHVDLTVYLKSKYDNNLYLAWGKEFANKDNKYWDLADPEGLNDHIINSFADDAKKQFKRVVRYMKKWKDICFNSSGNSRPPSIGITIAAVDLFSYKQSYNSLSGKFKDDDLGALKDFVSKLKNRFILKWDTDLEKSFYTIEYNLPVQPYSNVFSKMSNNQMDSFYQKLNELENALTEAEGKSDPHEACKVLSPKYFGDKFPIPESKEARYKQVALSSAPSSNSAIGY

SEQ ID NO: 3245 - protein, 357 aa, Bacillus megaterium
MADIQKQFEEFHSAIKLKRFKENKELREKRDIIINKIKQGIKTKFEEMEKEVPSLEFIDQGSYAVDLGIVPKDKDYDIDEGVIFDLYKEDYTDNLELKKIIKDILENHTSTAPKIKNPCVTITYSLEDEPVYHVDLPVYTKSKYDSNLYLAWGKEFANAENKRWDLADPQGLNDHIRNAFTGDAKNQFKRIVRYMKKWKDVCFNSSGSSRPPSVGITIAAVELFSYKQSYNSLSGNYKDDDLYALKDFVSRLKNKFTLKWDEESEKYFYTITYNLPVQPYSNVFGKMSNTQMDAFYHKLSNLETALTEAEGKSDPHDACKVLSPKYFGDKFPIPESKEARYKQVALSSAPSSNSAKE

SEQ ID NO: 3246 - protein, 358 aa, Bacillus thuringiensis
MTHIQKQFEDFHEAIKLKRFKENAELREKRDIIVSKVKKGVKSRFEEMGKSVPSLEFIDQGSYAVDLGIVPNDKDYDIDEGVIFNLYKEEYTDSLEFKKIIRDILEKHTSTSPKIKNPCVTITYSLDKEPVYHVDLPVYIKSKYDTNLYLAWGKEFASAQNKYWDPADPEGLNNHIKNAFTGDAKKQFKRVIRYMKKWKDVCFSLSGNSRPPSVGITVAAVDLFSYKKSYDSLSGKFKDDDLCALREFVTKLKNRFILTWDFELEKSFHTIEYNLPVQPYKNIFSRMSNSQMDSFYQKLNDLENALMEAEGETDPHEACKILSPKYFGDKFPVPESKQARYKQVALSSAPSSTSAKGD

SEQ ID NO: 3247 - protein, 358 aa, Bacillus thuringiensis
MTHIQKQFEDFHEAIKLKRFKENAELREKRDIIVSKVKKGVKSRFEEMGKSVPSLEFIDQGSYAVDLGIVPNDKDYDIDEGVIFNLYKEEYTDSLELKKIIRDILEKHTSTSPKIKNPCVTITYSLDKEPVYHVDLPVYIKSKYDTNLYLAWGKEFASAQNKYWDPADPEGLNNHIKNAFTGDAKKQFKRVIRYMKKWKDVCFSLSGNSRPPSVGITVAAVDLFSYKKSYDSLSGKFKDDDLCALREFVTKLKNRFILTWDFELEKSFHTIEYNLPVQPYKNIFSRMSNSQMDSFYQKLNDLENALMEAEGETDPHEACKILSPKYFGDKFPVPESKQARYKQVALSSAPSSTSAKGD

SEQ ID NO: 3248 - protein, 361 aa, Bacillus sp.
MADIQKQFEEFHDAIKLKRFKENKELREKRDIITDKIKSGIKTKFEEMDKDVPSLEFIDQGSYAVDLGIVPEDKDYDIDEGVIFDLYKEDYTDSVELKKIIKDILANHTNTPPKIKNPCVTITYSQEDEPIYHVDLPVYIKSKYDNDLYLAWGKEFAADDKKYWDPADPEGLNDHISNSFEGDDKKQFKRIVRYMKKWKDICFSTSGSSRPPSVGITIAAVDLFTPRQAYNSLSGTYKYDDLTALKDFVNNLKSKFVLVWDSEREEYLRTIEYSLPVKPYTNVFSKMTKVQMNSFYQKLVTFEGALADAQSKSDPHDACTVLSPYLGDKFPIPESAQARYQKVALSSAPSSNSAKGWGYEN

SEQ ID NO: 3249 - protein, 353 aa, Caloranaerobacter azorensis
MASIQKQFEKFHDEIKLKRFDENATLREKRDIITNRIKEGLKKKFQNGEEGVPNVEFIDQGSYAVDLGINPDDGNYDIDEGAIFDLYIEDYEDPTEIKKWIRDIMDGHTVIPPIIKNPCVTITYSQNNEPIYHVDIPVYAKSKYDSKLYLAWGKEHSNDDNKYWEPADPIGLNEYINNRFTGDDKKQFKRIVRYMKKWKDICFKSSGNARPPSIGITIAAVEMFMPYTEYNQLSGKLEYVDLIALKNFVWKLKNSFISEWDSDREEYLYTIYLRLPVTPYKNIFSKMSKLQMTDFYYKLGDLYDALQKAEEDCDPHTACKLLANYFGNKFPIPEPKESRYQVNRSNAPSSSSA

SEQ ID NO: 3250 - protein, 353 aa, Clostridium thermoalcaliphilum
MAQIQKQFEDFHDEIKLKRFDENATLREKRDIIIKKIEDGLDDKFKDDENGVPSVEFIDQGSYAVDLGIIPEDGDYDIDEGAIFDLYIEDYSDPTELKKWIKEIMEGHTLTPPKIKNPCVTITYSQDEEPIYHVDIPVYAKSKNDSELYIAWGKEHSNNENKYWDPADPKGLNEHIKNRFSGDDKKQFKRIVRYLKKWKDVCFKSSRNSRPPSVGITIAACEMFNPHTEYNSLSGKTEYVDLKALKNFVWNLKNKFTCEWDSEREEYLYSIYLELPVTPKKDIFSKMSKLQMTDFYNELDELYDALVKAEADSDPHTACKLLVDYFGSKFPVPEAKESRYQVGKSNSPSSFSA

SEQ ID NO: 3251 - protein, 355 aa, Clostridium sartagoforme
MANIQKQLEDFHDEIKLGRLKENAELRDKRDKITKKVKNGLEEYFEDNNMDIPSIEFIDQGSYAIDTGIKPTDGNYDIDEGVIISLNKEDYEDNPTKFKEIVRDIMLTHTSTEPKIKKPCVTITYSENEEPKYHVDLPIYLKSSDDENLYLSWGNETSKTNKDWIFSDPEGLNNHIKNSFSGDDKKQFKRIVRYLKKWKDKVFASETSDGTPPSIGITLIAADKLIPVKETNAITGREEYNDLKSMKCLVDDIKSLFSYKYCIDEEEFLYTIEYKLPVGNQGDVFSKMTNKKMNSFYNKVVKLQTALKYAIDEPDPTKACKELVKYFGDDLKIPESAENRYKTVGASSAPASNFA

SEQ ID NO: 3252 - protein, 355 aa, Clostridium sp.
MANIQKQLEDFHEEIKLGRLKENAELRDKRDKITKKVKNGLEKYFEDNDMDIPSIEFIDQGSYAIDTGIKPKDGNYDIDEGVIISLNKEDYEDNPTKFKEIVRDIMLTHTSTPPKIKKPCVTITYSENKEPKYHVDLPIYLKSSEDENLYLSWGNETSKTNKDWVFSDPEGLNNHIKNSFSGDDKKQFKRIVRYLKKWKDKVFASETSDGTPPSIGITLIAADKLIPLKETNTSTGNEEYNDLKAMKWLVDDIKSLFSYKYCIDEEEFLYTIEYKLPVGNEGDVFSKMTNKKMNSFYDKVVKLQTALQYAIDESDPTKACKELVKYFGDDLKIPESAENRYKTVGASSAPASNFA

SEQ ID NO: 3253 - protein, 355 aa, Clostridium botulinum
MANIQKQLEDFHEEIKLGRLKENAELRDKRDKITKKVKNGLEKYFEDNDMDIPSIEFIDQGSYAIDTGIKPTDGNYDIDEGVIISLYKEDYEDNPTKFKEVVRDIMLTHTNIPPKIKKPCVTITYSENEEPKYHVDLPIYLKSSDDENLYLSWGHETSRSNKDWIFSDPEGLNKHIKNSFSGDDKKQFKRIVRYLKKWKDKEFATETSDGTPPSIGITLIAADNLISVKETNTTTGKEEYNDLKAMKWLVDDIKSLFSYKYCIEEEELLYTIEYKLPVGNEGDVFSKMTNKKMNSFYNKVVKLQTALQYAVDESDPTKACKELVKYFGDDLKIPESAENRYKTVGASSAPASNFA

SEQ ID NO: 3254 - protein, 355 aa, Paeniclostridium sordellii
MANIQNQLEEFHDNIKLGRFKENQELRDKRDIITNKVKNGLEKYFEDKEMEIPSIDFIDQGSYAIDTGIKPSDGNYDIDEGIIIGLYKEDYESNPTIYKEVIEDVMKNHTKIPPKVKKPCVTITYSENNEPSYHVDLPVYLKSNKDDNLYLSWGYKTSKENKEWQLADPSGLNNHIKNAFSGDDKKQFKRIVRYLKKWKDKKFASESNDGTPPSIGLTIIAADKLIPLYETNSTTGKQIPNDLKAMKWLVDDIINLFKYKYCSIEREFLYTIEYNLPVGNNGNVFSKMTNKKMNSFYEKLINLQSALQFALDEKDPNKACTELVKYFGEELPIPESTENRYKTVGVSSAPSSNFA

SEQ ID NO: 3255 - protein, 356 aa, Clostridioides difficile
MADIQNQLIEFHDNIKLGRFDENEELRNKRDIITKKIESGLEKHFKNKEESVPSISFLDQGSYAIDTGIKPKDGDYDIDEGIIIGLYKEDYEDDPIYFKKIVRDIMWAHTKKEPKIKNPCVTITYSINDEPQFHVDLPIYLKSRYDDSLYLSWGKEFALKENKKWEKSDPIGLNSHIRNAFSGDDKRQFKRVVRYLKKWKDEKFVSETSDGTPPSIGLTIIAADEFSPKKEYNTINGKEEYNDLKAMKYLVDYLKSIFEYKYCKDEEEYLYVIEYKLPVGNEANVFSKMKNKKMNAFYEKVVKLQEALEYAINETDPNKACTELAKFFGDQLPIPESIENRYKTVGVSSAPSPNFA

SEQ ID NO: 3256 - protein, 333 aa, Methyloprofundus sedimenti
MADIQEQFNQYHDDIKLSKENEVLREKREILKKNLEDNLPEDAPNIEKFLLQGSYAIYTGINSPNDDYDIDVGVVFDCTSDDYKPMELKEMVRDALDHNSRVPIIKNPCITVQYKKDGKNDYHVDLPVYVKRADDDGYDLAWGKSSLSEEWKHSDPKGLKEDINDISDDEINLAQFRRIVKYLKAWKSKKFTGFDIPSIGITLGVRKEMVFNIGFYDDKPNDLLAMRDTIEKMLSRFSCPGTDDNGNNLYRYEVLLPVTPKNDVFEKLSDKQLTQLKTKLETLKDDLTKAHEEERCEKACEIMKKHFDGFPVPEAKESARATVRSMNNTGSSS

SEQ ID NO: 3257 - protein, 316 aa, Bacillus cereus
MEFLKENMPEGITSPEIFHQGSYAMYTGIKPFEDGDYDIDVGLFFDISKDDYENPVTAKKWVYDALKDKYPNIGMKKPCVAVKFESEEEESNNHYHVDFTIYAAKSSETKVFLAKGKLSSNSENRCWEESDPKELVNKIKTNLTEEKEREQFRRVIRYLKRWKDIKFKGIVNRPTGIGLTVAGLTHFSAKYDYDYFTNTKTYKDLEALEAFVQNMINAFTHVFNATDEEWEERLKVYLPTTPYNDIYEKMSGIQMKSFKEKLQTLLGNLQKARDEVDPVEGCKILAIEFGDDFPIPEESVTAQKRGPAMLVDHSSA

SEQ ID NO: 3258 - protein, 348 aa, Bacillus cereus
MANLQSYFNSFHDNIKLSYDDNKVLRDKRDELLEFLKENMPEGITSPEIFHQGSYAMYTGIKPFEDGDYDIDVGLFFDISKDDYENPVTAKKWVYDALKDKYPNIGMKKPCVAVKFESEEEESNNHYHVDFTIYAAKSSETKVFLAKGKLSSNSENRCWEESDPKELVNKIKTNLTEEKEREQFRRVIRYLKRWKDIKFKGIVNRPTGIGLTVAGLTHFSAKYDYDYFTNTKTYKDLEALEAFVQNMINAFTHVFNATDEEWEERLKVYLPTTPYNDIYEKMSGIQMKSFKEKLQTLLGNLQKARDEVDPVEGCKILAIEFGDDFPIPEESVTAQKRGPAMLVDHSSA

SEQ ID NO: 3259 - protein, 348 aa, Bacillus cereus
MANLQSYFNSFHDNIKLSYDDNKVLRDKRDELLEFLKENMPEGVTSPEIFHQGSYAMYTGIKPFEDGDYDIDVGLFFDISKDDYENPVTAKKWVYDALKDEYPNIEMKKPCVAVKFESEEEENNNHYHVDFTIYAAKSSETKIFLAKGKLSSNSENRCWEESDPKELVNKIKTHLTEEKEREQFRRVIRYLKRWKDIKFKGIVNRPTGIGLTVAGLTHFNAKYDYDYFTNTKTYKDLEALEAFVQNMINAFTHVFNATDEEWEERLKVYLPTAPYNDIYEKMSGIQMKSFKEKLQTLLENLQKARDEVDPVEGCKILAIEFGDDFPIPEESVTAQKRGPAMLVDHSSA

SEQ ID NO: 3260 - protein, 346 aa, Parageobacillus thermoglucosidasius
MANLQSYFNSFHDAIKLDYDDNKELRDKRDELLEILKANMPSDAGSFEIFHQGSYAMYTGVKPLDDGDYDIDVGLLFNISKDDYPNPVTVKKWVYDALTKNYEDVEMKKPCVTVKFKAEGEDERNYHVDFAVYADYESDEKTYLAKGKLNSNAENRYWEESDPKTLVNDIKNHFTDSEDRKQFRRVIRYLKRWKDIKFKGQVNRPSGIGLTVAGLTHFQPKYTYDGFTNTKNYKDLDAIESFVQSMLNTFAWVFNEENELEERLQVYLPTPPYNDIYEKMTGKQMTDFKEKLQCLLDKLQQAKNEADPVVACKLLQEEFGDDFPVPEESTTAQKRGPAIIVDHSSA

SEQ ID NO: 3261 - protein, 346 aa, Geobacillus sp.
MANLQSYFNSFHDAIKLDYDDNKELRDKRDELLEILKANMPSDAGSFEIFHQGSYAMYTGVKPLDDGDYDIDVGLLFNISKDDYPNPVTVKKWVYDALTKDYEDVEMKKPCVTVKFKAEGEDERNYHVDFAVYADYESDEKTYLAKGKLNSNAENRYWEESDPKTLVNDIKNHFTDSEDRKQFRRVIRYLKRWKDIKFKGQVNRPSGIGLTVAGLTHFQPKYTYDGFTNTKNYKDLDAIESFVQSMLNAFAWVFNEENELEERLQVYLPTPPYNDIYEKMTGKQMTDFKEKLQCLLDKLQQAKNEADPVVACKLLQEEFGDDFPVPEESTTAQKRGPAIIVDHSSA

SEQ ID NO: 3262 - protein, 343 aa, Bacillus akibai
MANLQKYFKGFHDAIKLEYDDNKELRDKRDELINFLRENMPKDACPFETFNQGSYSMFTGIKPIDDGDYDIDVALLFNLSKDDYPNPIIVKKWVHDSICMGYDDVEMKKPCVTVKFESGDRKYHVDFAIFSKENQDNNTYMAKGKLHSTPENRCWEHSAPEKLVNDIKGFPIDAQDREQFRRVIRYMKRWKDNKFKGQVNRPSGIGLTVAGLTHFQSKYTFEFFANTRTYNDLDALEIFVQNMLNSFISVLDDDLEWEDRLRVFLPTPPYNDIYGKMTGNQMAHFKEKLECLLEKLQNAKVEMDPVVACELLAEEFGDDFPIPETATTAQKRGPSIIIDNSSA

SEQ ID NO: 3263 - protein, 346 aa, Bacillus toyonensis
MANLQKYFKNFHDTIKLEYDDNKELRDKRDELIEFLKENMPEESCSFETFNQGSYSMFTGVKPIDDGDYDIDVALLFNLSKDDYTNPITVKKWVYDSLCSGYGDVEMKKPCVTVKFESEDENERKYHVDFAVFATKNQDGNTYIARGMLYSMAENRCWEHSDPQKLVNNIKSFPSDSQDREQFRRIIRYMKRWKDNKFKGQVNRPSGIGLTVAGLTHFQAKYTHDFFTNTRTDNDLDALETFVQNMFNSFVQVLNDDLEFEDRLRVYLPTPPYNDIYGKMNGNQMTALKGKLECLLDKLQKAKAEADPVVACKLMAEEFGDDFQIPEASATAQKKGPSIIIDNSSA

SEQ ID NO: 3264 - protein, 345 aa, Bacillus clarkii
MGNLQSYFLSFHDAIKLEIDDNKVLREKREELLDVLKENIDFEEGKYDIFHQGSYTMHTGVKPFEDGDYDIDVGLLFNISTVDYPNPVTTKKLVYNALKDDYENTEMKYPCVTVKFEGEDDEDDRNYHVDFTIYSNENIDGQTYLAKGKLGSGSDNRTWEHSDPKELVRTIKENLTDSEDRKQFRRVIRYLKRWKDLKFKSVVNRPSGIGLTVAGLTHFYPHFSYNAFTKIYDDLDALESFVQNMINSFSCRINDDGEWEDRLEVNLPTPPYNDIYEKMTGSQMKNFKLKLESLRDSLKEARDEADPVKACEILQKVFGQDFPVPTKKESAQQRGPAIMVDNSSA

SEQ ID NO: 3265 - protein, 350 aa, Domibacillus tundrae
MANLQSEFISFHDAIRLDYDDNKELREKRDELMDILKEHISDDAGSYSRFHQGSYAMYTGIKSLDGGDYDIDVGIIFHVNKEDYPNPVTVKKWVYNALCEKYNNVEMKKPCVTVKFESENEGDRNYHVDFAVYIDGKDSNDTIHHAKGKLHSTSEERCWDEADPKELVNKIKNHSSDAKDREQFRRIIRYLKRWKDIKFKGQVNRPSGIGLTVAGLTYFESVYTQDYFSGSDTRYYNDLDALEKFVQNMIYGFRYVWNSETAVSEERLRVELPTPTYNDIYEKMSAGQMSSFKEKLQNFLDKIREAQEETDPVEAAKIMKKEFGDDFPVPEESATAERKGAPILSDTSSA

SEQ ID NO: 3266 - protein, 347 aa, Sporolactobacillus inulinus
MVGLQKYFNDFHKTIKLDDDDNQILRDSREEVLNVIKENIDSDAPSHEIFHQGSYAMKTGINAVSGGDFDIDIGFIFDARRDDYSDPVQLKKLIRDALLNEYDDVKIKSPCVTVNFENAEKQVHVDLAIYINDNNSLFLARGKENSAPENRIWEEADPKELKNKVLNKYKDHEREQFRRTIRYLKRWKDIKFDGDVHRPNGIGITVAGLSYFYPKIDNDFLTGDETPRDIDSLIEFIQNMINNFSDGINIDSDGNIVHNYRLKVNLPVKPFTDIYEKVSDNQMNKFKEKLDKLLEDLQSANGETDISIATGLLHSEFGDDFPVKETDLNNNFVRTTHSAIVNDYPSA

SEQ ID NO: 3267 - protein, 329 aa, Enterococcus raffinosus
MDVEDNTLLKDYKDQVIDGLKDYLPDDVKFETFLQGSYSVYTGIKSCDEKIDFDIDIAVAFEIDHTVYEDPREPKLWVKEALVEIFPNAQVNLKVPCVTATFTGKKTKKNVHVDVAVYAKEDENYFLAKAKEFSAPENRCWEEADPKVLKEKINSHVADSDDRKQFRRCIRYLKRWKDNNFNQEYKPTGIGLTINVMDTFLVNKSTDFLTRKVQYNDMECMKQIVSSLKDSFVYEYSETDGWHYRLHAYLPVKPNSDTYSKMTVNQMSDFKNKLSKLYDDLIFAIDTEDEYEATKRLNNQFGEDFLIISEEEVTEKNLRNAFVTDYPSA

SEQ ID NO: 3268 - protein, 338 aa, Enterococcus faecium
MANIQTSFIDFHNSIRLDVEDNTLLKDYKDQVIDGLKDYLPDDVKFETFLQGSYSVYTGIKSCDEKIDFDIDIAVAFEIDHTVYEDPREPKLWVKEALVEIFPNAQVNLKVPCVTATFTGKKTKKNVHVDVAVYAKEDENYFLAKAKEFSAPENRCWEEADPKVLKEKINSHVADSDDRKQFRRCIRYLKRWKDNNFNQEYKPTGIGLTINVMDTFLVNKSTDFLTRKVQYNDMECMKQIVSSLKDSFVYEYSETDGWHYRLHAYLPVKPNSDTYSKMTVNQMSDFKNKLSKLYDDLIFAIDTEDEYEATKRLNNQFGEDFLIISEEEVTEKNLRNAF

SEQ ID NO: 3269 - protein, 345 aa, Enterococcus faecalis
MANIQKSFTDFHNSIRLDVDDNGLLKDYKDQVVEGLKEHLPESVKFETFLQGSYSVYTGIKSCDENIDFDIDVAVAFEIDRTDYEDPRKPKLWVKEALRKIFPDAEVKLKVPCVTATFSEKDAEKSVHVDVAVYAKEAGNYFLAKAKEFSTSENRCWEEADPKGLKEKINSHIADSDDRSQFRRCIRYLKRWKDNKFSQEYKPTGIGLTINVMDKFLAKKSTDILTGKVEYNDLDCLKQIVYSMKNSFEYEYNDTDEWHYRLHAVLPVKPNSDTYSKMTGNQMSNFKDKLSKLYDDLIFATETEDEHDATKRLNYQFGEDFLIISEKEVTENNLRNAFVTDYPSA

SEQ ID NO: 3270 - protein, 345 aa, Enterococcus faecium
MANIQKSFTDFHNSIRLDVDDNGLLKDYKDQVVEGLKEHLPESVKFETFLQGSYSVYTGIKSCDENIDFDIDVAVAFEIDRTDYEDPRKPKLWVKEALKKIFPEAEVKLKVPCVTATFSEKDAEKSVHVDVAVYAKEAGNYFLARAKEFSTSENRCWEEADPKGLKEKINSHIADSDDRSQFRRCIRYLKRWKDNKFSQEYKPTGIGLTINVMDKFLAKKSTDILTGKVEYNDLDCLKQIVYSMKNSFEYEYNDTDEWHYRLHAVLPVKPNSDTYSKMTGNQMSNFKDKLSKLYDDLIFATETEDEHDATKRLNYQFGEDFLIISEKEVTENNLRNAFVTDYPSA

SEQ ID NO: 3271 - protein, 345 aa, Enterococcus faecium
MANIQKSFTDFHNSIRLDVDDNGLLKDYKDQVVEGLKDHLPESVKFETFLQGSYSVYTGIKSCDENIDFDIDVAVAFEIDRTDYEDPRKPKLWVKEALIKIFPDAEVKLKVPCVTATFSEKDAEKSVHVDVAVYAKEAGNYFLAKAKEFSTSENRCWEEADPKGLKEKINSHIADSDDRSQFRRCIRYLKRWKDNKFSQEYKPTGIGLTINVMEKFLAKKSTDFLTGKVEYNDLDCLKQIVYSMKNSFEYEYNDTDEWHYRLHAVLPVKPNSDTYSKMTGNQMSNFKDKLSKLYDDLVFATETEDEHDATKRLNYQFGEDFLIISEKEVTENNLRNAFVTDYPSA

SEQ ID NO: 3272 - protein, 346 aa, Massilibacterium senegalense
MVDMQKHFTNFHDEIKLDYEDNSLLRDYRDQVISGLEDHLDIDHSFSHFLQGSYAMHTGIKSIDENIDFDIDIALSIDMKREDCINPVTAKKWVKEAMEKEFPSAEIKIKKPCVTISFAGDSNDENVHVDIAIYANEDGNYFLAKGKEFSSSENRYWEEADPKELKNKITNSYDGVDDRKQFRRCIRYLKRWKDEKFNQENRPNGIGITVSALENFYPYSVTDAFSGKKTYNDLDALENFVKNMLNSFAETYNFEEDTWYSRLKVYLPVKPRTDIYEQMTDKQMNDFKDKLKNLSEDLEYAKNTLDEHEATKRMNKHFGDDFIIVSEEDVVSKAERNAFVSDYPSA

SEQ ID NO: 3273 - protein, 347 aa, Tetragenococcus halophilus
MVDLQKNFITFHDKIKLEYEDNSLLRDYKDQVLDGLKKNLDIDHQFSPFVQGSYSVFTGIKSSDVDIDFDIDIGIELDINRNDYEDPVKLKVFVRDAMKLTFPQSKVEIKKPCVTINFSDKNSGESVHVDIALYAKENGSYYLARGNEYGNYENRYWEEAEPKKLKDKINNFSEDPDARKQFRRCIRYLKRWKDNKFNQENRPTGIGITSLALQNFKSKKSVDLFAGSTTYNDLQALKEFVSILTKSFTCPAYDEKNGTNYMRIEADLPVSPHSDTFCKMTAKQMKDFKIKLDSLYEDLNYAGDTFDKHEATKLLNKQFGNDFEIVSEQNVSEQSRNNGFITDYPSA

SEQ ID NO: 3274 - protein, 340 aa, Streptococcus sp.
MDTLQSQFIKFHDTIKLDAKDKQVLIEKREEVEEIINNGVSEFEKSFFNQGSYSTFTGILPLEDGDYDLDRGLRFEIDRNSNTPKEIKKIIFNTLVSKFGENNVKVKNPCVTVSFPKDNVHIDIAVYCIENDNYFLARGKLNSKEENIKWEEADPVELTEKINNAMENSEDRKQFRRVIRYLKRWKDIKFKNQDNKPTGIGISVFAVKNFTVCKNEDYLSGNTTYDDISALRNLVNTMINSFSNTYDVDRNLFYPRLKVFLPVKPYTDVYERVSNIQMEAFKNKLEKLRDSLDEAIYSTDLSESTKLLSKQFGDDFPVIEQKETAENFGTRAIISDYPSA

SEQ ID NO: 3275 - protein, 340 aa, Streptococcus sp.; identical to SEQ ID NO: 3274

SEQ ID NO: 3276 - protein, 340 aa, Streptococcus parasanguinis
MDTLQSQFIKFHDTIKLDADDKKVLIDKRKEVEEAINKGVSEFEKSFFNQGSYSTFTGILPLEDGDYDLDRGLRFEIDRNSNTPKEIKKIIFNTLVSKFGENNVKVKNPCVTVSFPKDNVHIDIAVYCIENDNYFLARGKLNSKEENIKWEEADPVELTEKINNAMENSEDRNQFRRVIRYLKRWKDIKFKNQDNKPTGIGISVFAVNNFSVSKKVDYLSGNATYDDISALRNLVNTMINSFSDTYDVDRNLFYPRLEVSLPVKPYTDVYERVSNIQMEAFKNKLEKLRDSLDEAIDSTDLSDSTKILSKQFGDDFPIIEQKETAENFGTRAIISDYPSA

SEQ ID NO: 3277 - protein, 340 aa, Streptococcus gordonii
MPTIQSQFIKFHDTIKLDADDKKVLIDKRKEVEEAINKGVSEFGKSFFNQGSYSTHTGILPIDEGDYDLDRGLKIDVDRYSYSPKEVKNFIFDALVSEFGENRVKVKNPCVTVSFPEDSVHIDIAVYCTENDNYFLARGKLNSTDENIKWEEADPVELTKKINNAMENSEDRNQFRRVIRYLKRWKDLKFKNQDNRPTGIGISVFAVNNFSVSKKVDYLSGNTTYDDISALRNLVNTMINSFSNIYDVDRNLFYPRLEVFLPVKPYTDVYERVSNIQMEAFKNKLEKLRDSLDEAIDSTDLSESTKILSKQFGDDFPVIEQKETAENFGTRAIISDYPSA

SEQ ID NO: 3278 - protein, 340 aa, Unknown
  Description of Unknown: Streptococcus sequence
MPTIQSQFIKFHDTIKLDADDKKVLIDKRKEVEEAINKGVSEFGKSFFNQGSYSTHTGILPIDEGDYDLDRGLKIDVDRYSYSPKEVKNFIFDALVSEFGENRVKVKNPCVTVSFPEDSVHIDIAVYCTENDNYFLARGKLNSTDENIKWEEADPVELTKKINNAMENSEDRNQFRRVIRYLKRWKDLKFKNQDNRPTGIGISVFAVNNFSVSKKVDYLSGNTTYDDISALRNLVNTMINSFSNTYDVDRNLFYPRLEVFLPVKPYTDVYERVSNIQMEAFKNKLEKLRDSLDEAIDSADLSESTKILSKQFGDDFPVIEQKETAENFGTRAIISDYPSA

SEQ ID NO: 3279 - protein, 340 aa, Streptococcus suis
MPTLQSQFIKFHDTIKLDADDKKVLIDKRKEVEEVINNGVSEFGKSFFNQGSYSTYTGILPIDEGDYDLDRGLKIDVDRHSNSPKEVKKFIFDALVSEFGENRVKVKNPCVTVSFPEDNVHIDIAVYCTENDNYFLARGKLNSNYENIKWEEADPVELTKKINNAMENSEDRNQFRRVIRYLKRWKDLKFKNQDNRPTGIGISVFAVSNFSVSKKVDYLSGNTTYDDISALRNLVNTMINSFSDTYDVDRNLFYPRLEVYLPVKPYTDVYERVSNIQMEAFKNKLEKLRDSLDEAINSTDLSESTKVLSKQFGDDFPIIEQKETAENFGTRAIISDYPSA

SEQ ID NO: 3280 - protein, 340 aa, Streptococcus suis
MPTLQSQFIKFHDTIKLDADDKKVLIDKREKVEEVINNGVSEFGKSFFNQGSYSTYTGILPIDEGDYDLDRGLKIDVDRHSNSPKEVKKFIFDALVSEFGENRVKVKNPCVTVSFPEDNVHIDIAVYCTENDNYFLARGKLNSIDENIKWEEADPVELTKKINNAMENSEDRYQFRRVIRYLKRWKDLKFKNQDNRPTGIGISVFAVSNFSVSKKVDYLSGNTTYDDISALRNLVNTMINSFSDTYDVDRNLFYPRLEVYLPVKPYTDVYERVSNIQMEAFKNKLEKLRDSLDEAINSTDLSESTKVLSKQFGDDFPIIEQKETAENFGTRAIISDYPSA

SEQ ID NO: 3281 - protein, 340 aa, Streptococcus azizii
MPTLQSQFIKFHNTIKLDADDKKVLIDKRKEVEEVINNGVSEFGKSFFNQGSYSTYTGILPTDEGDYDLDRGLKIDVDRHSNSPKEVKKFIFDALVSEFGENRVKVKNPCVTVSFPEDNVHIDIAVYCTENDNYFLARGKLNSIDENIKWEEADPVELTKKINNAMENSEDRNQFRRVIRYLKRWKDLKFKNQDNRPTGIGISVFAVSNFSVSKKVDYLSGNTTYDDISALRNLVNTMINSFSDTYDVDRNLFYPRLEVYLPVKPYTDVYERVSNIQMEAFKNKLEKLRDSLDEAINSTDLSESTKVLSKQFGDDFPIIEQKETAENFGTRAIISDYPSA

SEQ ID NO: 3282 - protein, 340 aa, Streptococcus suis
MPTLQSQFIKFHDTIKLDADDNKVLIDKRKEVEEIINNGVSEFGKSFFNQGSYSTYTGILPIDEGDYDLDRGLKIDVDRQSNSPKEVKKLIFDALVSEFGENRVKVKNPCVTVSFPEDNVHIDIAVYCTESDNYFLARGKLNSIDENIKWEEAAPIELTKKINNAMENSEDRNQFRRVIRYLKRWKDLKFKNQDNRPTGIGISVFAVSNFSVSKKVDYLSGNTTYDDISALRNLVNTMINSFSDTYDVDRNLFYPRLEVYLPVKPYTDVYERVSNIQMEAFKNKLEKLRDSLDEAINSTDLSESTKVLSKQFGDDFPIIEQKETAENFGTRAIISDYPSA

SEQ ID NO: 3283 - protein, 340 aa, Streptococcus suis
MPTLQSQFIKFHDTIKLDADDNKVLIDKRKEVEEIINNGVSEFGKSFFNQGSYSTYTGILPIDEGDYDLDRGLKIDVDRHSNSPKEVKKLIFDALVSEFGENRVKVKNPCVTVSFPEDNVHIDIAVYCTESDNYFLARGKLNSIDENIKWEEAAPIELTKKINNAMENSEDRNQFRRVIRYLKRWKDLKFKNQDNRPTGIGISVFAVSNFSVSKKVDYLSGNTTYDDISALRNLVNTMINSFSDTYDVDRNLFYPRLEVYLPVKPYTDVYERVSNIQMEAFKNKLEKLRDSLDEAINSTDLSESTKVLSKQFGDDFPIIEQKETAENFGTRAIISDYPSA

SEQ ID NO: 3284 - protein, 340 aa, Streptococcus suis
MPTLQSQFIKFHDTIKLDADDNKVLIDKRKEVEEIINNGVSEFGKSFFNQGSYSTYTGILPIDEGDYDLDRGLKIDVDRHSNSPKEVKKLIFDALVSEFGENRVKVKNPCVTVSFPEDNVHIDIAVYCTESDNYFLARGKLNSIDENIKWEEAAPIELTKKINNAMENSEDRNQFRRVIRYLKRWKDLKFKNQDNRPTGIGISVFAVSNFSVSKKVDYLSGNTTYDDISALRNLVNTMINSFSDTYDVDRNLFYPRLEVYLPVKPYTDVCERVSNIQMEAFKNKLEKLRDSLDEAINSTDLSESTKVLSKQFGDDFPIIEQKETAENFGTRAIISDYPSA

SEQ ID NO: 3285 - protein, 340 aa, Streptococcus agalactiae
MPTLQSQFIKFHDTIKLDVDDNKVLIDKRKEVEEIINNGVSEFGKCFFNQGSYSTYTGILPIDEGDYDLDRGLKIDVDRHSNSPKEVKKFIFDALVSEFGENRVKVKNPCVTVSFPEDNVHIDIAVYCTESDNYFLARGKLNSIDENIKWEEADPIELTKKINNAMENSEDRNQFRRVIRYLKRWKDLKFKNQDNRPTGIGISVFAVSNFSVSKKVDYLSGNTTYDDISALRNLVNTMINSFSDTYDVDRNLFYPRLEVYLPVKPYTDIYERVSNIQMEAFKNKLEKLRDSLDEAINSTDLSESTKVLSKQFGDDFPIIEQKETAENFGTRAIISDYPSA

SEQ ID NO: 3286 - protein, 340 aa, Streptococcus agalactiae
MPTLQSQFIKFHDTIKLDVDDNKVLIDKRKEVEEIINNGVSEFGKCFFNQGSYSTYTGILPIDEGDYDLDRGLKIDVDRHSNSPKEVKKFIFDALVSEFGENRVKVKNPCVTVSFPEDNVHIDIAVYCTESDNYFLARGKLNSIDENIKWEEADPIELTKKINNAMENSEDRNQFRRVIRYLKRWKDLKFKNQDNRPTGIGISVFAVSNFSVSKKVDYLSGNTTYDDISALRNLVNTMINSFSDTYDVDRNLFYPRLEVYLPVKPYTDVYERVSNIQMEAFKNKLEKLRDSLDEAINSTDLSESTKVLSKQFGDDFPIIEQKETAENFGTRAIISDYPSA

SEQ ID NO: 3287 - protein, 340 aa, Unknown
  Description of Unknown: Streptococcus sequence
MPTLQSQFIKFHETIKLDADDKKVLIDKRKEVEEAINKGVSGFGKSFFNQGSYSTYTGILPIDEGDYDLDRGLKIDVDRQSHSPKEVKKFIFDALASEFGENSVKVKNPCVTVSFPEDNVHIDIAVYCTENDNYFLARGKLNSTDENIKWEEADPVELTKEINNAMENSEDRNQFRRVIRYLKRWKDLKFKNQDNRPTGIGISVFAINNFSVSKKVDYLSGKTTYDDISALRNLINTMINSFSDRYDVERKLFYPRLEIILPVKPNTDVYEKVSNIQMEDFKNKLEKLRTSLDEAIEATDLSESTKILSKQFGDDFPIIEQNETAENFGTKAIISDYPSA

SEQ ID NO: 3288 - protein, 347 aa, Streptococcus pneumoniae
MPTLQSQFIKFHETIKLDADDKKVLIDKRKEVEEAINKGVSGFGKSFFNQGSYSTYTGILPIDEGDYDLDRGLKIDVDRQSHSPKEVKKFIFDALASEFGENSVKVKNPCVTVSFPEDNVHIDIAVYCTENDNYFLARGKLNSTDENIKWEEADPVELTKEINNAMENSEDRNQFRRVIRYLRRVIRYLKRWKDLKFKNQDNRPTGIGISVFAINNFSVSKKVDYLSGKTTYDDISALRNLINTMINSFSDRYDVERKLFYPRLEIILPVKPNTDVYEKVSNIQMEDFKNKLEKLRTSLDEAIEATDLSESTKILSKQFGDDFPIIEQNETAENFGTKAIISDYPSA

SEQ ID NO: 3289 - protein, 340 aa, Streptococcus mitis
MPTLQSQFIKFHETIKLDDDDKKVLIDKRKEVEEAINKGVSGFGKSFFNQGSYSTYTGILPIDEGDYDLDRGLKIDVDRQSNSPKEVKKLIFDALASEFGEKSVKVKNPCVTVSFPEDNVHIDIAVYCTENDNYFLARGKLNSTDENIKWEEADPIELTKEINNAMENSEDRNQFRRVIRYLKRWKDLKFKNQDNRPTGIGISVFAINNFSVTKKVDYLSGKTTYDDISALRNLINTMINSFSDRYDVERKLFYPRLEVILPVKPYTDVYERVSNIQMEAFKNKLEKLRDSLDEAISSTDLSESTKVLSKQFGDDFPIIEQKETAENFGTRAIISDYPSA

SEQ ID NO: 3290 - protein, 340 aa, Lactococcus lactis
MEKLQANFIQFHNAIRLEMDDKSILIEKRKEVEEAITTGVSEFKVDFFNQGSYSTFTGVLPFEDGDYDIDRGAIANFSREDMSPKKAKEILYNALVKTFGSNSVKVKQPCVTVSFPENGVHVDVALYCNEDSNVFLARGKLGSAEENTSWEEADPKTLTKSINEAMNNVDDRNQFRRIIRYLKRWKDINFKNQENRPTGIGISVFAVKHFTPNKKIDNLSWSTQYDDANALKDFVSLMIANFRSVFDSDKVEYYPRLEVTLPVKPWTDVYCKVSNVQMKDFHDKLITLNEALENAINSSDLHEATKILNKQFGDEFQIVSQEETAKQFNRRAIISDHPSA

SEQ ID NO: 3291 - protein, 340 aa, Lactococcus lactis
MEKLQANFIQFHDAIRLEMDDKSILIEKRKEVEEAITTGVSEFKVDFFNQGSYSTFTGVLPFEDGDYDIDRGAIANFSREDMSPKKAKEILYNALIKTFGSNSVKVKQPCVTVSFPENGVHVDVALYCSEDSNVFLARGKLGSAEENTSWEEADPKTLTKSINEAMNNVEDRNQFRRIIRYLKRWKDINFKNQENRPTGIGISVFAVKYFTPNKKIDNLSWSTQYDDANALKDFVSVMIANFRSVFDRDKEEYYPRLEVTLPVKPWADVYCKVSNVQMKDFHDKLIILNEALENAINSSDLHEATKILNKQFGDEFQIVSQEETAKQFKRRAIISDHPSA

SEQ ID NO: 3292 - protein, 345 aa, Niastella koreensis
MGSIVQNQFIKFHGKIRLDMDNIKAVIEKRDMLIDEIRAYIKKMCENDEIELVKFETFNQGSYSMGTGIKPQNEDDDYDIDCGLLFEISIDDYSPIRVKQWVFDALNNNEFRTVEWKKACVRVQYIEEGLPKFHVDFASYSNTNDDDKIFLAKGTPTSTTDNKKWEETQPKKLRDLINDKFDDEEECSQFKRVIRYAKRWKDNQFTSVNGKPTGIALTALAYEGFKPYTKDLFTSEVDINDLKATKDFVGYILSHYNWLTNRISIQLPVPPHNDLFEKMTDQQCKELKQKLEKLRDCLIESEQETDPHEACKILKKQFGDDFPVPVKEETGQNRKKAIAGTSESA

SEQ ID NO: 3293 - protein, 347 aa, Clostridium perfringens
MGLQKYFEDFNKKIKMDYEELSELANKRDILLKKLRDSDDIPSFEEFNQGSYSMFTGVEPLDKEYDIDVGLRFNVNKSDYEPLYLKEKIQEVLKNHTEYGADIKQPCVTVKYKKDGEIAYHIDLVVYSYEDKNDKESQMYLARGKKYSNDENKKWEEADPINLKNKIMNKWEDKEIKNQYRRIIRYLKRWKNLKFSSDGNSEPPGIGITLLAYEKFEPKTYDYLESKYIFDDLEALISLIEKIKEMFKCVEYSVDSDRFLYKIEVNLPVAPKTNVFSKMTNIQMTNFKDKIDDLYKNLIEVRNEAELVEQCKLLNKIFGEDFDIPSKEETAKNQSRTILTSSTSGKR

SEQ ID NO: 3294 - protein, 347 aa, Clostridium perfringens; identical to SEQ ID NO: 3293

SEQ ID NO: 3295 - protein, 348 aa, Clostridium sporogenes
MSLQTYFEEFNKKIKMDYDELSELAEKRDILLSKLRADKDLPSFEELNQGSYSMFTGVEPLDKDYDIDVGLRFKVNKNDYEPVDLKEKIYDILKNHTEYGAEIRQPCVTVKYKKDGELAYHIDLVVYAYEDKGDTRSQLYLARGEKYSSEDNKYWEESDPVGLTNTIMNKYSDKDKRAQYRRIIRYMKRWKNIEFSSDGNNEPPGIGITLLAYEKFTPQKYDWLESKYIFEDIKALISFVQEINSMFICEEYSVDREEWLYKIELNLPVTPYTNVFYKMSLIQMTNFKKKIGKLLNDLEAVNEEADIVEQCTKLNKIFGEDFPIPDKEKESKKQRNFAPPSSASGKDI

SEQ ID NO: 3296 - protein, 344 aa, Inediibacterium massiliense
MGLQKYFDEFNKKIKMDYDENSLLAEKRDILLEKLEKAEDLPSFKKLDQGSYSMFTGVEPLDKDYDIDVGLRFEINKDDIEPVELKEKVYDVVKNHTHNVEIRKPCITVYYKEDGEIAYHVDLVVYAYEDKEDTDSQLYLARGTKYSKDENKYWEEADPKGLKDKIMNKFEEAEERAQYRRIIRYLKRWKNIKFSSDGNAEPPGIGITLLAYEFFDPKEYDILQCKYVFNDLKALKNLVEKIIDRFIPVEYSQVREEYLYEIELNLPVQPYTNVFSKMSNNYMTDFKNKLEKLLKCLKEVDEECDVIEQCKLLAKEFGEDFPIPTAEEVSKRQEKSILSNSHSA

SEQ ID NO: 3297 - protein, 356 aa, Varibaculum timonense
MSLQNQFTEFHNKIKISESKLSTLREKRDIVIEKLRDSGKLPSFEKLDLGSYSMNTGVEPCDRGENTKDYDIDVGLRFNVNTSEYEENPIELKELIDEILKDHTEYGSEIKQPCVTVKYKKDGELAYHLDLVVYAYEDKDDKNSQLYLSRGKNNSSKENKYWEKADPIGLKNLIIKKYEGDNSEEKEKRAQYRRVIKYLKRWKDVQFSSDGNNEPPGIGITLLVYELFEPSEYDYLESRFIANDFEALKNVVFKIKNEFRDYYDFEKGVWYKKIEYKIPVEPYSNVFSKMTGAQMTRFWEKIDKLHDGLVEVSEESDLIKQCEKLAKLLGDDFPIPKKVDTSKKKSSAIAPSNVSG

SEQ ID NO: 3298 - protein, 343 aa, Candidatus Gastranaerophilales bacterium
MSVQTEFKAFSDRIKLDYDVRSELASKRDILIQKLRDSGELPSFDKYDQGSYGMYLGTEPVEDREYDIDVGLRFNVNKSDYTPMELKETICNILENHTEYGAKIKKPCVTVTYKKNGEPSYHVDLVVYTYDDKTDTQSQMYLARGKDKDSDETCWEKSDPVGLVNYINDAVEKGEERDQFRRCIRYLKRWKNIRFSSNGHAEPASIGITLIAADYFEYIKDDDLSALKNLTDKIISLFEKNTYDSEGERWLYRLTYPMPDSLNFESNTDAFCKMTDIQMTDFKDKIEKLYRDLQNVEKEPDEVEQCSMLQKIFGDDFNIPESDSVSKKQFNYIPASSASGGSL

SEQ ID NO: 3299 - protein, 340 aa, Lachnospiraceae bacterium
MSVQSEFIGFHERIKLDYDVRSELASKRDILIDKLRRSGKLPGFTEFNQGSYGMYLGVEPIDGKEYDIDVGLRFNVNKADYDPMDLKDTICEVLKNHTEYGAKIKKPCVTVTYKKDGEPSYHVDLVVYVYEDKQDSSSQLFLARGINAESEETCWEKSDPLGLIDYINDAVTQGDERDQFRRVVRYLKRWKNRRFSSTGHSEPASIGITLIAADYFKSVSNDDLAALKNLVDDMLALFVIKTYEDGRWLYRITYPMPASLDFESGTDAFNKMTDIQMTDFKDKLDKLSRDLADVQKEPDEVEQCKKLNKIFGDDFHVPEAKNVSKKQSTYIPSSSASGAL

SEQ ID NO: 3300 - protein, 341 aa, Lachnoclostridium sp.
MSIQSEFLNFYERIKLDYEVNAELADKRDILLGILRNSDRLPGFDEYNQGSYSMHLGIEPTDGREYDIDVGLRFNADKDDYEPMEIKNIIANILDGHTDYGATIKKPCVTVTYKKDGEPTYHVDLVTYLYEDHTDKESQLYLARGKDSKPEEIKWEKSDPVGLVDYINHKIDKGDERDQFRRVIRYIKRWKNRRFNSQGHAEPASIGITLIVVDNFVACLDDDLGALLAAVKSIQGLFKIEKFEDDRWLYRLKCPMPSILKFENNTDAFEKMTDIQMTDFKEKLEKLIRDLEAVQGEADEIEQCKKLQRIFGEDFHVPEAKNISKIQHDYIPPISASGVMN

SEQ ID NO: 3301 - protein, 353 aa, Unknown
  Description of Unknown: uncultured Blautia sp. sequence
MSLQTYFKEFNKVIKMDYDVKSELKEKRDILLGILRNDDDMPAFDEYNQGSYSMHLGVEPLDKEYDIDVGLRFHVNRDDYEPMDLKEKIRDLLKNHTEYGAKIKKPCVTVTYKKDGEAAYHVDLVTYVYEDKDDSDSQLYLARGKNRDSEETCWEKSDPVGLVEYVNDKYKGDDNKEDREQFRRVVRYIKRWKNKKFSSSGNAEPPSIAITLIAVDHFEASKKYDYIEEKYCYDDLQAVISFAKENQKLFVFKEVNENGRLMYTIEYNLPSSLNFESDVNLFRKMSDNYMTDFKEKIDDLVDDLEAVKSETDEVEQCKMLSKIFGDDFPIPEKKNAAKKQMNFIPSTSASGVD

SEQ ID NO: 3302 - protein, 353 aa, Blautia sp.
MSLQTYFKEFNKVIKMDYDVKSELKEKRDILLGILRNDDDMPAFDEYNQGSYSMHLGVEPLDKEYDIDVGLRFHVNRDDYEPMDLKEKIRDLLKNHTEYGAKIKKPCVTVTYKKDGEAAYHVDLVTYVYEDKDDSDSQLYLARGKNRDSEETCWEKSDPVGLVEYVNDKYKGDDNKEDREQFRRVVRYIKRWKNKKFSSSGNAEPPSIAITLIAVDHFEASKKYDYIEEKYCYDDLQAVISFAKEIQKLFVFKEVNENGRLIYTIEYNLPSSLNFESDVNLFRKMSDNYMTDFKEKIDDLVDDLEAVKSETDEVEQCKMLSKIFGDDFPIPEKKNAAKKQMNFIPSTSASGVD

SEQ ID NO: 3303 - protein, 353 aa, Unknown
  Description of Unknown: uncultured Eubacterium sp. sequence
MSLQTYFKEFNKVIKMDYDVKSELKEKRDILLGILRNDDDMPAFDEYNQGSYSMHLGVEPLDKEYDIDVGLRFHVNRDDYEPMDLKEKIRDLLKNHTEYGAKIKKPCVTVTYKKDGEAAYHVDLVTYVYEDKDDSDSQLYLARGKNRDSEETCWEKSDPVGLVEYVNDKYKGDDNKEDREQFRRVVRYIKRWKNKKFSSSGNAEPPSIAITLIAVDHFEASKKYDYMEEKYCYDDLQAVISFAKEIQKLFVFKEVSENGRLIYTIEYNLPSSLNFESDVNLFRKMSDNYMTDFKEKIDDLVDDLEAVKSETDEVEQCKMLSKIFGDDFPIPEKKNAAKKQMNFIPSTSASGVD

SEQ ID NO: 3304 - protein, 351 aa, Clostridium sp.
MSLQKYFRDFNKTIKMDYDVKSELASKRDILLKKLRDSNELPGFTELNQGSYIMYTGVEPLDKEYDIDVGLRFNVNKNDYESPMELKNKICDILKNHTEYGAKVKKPCVTVTYKKNGETAYHVDLVVYTYEDKDDMESQLYLARGKDSIPEEICWEKSDPKGLVDYINNKFETETKDREQYRRVIRYMKRWKNLKFSSSGNAEPPSIGITLIAADKFEVSKSYDYLEEEWKYDDLEALIGFAKAIQNLFKLQGVSENGRLLYRIKYPLPSSLNFESDTDIFKKMTDSYMTDFKDKVDRLVNDLEEVKEEADEVEQCKLLNKIFGDDFKIPEKKNASKKQVNCIPVSSSSGV

SEQ ID NO: 3305 - protein, 351 aa, Eubacterium eligens
MSLQKYFKDFNKTIKMDYEVKAELASKRDILLGKLRDSGKLPAFCELNQGSYIMYTGVEPLDKEYDIDVGLRFKVNKEDYENPVELKNTIYDILQSHTEYGAEVKKPCVTVTYKKDGEAAYHVDLVVYTYEDKDDIDSQLYLARGKDNTPEEICWEKSDPKGLVDYINDKYEADSEERAQYRRVIRYMKRWKNLKFNSSGNAEPPSIGITLIAADKFEVYRTYDYLEEKWKYDDLEALIGFAKEIQNLFIFQGVSDNGRLLYRIKYPLPSSLNFEDDTDVFKKMTDIYMTDFKDKIDKLITDLEEVKKEVDEVEQCKLLNKIFGDDFKVPETKDASKKQMNYIPSSSSSGV

SEQ ID NO: 3306 - protein, 342 aa, Clostridium novyi
MMSIQSEFKKFNEKIRLDYGTNSELAEKRDTLLRILENDKDLPSFKKLDQGSYAMYTGIKPGDGREYDIDVGLRFNVNKSEYDPMDLKEDIEKLLKNHTEYGAEIKKPCVTVTYKKDGEPSYHVDLVVYVYEDKDNTDSQIYIAKGIKGNKDSQKWDKADPKGLVEHINNGVEMGKQRDQFRRMLRYLKRWKHRRFDAKGHSEPSSIGLNLIALDNFIYYEEDDLSALIHIVDSIVNSFRFEGIDKDGDFLYRIKSPLPIELDFELNSDVFEKMSDRQMTDFKEKAEKLQSDLNGVENETDEHEKYKKLQKIFGDDFEVPEEEKTAKKQYNYIPSSSSSGME

SEQ ID NO: 3307 - protein, 341 aa, Unknown
  Description of Unknown: Firmicutes sequence
MSIQSEFKKFNEKIRLDYGTNSELAEKRDTLLRILENDKDLPSFKKLDQGSYAMYTGIKPGDGREYDIDVGLRFNVNKSEYDPMDLKEDIEKLLKNHTEYGAEIKKPCVTVTYKKDGEPSYHVDLVVYVYEDKDNTDSQIYIAKGIKGNKDSQKWDKADPKGLVEHINNGVEMGKQRDQFRRMLRYLKRWKHRRFDAKGHSEPSSIGLNLIALDNFIYYEEDDLSALIHIVDSIVNSFRFEGIDKDGDFLYRIKSPLPIELDFELNSDVFEKMSDRQMTDFKEKAEKLQSDLNGVENETDEHEKYKKLQKIFGDDFEVPEEEKTAKKQYNYIPSSSSSGME

SEQ ID NO: 3308 - protein, 342 aa, Clostridium novyi; identical to SEQ ID NO: 3306

SEQ ID NO: 3309 - protein, 342 aa, Anaerococcus prevotii
MTVQKQFEKFNDNIRVDFDTNHELKEKREVLVNILRNSDDLPSFEVINQGSYILKTGIKPEEDQEYDIDVGLIFNVNKDDYKPLDLKEKICSILENHTDYGAKIKKPCVTVTYKKNNKAAFHVDLVVYAYEDNENKESQLYIAKGISSNQDSIKWEKADPKGLVDYINNTIVKGEQRDQFRRIIRYIKKWRNRRFSNFGHISPASIGLTLMAIDNFSYYSDDDLTVLIDVVNYIKNKFHYRKTENGRDLYRIELSLPYELSFDFPNDVFEKMTDNQMTDFKYKITKFSNDLKEARNEIDEYAQYKKLNKIFGDEFEIPEEKNTAKNQVNYIPSSSSSGWEIY

SEQ ID NO: 3310 - protein, 341 aa, Anaerococcus sp.
MTVQKQFEKFNDNIRVDFDTNHELKEKREVLVSILRNSDDLPSFEVINQGSYILKTGIKPEEDQEYDIDVGLIFNVNKDDYKPLDLKEKICSILENHTDYGAKIKKPCVTVTYKKNNKAAFHVDLVVYAYEDNENKESQLYIAKGISSNQDSIKWEKADPKGLVDYINNTIVKGEQRDQFRRIIRYIKKWRNRRFSNFGHISPASIGLTLMAIDNFSYYSDDLTVLIDVVNYIKNKFHYRKTENGRDLYRIELSLPYELSFDFPNDVFEKMTDNQMTDFKDKITKFSNDLKEARNEIDEYAQYKKLNKIFGDDFEIPEEKNTAKNQVNYIPSSSSSGWEIY

SEQ ID NO: 3311 - protein, 342 aa, Unknown
  Description of Unknown: Firmicutes sequence
MTVQKQFEKFNDNIRVDFDTNHELKEKREVLVNILRNSDDLPSFEVINQGSYILKTGIKPEEDQEYDIDVGLIFNVNKDDYKPLDLKEKICSILENHTDYGAKIKKPCVTVTYKKNNKAAFHVDLVVYAYEDNENKESQLYIAKGISSNQESIKWEKADPKGLVDYINNTIVKGEQRDQFRRIIRYIKKWRNRRFSNFEHISPASIGLTLMAIDNFSYYSDDDLTVLIDVVNYIKNKFHYRKTENGRDLYRIELSLPYELSFDFPNDVFEKMTDNQMTDFKDKITKFSNDLKEARNEIDEYAQYKKLNKIFGDDFEIPEEKNTAKNQVNYIPSSSSSGWEIY

SEQ ID NO: 3312 - protein, 342 aa, Anaerococcus lactolyticus
MTVQKQFEKFNDNIRVDFDTNHELKEKREVLVNILRNSDDLPSFEVINQGSYILKTGIKPEDDQEYDIDVGLIFNVNKDDYKPLDLKEKICSILENHTDYGAKIKKPCVTVTYKKNNKAAFHVDLVVYAYEDNENKESQLYIAKGISSNQDSIKWEKADPKGLVDYINNTIVKGEQRDQFRRIIRYIKKWRNRRFSNFGHISPASIGLTLMAIDNFSYYSDDDLTVLIDVVNYIKNKFHYRKTENGRDLYRIELSLPYELSFDFPNDVFEKMTDNQMTDFKDKITKFSNDLKEARNEIDEYAQYKKLNKIFGDDFEIPEEKNTAKNQVNYIPSSSSSGWEIY

SEQ ID NO: 3313 - protein, 338 aa, Fusobacterium nucleatum
MSIQSELKKFNDRIRVDFDTKKELADKRDILLKKLRNSDLPSFKELNQGSYAMYTGIEPESDGEYDIDVALKFYANKKDYNPIDLKNKICEILKNHTDYGAEIKKPCVTVTYKKDGEAKFHVDLVTYVYDNKDDEDSQLYIAKGKNDDSQEWEEADPKGLVDYINEKVEKGDKRDQFRRVVRYLKKWKNYKFSNTGHTNPPSIGITIITVDNFTYYEGDDLNALINIVNKIIDKFIFVGTNGTGRYLYRIKLSLPSSLKFKFQNDVFEKMSDAQLTDFKDKIEKLKNDLEAARDEADEQEQYKKLNKIFGDDFEIPEAKNSSKKQFDYIPHSSTSGME

SEQ ID NO: 3314 - protein, 339 aa, Veillonella montpellierensis
MSVQSELKKFNDKIRADFEVKKELSEKRDILLGKLRNNDDLPSFKELNQGSYAMCTGIEPEDDSEYDIDVALRFSVNKDDYDPIEIKEKICEILKNHTDYGSEIKKPCVTVTYKKDGEAKFHVDLVTYLYADKDDENSQLYISKGKNKGSQEWEEADPKGLVDYINDSVEVGEKRNQFRRVVRYLKKWKNIKFSNTGHANPPSIGITLIAADNFNYYEEDDLNSLIDVVNTIVNKFSYVRTNEYGRYMYRISLSLPYILKFKFGNDVFEKMSDAQMTDFKDKIEKLKKDLVEVRDEADELEQYKKLNKIFGDDFEIPEAKNSAKKQFDYIPASSASGME

SEQ ID NO: 3315 - protein, 339 aa, Peptostreptococcus sp.
MSVQSEFKKFNDKIRADFEVKKELSDKRDILLGKLRNNDELPSFKELNQGSYAMCTGIEPEDDSEYDIDVALRFSANKDDYDPIELKEKICEILKNHTDYGSEIKKPCVTVTYKKDGEAKFHVDLVTYLYADKDDEKSQLYIAKGKDKDSQEWEEADPKGLVDYINDSVEVGEKRNQFRRVIRYLKKWKNRKFSNTGHANPPSIGITLIAADNFNYYEEDDLSSLIDVVNTIINKFGYVRTNESGRYMYRISLSLPYILKFKFGNDIFEKMSDAQMTDFKDKIEKLKKDLVEVRDEADELEQYKKLNKIFGDDFEIPEAKNSAKKQFDYIPSSSASGME

SEQ ID NO: 3316 - protein, 339 aa, Veillonella sp.
MSVQSELIKFNDKIRVDFEVKKELSEKRDILLGKLRNSDELPSFKELNQGSYAMCTGIEPEDDSEYDIDVALRFSANKDDYTSIELKKKICEILKNHTDYGAEIKKPCVTVTYKKDGEAKFHVDLVTYLYADKDDEKSQLYIAKGKDKDSQEWEAADPKGLVDYINDSVEGGEKRNQFRRVIRYLKKWKNRKFSNTGHANPPSIGITLIAADNFNYYEEDDLSSLIDLVNTIINKFSYVRTNESGRSMYKISLPLPYNLKFKFGDDIFEKMSVAQMTDFKDKIEKLKKDLVEVRDEADELEQYKKLNKIFGDDFEIPEEKNSAKKQFNYIPSSSASGME

SEQ ID NO: 3317 - protein, 337 aa, Coriobacteriaceae bacterium
MSLQSQFKEFNKKIALSKTEQEELRNKRSVLTDKLRSSKDMPVFDDYCQGSYATHLGVKPVDDREYDIDIALMFNINATNHNPYEIKSKIAKVLKGHNTTDPKIKDPCVTMTYIEDGNAKYHLDLVTYSYQDSESNESQPYLARGKAADEAEWEEADPKGLINYINKTIADADDPSQLRRVIRYLKRWKTLKFSPQGDSEPPSIGITLIALEGYKNSPGNDLLATIDVVNAIKNRFYANGLDTSGNEMWKIAYPLPDSLYFKKPNDVFEKMSTVQQRGFHQKIETLLNGLIAVQNEPDIINQCKKLRKIFGDDFKIPDEASTSRRQSNFFPSSSHSG

SEQ ID NO: 3318 - protein, 343 aa, Pseudoalteromonas sp.
MSVQNKFIKFHDKIKLGREDEAYREARAKDNSILDELKTEFKNAGYPIIETFIQGSLSMYTGIKHPEADFDIDRAVVIDTDSAPDDPVEVKKLVLKVLEKRGFKNAKIKKPCVTADYMNLNLHIDIVIYRKRDERYELAVGKLNSNAENRVWSPSEPKKLIQHVNDSSQYIGSADLKIRQVKRLVRYVKRWRDEKFGQNVGKKVFSIGLTLMLKDKFCPSISDDGKVSDLQSLRDTVSAILNANYFQWVDDGKYKVNVRLPVQPYRNVFENSSIDTGTQLYNKLNAMLTKLDQALNEDSLRKQCEIMQGLFGGDFEVPEKEQDSNAKKVAYSSAGVVGTSQGA

SEQ ID NO: 3319 - protein, 343 aa, Unknown
  Description of Unknown: Shewanella sequence
MSLQNQFSKFHDKIKLGREDDTYREARSKDSSILDDLRDEFKNAGYPIIETFIQGSLSTHTGIKHPVADFDIDRAVVIDADNAPDDPVEVKKLVLKVLEKRGFKNARIKKPCVTADYMNLNLHIDIVIYRKLGQQYELAVGKLNSNVENRVWSPAEPKKLIEHINDSSQYIGSADLKIRQVKRLVRYVKRWRDEKFGQNVGKKVFSIGLTLMLKDKFSPSISNDGKLSDLQSLRDTVSAILNANYFQWVDDGKYKIDVRLPVQPYRNVFENSSIDTGTQLYNKLNAMLTKLDQALNEDSLRKQCEILQGLFGGDFEVPEKEQDSNAKKVAYSSAGVVGTSQGA

SEQ ID NO: 3320 - protein, 343 aa, Vibrio cholerae
MSLQNQFSKFHDKIKLGREDDSYREARTKDSSILDDLRDEFKNAGYPIIETFIQGSFSTHTGIKHPVADFDIDRAVVIDADNAPNDPVEVKKLVLKVLEKRGFKNARIKKPCVTADYINLNLHIDIVIYRKRGQQYELAVGKLNSNVENREWSPAEPKKLIEHINDSSQYIGSADLKNRQVKRLVRYVKRWRDEKFGQNVGKKVFSIGLTLMLKDKFRPSISYDGKVNDLQSLRDTISAILNANYFQSVDYSKYKVNVQLPVQPYRNVFENSSIDTGTQLYNKLNAMLTKLDQALNEDSLSKQCEILQGLFGDDFEVPEKEQDSNAKKVAYSSAGVVGTSQGA

SEQ ID NO: 3321 - protein, 343 aa, Aliiglaciecola lipolytica
MSIQNRFSKFHDKIKLGREDDAYREARAKDNSILDEIKAEFRSAGYPIIETFIQGSLSTYTGIKHPVDDFDIDRAVVIDADNAPDNPVELKKLVLKVLEKRGFKNARVKKPCVTADYINLSLHIDIVVYRKGGEQYELAVGKLNSNEQNREWSPSEPKKLIEHINNSSLFIGSADLKIKQFKRLVRYFKRWRDEKFGQAIGKKVFSIGLTLMLKEQFRPAIDNNGKVDDLQSLRDTVGAIMASNYFHWAGDNKYKVNVYLPVQPYINVFENSSIDTGTQLYNKFKLLLTKLDQALEEDSLKKQCEILQGLFGNDFEVPEKEQSNNAGKVAYSNAGVVGTSQGA

SEQ ID NO: 3322 - protein, 341 aa, Photobacterium damselae
MSTQSKFIKFHDKIKLSREDCEYKDAREKDDSILKAIKTSLKDEGYPVIDNFLQGSMSTSTGVKNRGEDFDIDRAVVIAFDDSPDDPVKVKKIVLKVLEDRGFKNAKIKKPCVTADYISKNLHIDIPIYRECNGNYELAIGKKNSGDDSKEWSASDPKGLKEWINDASLYTGSANKKLEQYKRIVRYLKRWRDNKFSTAVAKKVFSISLTVMAKEQFKPSLDDNNKANDLVALRDTVNDMLHADYFSYQGNEQYRVRVTLPKSPWRDIFYGSSLNTGTQFYNKLTTLKNKLDKAIEETDLTKQCKILNEVFGDDFEVPSSSSTIRKATYSTAGASGTSQGA

SEQ ID NO: 3323 - protein, 341 aa, Shewanella colwelliana
MSIQAKFIKFHDKIKLSREDSEYKDAREKDDSILKAVKKALKEEGYPVVDNFLQGSMSTSTGIKNPGEDFDIDRAIVIAFNGSPDDPVKVKKIVLKVLEDRGFKNAKIKKPCVTADYTSKNLHIDIPIYREQNGDYELAVGKKNSSDDNREWSASDPKGLRDWINDSSLYIGSANKKLEQYKRIVRYLKRWRDNKFSTAVAKKVFSIALTVMSKQQFRSSLDDSEKANDLVALRDTVNDMLHASYFSFQGNEQYRVRVTLPKSPWRDIFDGSSLNTGTQFYNKLTVLKSKLDQVIEETDLVKQCKILNEVFGDDFEVPSSSSTAKKAAYSTAGASGTSQGA

SEQ ID NO: 3324 - protein, 341 aa, Shewanella sp.
MSIQAKFIKFHDKIKLSREDSEYKDAREKDDSILKAVKKALEEEGYPVIDNFLQGSMSTATGIKNPGEDFDIDRAIVIAFDGSPDDPVKVKKIVLKVLEDRGFKNAKIKKPCVTADYTSKNLHIDIPIYREQNGDYELAVGKKNSSDDNKEWSASDPKGLRDWINDSSLYIGSANKKLEQYKRIVRYLKRWRDNKFSTAVAKKVFSIALTVMAKQQFSSSLDDSEKANDLVALRDTVNDMLHASYFSFQGNEQYRVRVTLPKSPWRDIFDGSSLNTGTQFYNKLTVLKNKLDKAIEETDLVKQCKILNEVFGDDFEVPSSSSTAKKAAYATAGASGTSQGA

SEQ ID NO: 3325 - protein, 341 aa, Vibrio cholerae
MSIQAKFLKFHDKIKISREDKEYKDAREKDDSILSAIKIALKDEGYPVIEDFLQGSMSTSTGVKNPCQDFDIDRAIVISFDGSPDDPIKVKKIVLKVLEDRGFKNAKIKKPCVTADYVSKNLHIDIPVYREQNGEYELAVGKKNSSEGNKEWSDSDPKGLKDWINNSSAYLGSASKKIEQYKRIVRYLKRWRDHKFSTDVAKKVFSIGLTVMAKEQFSPSFDDSDKANDLVALRNTVNAMLSGGYFSYQGDELYKVMVYLPKSPYRDIFDGSSLNTGTQFYNKLKSLRDKLDKTIDETDLVKQCKILNQVFGDDFEVPSSSSNVKKAAYATAGASGTSQGA

SEQ ID NO: 3326 - protein, 341 aa, Vibrio sp.
MSIQAKFIKFHDKIKISREDSEYKDAREKDDSILKAIKSTLKVEGYPVIEDFLQGSMSTATGVKNPGEDFDIDRAIVIAFDGSPDDPVKVKKIVLKVLEDRGFKNARIKKPCVTADYVSKNLHIDIPIYREQNGEYELAVGKKNSSEGNKEWSDSDPKGLKDWINDSSAYLGSASKKLGQYKRIVRYLKRWRDHKFSTDVAKKVFSIGLTVMAKEQFSPSLDDSDKANDLVALRNTVNAMLSGGYFTYQGDDLYKVMVYLPKSPWRDIFDGSSLNTGTQFYNKLKSLRDKLDKAIDETDLVKQCKILNQVFGNDFEVPSSSSNVKKAAYATAGASGTSQGA

SEQ ID NO: 3327 - protein, 341 aa, Paraferrimonas haliotis
MSIQAKFIKFHDKIKISREDSEYKDAREKDDSILKAIKSTLKDEGYPVIEDFLQGSMSTATGVKNPGKDFDIDRAIVIAFDGSPDDPIKVKKIVLKVLENRGFKNARIKKPCVTADYVSKNLHIDIPVYREQNGEYELAVGKKSSSEGNKEWSNADPKGLKDWINDSSTHLGSASKKLGQYKRIVRYLKRWRDHKFSTDVATKVFSIGLTVMAKEQFSPSLDDSDKPNDLVALRNTVNAMLSGGYFSNQGDDLCKVMVYLPKSPRRDIFDGSSLNTGTQFYNKLKSLRDKLNKAIDETDLVKQCKILNQVFGDDFEVPSCSSNVKKAVYATAGASGTSQGA

SEQ ID NO: 3328 - protein, 341 aa, Vibrio owensii
MSIQAKFLKFHDQIKISREDSAYKDAREKDDSILKDVKSALKDEGYPVIENFLQGSMSTATGVKNPKDDFDIDRAVVIAFDDSPSNPVEVKKIVLKVLEDRGFKNAKIKKPCVTADYTSKNLHIDIPIYRKANDAYELAVGKKNSCEENREWSSSDPKGLKDWINDSSDYYGSASKKLEQYKRLVRYLKRWRDNKFSSAVAKKIFSIGLTVMAKEQFTPSFDDTDKANDLIALRDTVDGIIRGTYFSYQGNEEYKVKAFLPKSPWRDIFDGSSKNTGTQFYNKLKSLRDNLDKAIDETDLVKQCEILNKIFGDDFEVPSSSSNLKKATYATAGAAGTSQGA

SEQ ID NO: 3329 - protein, 341 aa, Unknown
  Description of Unknown: Vibrio sequence
MSIQAKFLKFHDQIKISREDSAYKDAREKDDSILKDVKSALKDEGYPVIENFLQGSMSTATGVKNPKEDFDIDRAVVIAFDDSPSDPVEVKKIVLKVLEDRGFKNAKIKKPCVTADYTSKNLHIDIPIYRKANDAYELAIGKKNSSEENREWSGSDPKGLKDWINDSSDYYGSASKKLEQYKRLVRYLKRWRDNKFSSSVAKKIFSIGLTVMAKEQFTPSFDDSGKANDLIALRDTVDAIIRGTYFGYQGNEEYKVKAFLPKSPWRDIFDGSSKNTGTQFYNKLKSLRDNLDKAIDETDLVKQCEILNKIFGDDFEVPSSSSNLKKATYATSGAAGTSQGA

SEQ ID NO: 3330 - protein, 341 aa, Vibrio nigripulchritudo
MSIQARFIKFHGKIQLSRGDSEYKDARKKDDSILEAIKNELKEEGYPVIEDFLQGSMSTATGVKNPGEDFDIDRAVVIAFDGSPDDPVKVKKIVLKVLEDRGFKNAKIKKPCVTADYASKNLHIDIPIYREQNGHYELAIGKKNSSEGNKEWSGSDPKGLKSWVNDSSSYLGSASKKLEQYKRLVKYLKRWRDNKFSGEVAKKVFSIGLTVMAKEQFTPSFDDSDKANDLVALRDTVHDMLSGAYFIYQGDDLYRVRVSLPKSPYRDIFHGSSLNTGTQFYNKLKSLKDKLDKAIDETDLVKQCKILNEVFGDDFEVPSSSSNVKKATYATAGVSGTSQGA

SEQ ID NO: 3331 - protein, 341 aa, Vibrio parahaemolyticus
MSLQSKFFKFHDKIKLSREDNDYKNAREKDDSILKAVRSALKEEGYPVVEDFLQGSMSIATGVKHPCEDFDIDRAVVIAFDDSPKDPVKVKKIVLNVLEDRGFKNAKIKKPCVTADYTSQKLHIDIPIYREKNGTYELGIGKKNSSEENREWSESDPKGLKEWINDSSHYLGSSNKKLEQYKRLVRYLKRWRDNKFSTSVAKKVFSIGLTVMAKEKFSPSFDDSDKANDLVALRGTVDAMLNGGYFSYQGEDLYKVRVNLPKSPWRDIFYGSSLNTGTQFYNKLKSLKSKLDKAIEETDLVKQCQILNEVFGEDFEVPTSSLNTNKAVYSTAGASGTSQGA

SEQ ID NO: 3332 - protein, 345 aa, Shewanella halifaxensis
MSIQKSFKGFHDKIKLGYSDTEYSTAKIKDSSITAAVKAAFKDEGYSVVDDFIQGSFSTHTAIKSKDGDFDIDRAVVIDYQDSPDNPIEPKKVVLDVLEKRGFKNAKIKKPCVTADYKSENLHIDFPIYRNNNGTLELAVGKANSNQDNREWAISDPKGLRSWIKDSSTYGNSAELKQQQFNRLVRYVKRWRDHKFTDDSVRSKVYSIGLTVMLKADFVWALDDDGYPDDLKALRDTISSVISTNYFRFIGVDQYKVQVMLPKAPYRDIFDGSSTNTGSQLRNKLNSLKSKLDEAIAETDNTKKCQILNKLFGDDFEIPDDTKGANNIRKAVYSSAGAVGTSQGA

SEQ ID NO: 3333 - protein, 343 aa, Vibrio sp.
MAVQTHFIKFHNKIKLTRESVDYRDARDKDSSILSQVRTAFCSAGYPVIDDFLQGSFSTNTAIQSLDGDFDIDRAVVVAFDKAPDDPVTAKRKVKEVLDNRGFRNAKIKKPCVTADYASLNLHIDIPIYAKDGESYKLALGKANSTSVNRKWSDSDPKGLRNWINDTSSYTYSPNDTQQQFIRLVRYIKRWRDHKFSADVRRKVYSIGLTVIIKQCFQPCFDQEGKPDDLRALKETVDRILRSGYFHLVGVSKYKISVMLPVTPRMDIFANSSSDTGTQLQNKFVNLQTKLGEVQREADESKQCEILNKLFGADFEVPEDSSGAKSSLASFSSAGVVGTSQGA

SEQ ID NO: 3334 - protein, 343 aa, Vibrio parahaemolyticus
MAVQTHFIKFHNKIKLTRENSDYKDAREKDSSIISRVRTAFCSAGYPIIDDFLQGSFSTNTAIHSLDGDFDIDRAVVVDFDNAPDDPVTLKRKVKEVLDNRGFRNAKIKKPCVTADYASLNLHIDIPVYAKNGESYKLALGKTNSNAANRQWSDSDPKGLRNWINDTSSYTVSPNDTQQQFIRLVRYIKRWRDHKFSEDVRRKVYSIGLTVIIKQCFQPCFDQEGKPDDLSAFKGTVDRILSSSYFHLVGVSKYKISVMLPVTPRIDIFANSGSDTGTQLQNKFVNLQTKLGEVQKEVDERKQCEILNKLFGADFEVPENSSGSKSCLAAFSSAGVVGTSQGA

SEQ ID NO: 3335 - protein, 345 aa, Vibrio parahaemolyticus
MASQTHFNKFHEKIKLTREADAYKDARQKDTSILSKIREAFANEGYPLCDDFLQGSFSTNTAIQSLDGDFDIDHAIVIDSEKSPSNPIDVKKVVKGVLEKRGFKNAKIKKPCITADYNSLNLHIDIPVYRVKNSQYELAVGKLNSDERNREWAPADPKGLKNWINNTSTYAYSPNSTQQQFIRVIRYLKRWRDHTFTPVVRKKIFSIGLTVMAKQCFECNFDKDGKPNDLLALIATVNNILNRGYFRICNVEQYIVSVPLPVTPYRDIFYGSSLETGTQLRNKLNTIKNKLEEANRQTDEIKQCEIFNKLFGSDFVIPAKSSENKERGQMLSFSSAGVVGTSQGA

SEQ ID NO: 3336 - protein, 344 aa, Marinobacter segnicrescens
MGLQKHFKAFHDTIKLGRKDVSYASAREKDDSIKEAIKRSFKENGHPVIDDFIQGSLAVHTGIKSRDTDFDIDRAIIIDSADAPESPIEPKRRIKEVLENRGFSNVRIKKPCVTADYKALDLHIDFPVYKRSGAEYSLAVGKAGSSDGNKEWASADPKGLESWIKDDSFYTGSKRDKHDQFRRLVRYVKRWRDHQFSQDVARKIYSIGLTVMIKECFSPCFDDNGKPCDATALSQTLSNILSRGYFAQQLEDGRYKVNVRLPVNPWRDIFSGSSVNTGTQLFNKLSRLKTKLDQALAEEDEVKQCRILNQMFGDEFEVPTQSSESRASKAAFATAGYVGTSQGA

SEQ ID NO: 3337 - protein, 346 aa, Acinetobacter sp.
MGLQSKFLTFNSNIYITRQSDEYKNARQKDDSITEDIRKKFRENGYPVQEDFIQGSLATSTTIKEKGKDFDIDRAIVIKENDAPEDPTIPKKVVLEILENRGFKNAKIKKPCVTADYKNEDLHIDIPIYSKSESGYYKLAVGKKNSDENNREWSDSDPKGLIDWVNAKDSSGIYETQKLQRFKRLTRYIKRWRNIKFHEDTCRKVFSIGLTVMLKEKFQSSINDEGLENDLEALKKTIDQILDYSTYFQYQNDSQWKVKVDLPVSPYRDIFSGSSVDTGTQLKNKLSTLRNKLQNVIDEPDEAKQCDLLREIFGEDFPEGTKNNSKNEAAKVVFSSAGSVGTSQGA

SEQ ID NO: 3338 - protein, 248 aa, Acinetobacter sp.
MGLQSKFLTFNSNIYITRQSDEYKNARQKDDSITEDIRKKFRENGYPVQEDFIQGSLATSTTIKEKGKDFDIDRAIVIKENDAPEDPTIPKKVVLEILENRGFKNAKIKKPCVTADYKNEDLHIDIPIYSKSESGYYKLAVGKKNSDENNREWSDSDPKGLIDWVNAKDSSGIYETQKLQQFKRLTRYIKRWRNIKFHEDTCRKVFSIGLTVMLKEKFQSSINDEGLENDLEALKKTIDQILDYSTYF

SEQ ID NO: 3339 - protein, 346 aa, Unknown
  Description of Unknown: Acinetobacter sequence
MGLQSKFLTFNSNIYITRQSDEYKNARQKDDSITEDIRKKFRENGYPVQEDFIQGSLATSTTIKEKGKDFDIDRAIVIKEDDAPEDPTIPKKVVLEILENRGFKNAKIKKPCVTADYKNEDLHIDIPIYSKSESGYYKLAVGKKNSDENNREWSDSDPKGLIDWVNTKDSSGIYETQKLQQFKRLTRYIKRWRNIKFHEDTCRKVFSIGLTVMLKEKFQSSINDEGLENDLEALKKTIDQILDYSTYFQYQNDSQWKVKVDLPVSPYRDIFSGSSVDTGTQLKNKLSTLRNKLQNVINEPDEAKQCDLLREIFGEDFPEGTKNNSKNEAAKVVFSSAGSVGTSQGA

SEQ ID NO: 3340 - protein, 346 aa, Acinetobacter baumannii
MGLQSKFLTFNSNIYITRQSDEYNNARQKDDSITEDIRKKFRENGYPVQEDFIQGSLATNTAIKEKGKDFDIDRAIVINENDAPADPTIPKKVVLEILENRGFKNAKIKKPCVTADYKNEDLHIDIPIYSKSENNFYKLAVGKKNSDENNREWSDSDPKGLIDWINAKDSSGIYETQKLQQFKRLTRYIKRWRNIKFHEDTCRKVFSIGLTVMLKEKFQSSINDEGLENDLEALKKTIDQILDHSTYFQYQNDSQWRVKVDLPVSPYRDIFSGSSVDTGTQLKNKLSTLRNKLQNVIDEPDEAKQCGLLREIFGEDFPEGTKNNSKNEAAKVVFSSAGSVGTSQGA

SEQ ID NO: 3341 - protein, 346 aa, Acinetobacter schindleri
MGLQSKFLTFNTNIYITRQSEEYKNAREKDDSITEDIRKKFRENGYPVQEDFIQGSLATNTAIKEKGKDFDIDRAIVINENDAPTDPTIPKKVVLEILENRGFKNAKIKKPCVTADYKNEDLHIDIPIYSKSESGYYKLAVGKKNSDENNREWSDSDPKGLIDWINAKDSSGIYETQKLQQFKRVTRYIKRWRNIKFHEDICRKIFSIGLTVMIKEKFQSSINDEGLENDLEALKNTIDQILDQSNYFLYQNESQWKVKVDLPVSPYRDIFSGSSIDTGTQLKNKLSTLRNNLKNVIDESDESKQCDLLREIFGEDFPEGTKNNSKNEAAKVVFPSAGSVGTSQGA

SEQ ID NO: 3342 - protein, 346 aa, Acinetobacter marinus
MGLQSKFLTFNTNIYITRQSEEYKNAREKDDSITEDIRKKFRENGYPVQEDFIQGSLATNTAIKEKGKDFDIDRAIVINENDAPTDPTIPKKVVLEILENRGFKNAKIKKPCVTADYKNEDLHIDIPIYSKSESGYYKLAVGKKNSDENNREWSDSDPKGLIDWINAKDSSGIYETQKLQQFKRLTRYIKRWRNIKFHEDTCRKVFSIGLTVMLKEKFQSSINDEGLENDLEALKNTIDQILDQSNYFLYQNDSQWKVKVDLPVSPYRDIFSGSSIDTGTQLKNKLSTLRNNLKKVIDESDESKQCDLLREIFGEDFPESTKNNSKNEAAKVVFPSAGSVGTSQGA

SEQ ID NO: 3343 - protein, 346 aa, Acinetobacter sp.
MGLQSKFSTFNNNINITRQSDEYKNARQKDDSITEEIRKKFKEFGYPVQDDFIQGSLATSTAIKEKGKDFDIDRAIVINEKDAPADPTIPKKVVLEILETRGFKNAKIKKPCVTADYKNEDLHIDIPIYSKSESGYYKLAVGKKNSDENNREWSDSDPKGLIDWINAQDSSGIYESQKLQQFKRLTRYIKRWRNIKFHENTCRKVFSIGLTVMLKEKFQSSINDEGLENDLQALKNTIDKILDQSNYFLYQNESQWKVSVYLPVSPYRDIFSGSSIDTGTQLKNKLSTLRNNLKKVIDESDESKQCDLLREIFGEDFPEGTKNNSKNEAAKVVFPSAGSVGTSQGA

SEQ ID NO: 3344 - protein, 346 aa, Acinetobacter nosocomialis
MGLQNKFLTFDGKIYITRYSDEYKKAREKDDSITEEIRKKFKENGYPVQEDFIQGSLATSTTIKEKGKDFDIDRAIVIKEDDAPEDPTIPKKVVLDILENRGFKNAKIKKPCVTADYQSEDLHIDIPIYSKSSSGLYKLAVGKKNSDENNREWSDSDPKGLQSWINQKDNSGIYETEKLLQFKRLTRYIKRWRNFNFHEDTCRKVFSIGLTVMFKQKFQSSINDEGLENDLEALKKTIDQIIDNSNYFLAQPDNKWKIEVYLPVSPYRDIFSGSSINTGTQLRNKLSNLRTTLQKVIDETDESKQCGLLRTVFGDDFPESSQNSSKNEAAKVVFASAGSVGTSQGA

SEQ ID NO: 3345 - protein, 346 aa, Acinetobacter baumannii
MGLQNKFLTFDGKIYITRYSDEYKKAREKDDSITEEIRKKFKENGYPVQEDFIQGSLATSTTIKEKGKDFDIDRAIVIKEDDAPEDPTIPKKVVLDILENRGFKNAKIKKPCVTADYQSEDLHIDIPIYSKSSSGLYKLAVGKKNSDENNREWSDSDPKGLQSWINQKDNSGIYETEKLLQFKRLTRYIKRWRNFNFHEDTCRKVFSIGLTVMFKQKFQSSINDEGLENDLEALKKTIDQIIDNSNYFLAQPDNKWKIEVYLPVSPYRDIFSGSSINTGTQLRNKLSNLRTTLQKVIDETDESKQCDLLRTVFGDDFPESSQNSSKNEAAKVVFASAGSVGTSQGA

SEQ ID NO: 3346 - protein, 346 aa, Acinetobacter baumannii
MSLQNKFNTFNQRIYLTRHDSEYSDAREKDDSITAAIKAKFKEKGYPVIDNFVQGSLATYTTIKEPGKDFDIDRAIVIDYEESPSDPLIPKKVILEILEDRGFQNAKIKKPCVTADYKFKNLHIDIPVYRKNSWGGYELAVGKKDSADEHKIWSESSPTELIDWVNDSSQYGVYATEKLYQFRRLVRYLKRWRNLKFSPDVCRKIYSIGLTVMIKQNFKPSIDEDGFPNDLLALKATVDSILDWSGYFQLHSDDQWKVKVNLPVYPSRDIFHGSSLNTGTRFRNQFTNLRSTLQDVIDASDEAEQCSLLVKIFGDDFPNNVNTNSASTAQKVQFATAGAVGTSQGA

SEQ ID NO: 3347 - protein, 346 aa, Acinetobacter baumannii
MSLQNKFNTFNQRIYLTRHDSEYSDAREKDDSITAAIKAKFKEKGYPVIDNFVQGSLATYTTIKEPGKDFDIDRAIVIDYEESPSDPLIPKKVILEILEDRGFQNAKIKKPCVTADYKFKNLHIDIPVYRKNSWGGYELAVWKKDSADEHKIWSESSPTELIDWVNDSSQYGVYATEKLYQFRRLVRYLKRWRNLKFSPDVCRKIYSIGLTVMIKQNFKPSIDEDGFPNDLLALKATVDSILDWSGYFQLHSDDQWKVKVNLPVYPSRDIFHGSSLNTGTRFRNQFTNLRSTLQDVIDASDEAEQCSLLVKIFGDDFPNNVNTNSASTAQKVQFATAGAVGTSQGA

SEQ ID NO: 3348 - protein, 346 aa, Unknown
  Description of Unknown: Acinetobacter calcoaceticus/baumannii complex sequence
MSLQNKFNTFNQRIYLTRHDSEYSNAREKDDSITAAIKAKFKEKGYPVIDNFVQGSLATYTTIKEPGKDFDIDRAIVIDYEDSPSDPLVPKKVILEILEDRGFQNAKIKKPCVTADYKFKNLHIDIPVYRKNSWGGYELAVGKKDSADEHKIWSESSPIELIDWVNDSSQYGVYATEKLHQFRRLVRYLKRWRNLKFSPDVCRKIYSIGLTVMIKQNFKPSIDEDGFPNDLLALKATVDSILDWSGYFQLHSDDQWKVKVNLPVYPSRDIFHGSSLNTGTRFRNQFTNLRSTLQDVIDTSDEAEQCSLLVKVFGDDFPNNVNTNSASTAQKVQFATSGAVGTSQGA

SEQ ID NO: 3349 - protein, 346 aa, Unknown
  Description of Unknown: Acinetobacter sequence
MSLQNKFNTFNQRIYLTRHDSEYSNAREKDDSITAAIKAKFKEKGYPVIDNFVQGSLATYTTIKEPGKDFDIDRAIVIDYEESPSDPLVPKKVILEILEDRGFQNAKIKKPCVTADYKFKNLHIDIPVYRKNSWGGYELAVGKKDSADEHKIWSESSPKELIDWVNDSSQYGVYATEKLHQFRRLVRYLKRWRNLKFSPDVCRKIYSIGLTVMIKQNFKPSIDEDGFPNDLLALKATVDSILDWSCYFQLHSDDQWKVKVELPVYPSRDIFHGSSLNTGTRFRNQFTNLRSILQDVIDTSDEAEQCSLLVKVFGDDFPNNVNTNSASNAQKVQFATSGAVGTSQGA

SEQ ID NO: 3350 - protein, 346 aa, Unknown
  Description of Unknown: Acinetobacter sequence
MSLQNKFNTFNQRIYLTRHDSEYSNAREKDDSITATIKAKFKEKGYPVIDNFVQGSLATYTTIKEPGKDFDIDRAIVIDYEESPSDPLVPKKVILEILEDRGFQNAKIKKPCVTADYKFKNLHIDIPVYRKNSWGGYELAVGKKDSADEHKIWSESSPKELIDWVNDSSQYGVYATEKLHQFRRLVRYLKRWRNLKFSPDVCRKIYSIGLTVMIKQNFKPSIDEDGFPNDLLALKATVDSILDWSCYFQLHSDDQWKVKVELPVYPSRDIFHGSSLNTGTRFRNQFTNLRSTLQDVIDTSDEAEQCSLLVKVFGDDFPNNVNTNSASNAQKVQFATSGAVGTSQGA

SEQ ID NO: 3351 - protein, 346 aa, Acinetobacter baumannii
MSLQNKFNTFNQRIYLTRHDSEYSNAREKDDSITAAIKAKFKEKGYPVIDNFVQGSLATYTTIKEPGKDFDIDRAIVIDYEESPSDPLVPKKVILEILEDRGFQNAKIKKPCVTADYKFKNLHIDIPVYRKNSWGGYELAVGKKDSADEHKIWSESSPKELIDWVNDSSQYGVYATEKLHQFRRLVRYLKRWRNLKFSPDVCRKIYSIGLTVMIKQNFKPSIDEDGFPNDLLALKATVDSILDWSCYFQLHSDDQWKVKVELPVYPSRDIFHGSSLNTGTRFRNQFTNLRSTLQDVIDTSDEAEQCSLLVKVFGDDFPNNVNTNSARNAQKVQFATSGAVGTSQGA

SEQ ID NO: 3352 - protein, 346 aa, Acinetobacter baumannii
MSLQNKFNTFNQRIYLTRHDSEYSNAREKDDSITAAIKAKFKEKGYPVIDNFVQGSLATYTTIKEPGKDFDIDRAIVIDYEESPSDPLVPKKVILEILEDRGFQNAKIKKPCVTADYKFKNLHIDIPVYRKNSWGGYELAVGKKDSADEHKIWSESSPKELIDWVNDSSQYGVYATEKLHQFRRLVRYLKRWRNLKFSPDVCRKIYSIGLTVMIKQNFKPSIDEDGFPNDLLALKATVDSILDWSCYFQLHSDDQWKVKVELPVYPSRDIFHGSSLNTGTRFRNQFTNLRSTLQDVIDTLDEAEQCSLLVKVFGDDFPNNVNTNSARNAQKVQFATSGAVGTSQGA

SEQ ID NO: 3353 - protein, 346 aa, Acinetobacter baumannii
MSLQNKFNTFNQRIYLTRHDSEYSNAREKDDSITATIKAKFKEKGYPVIDNFVQGSLATYTTIKEPGKDFDIDRAIVIDYEESPSDPLVPKKVILEILEDRGFQNAKIKKPCVTAVYIFKNLHIDIPVYRKNSWGGYELAVGKKDSADEHKIWSESSPKELIDWVNDSSQYGVYATEKLHQFRRLVRYLKRWRNLKFSPDVCRKIYSIGLTVMIKQNFKPSIDEDGFPNDLLALKATVDSILDWSCYFQLHSDDQWKVKVELPVYPSRDIFHGSSLNTGTRFRNQFTNLRSTLQDVIDTSDEAEQCSLLVKVFGDDFPNNVNTNSASNAQKVQFATSGAVGTSQGA

SEQ ID NO: 3354 - protein, 346 aa, Unknown
  Description of Unknown: Acinetobacter sequence
MSLQNKFNTFNQRIYLTRHDSEYANAREKDDSITAAIKAKFKEKGYPVIDNFVQGSLATYTTIKEPGKDFDIDRAIVIDYEESPSDPLVPKKVILEILEDRGFQNAKIKKPCVTADYKFKNLHIDIPVYRKNSWGGYELAVGKKDSADEHKTWSESSPKELIDWVNDSSQFSVYATEKLYQFRRLVRYLKRWRNLKFSPDVCRKIYSIGLTVMIKQNFKPSIDEDGFPNDLLALKATVDSILDWSGYFQLHSDDQWKVKVNLPVHPSRDIFHGSSLNTGTRFRNQLTNLRSTLQDVIDTSDEAEQCSLLVKVFGDDFPNNVNTNSASNAQKVQFATSGAVGTSQGA

SEQ ID NO: 3355 - protein, 346 aa, Unknown
  Description of Unknown: Acinetobacter sequence
MSLQNKFFTFDRRIYLTRHDSEYSNAREKDDSITAAIKAKFKEKGYPVIDDFIQGSLVTYTTIKEPGKDFDIDRAIVIDYEGSPSDPLIPKKVILEILEDRGFQNAKIKKPCVTADYKFKNLHIDIPVYRKNSWGGYELAVGKKDSADEHKIWSESSPKELIDWVNDSSQFSVYATEKLYQFRRLVRYLKRWRNLKFSPDVCRKIYSIGLTVMIKQNFKPSIDEDGFPNDLLALKATVDSILDWSGYFQLHSDDQWKVKVNLPVHPSRDIFHGSSLNTGTRFRNQLTNLRSILQDVIDTSDEAEQCSLLVKVFGDDFPNNVNTNSASTAQKVQFATCGAVGTSQGA

SEQ ID NO: 3356 - protein, 346 aa, Acinetobacter baumannii
MSLQNKFNTFNQRIYLTRHDSEYSNAREKDDSITAAIKAKFKEKGYPVIDNFVQGSLATYTTIKEPGKDFDIDRAIVIDYEDSPSDPLVPKKVILEILEDRGFQNAKIKKPCVTADYKFKNLHIDIPVYRKNSWGGYELAVGKKDSGTEHKSWSESSPKELIDWVNNSSLYGVYATEKLHQFRRLVRYLKRWRNIKFSKDVCRKIYSIGLTVMVKQHFKPSIDADGFPNDLLALKATIDSILDWSGYFQWHSDDQWKVKVELPVYPSRDIFHGSSLNTGTRFRNQLTNLRSTLQDVIDTSDETEQCSLLIKVFGDDFPSNANTNSASNTQKVQFATAGAVGTSQGA

SEQ ID NO: 3357 - protein, 346 aa, Acinetobacter baumannii
MSLQNKFNTFNQRIYLTRHDSEYSNAREKDDSITAAIKAKFKEKGYPVIDNFVQGSLATYTTIKEPGKDFDIDRAIVIDYEDSPSDPLVPKKVILEILEDRGFQNAKIKKPCVTADYKFKNLHIDIPVYRKNSWGGYELAVGKKDSGTEHKSWSESSPKELIDWVNNSTLYGVYATEKLHQFRRLVRYLKRWRNIKFSKDVCRKIYSIGLTVMVKQHFKPSIDADGFPNDLLALKATIDSILDWSGYFQWHSDDQWKVKVELPVYPSRDIFHGSSLNTGTRFRNQLTNLRSTLQDVIDTSDETEQCSLLIKVFGDDFPSNANTNSASNTQKVQFATAGAVGTSQGA

SEQ ID NO: 3358 - protein, 346 aa, Acinetobacter baumannii
MSLQNKFNTFNQRIYLTRHDSEYSNAREKDDSITAAIKAKFKEKGYPVIDNFVQGSLATYTTIKEPGKDFDIDRAIVIDYEDSPSDPLVPKKVILEILEDRGFQNAKIKKPCVTADYKFKNLHIDIPVYRKNSWGGYELAVGKKDSGTEHKSWSESSPKELIDWVNNSSLYGVYATEKLHQFRRLVRYLKRWRNIKFSKDVCRKIYSIGLTVMVKQHFKPSIDEDGFPNDLLALKATIDSILDWSGYFQWHSDDQWKVKVELPVYPSRDIFHGSSLNTGTRFRNQLTNLRSTLQDVIDTSDETEQCSLLIKVFGDDFPSNANTNSASNTQKVQFATAGAVGTSQGA

SEQ ID NO: 3359 - protein, 346 aa, Acinetobacter haemolyticus
MSLQNKFNTFNQRIYLTRHDSEYSNAREKDDSITATIKAKFKEKGYPVIDNFVQGSLATYTTIKEPGKDFDIDRAIVIDYEESPSDPLVPKKVILEILEDRGFQNAKIKKPCVTADYKFKNLHIDIPVYRKNSWGGYELAVGKKDSADENKIWAESSPKELIDWVNDSSQFGVYATEKLHQFRRLVRYLKRWRNLKFSPDVCRKIYSIGLTVMIKQHFKPSIDEDGFPNDLLALKATVDSILDWSGYFQWHSDDQWKVKVKLPVHPFRDIFHGSSLNTGTRFRNQLTNLRSTLQDVIDASDEAEQCSLLVKVFGDDFPNNVNTNSASTAQKVQFATSGAVGTSQGA

SEQ ID NO: 3360 - protein, 346 aa, Unknown
  Description of Unknown: Acinetobacter sequence
MSLQNKFNTFNQRIYLTRHDDEYTNAREKDDSITAAIKAKFKEKGYPVIDNFVQGSLATFTTIKESGKDFDIDRAIVIDYEDSPSDPLIPKKVILEILEDRGFQNAKIKKPCVTADYKFKNLHIDIPVYRKNSWGGYELAVGKKDSADENKIWAESSPKELIDWVNDSSQFGVYATEKLHQFRRLVRYLKRWRNLKFSPDVCRKIYSIGLTVMIKQHFKPSIDEDGFPNDLLALKATVDSILDWSGYFQWHSDDQWKVKVKLPVHPFRDIFHGSSLNTGTRFRNQLTNLRSTLQDVIDASDEAEQCSLLVKVFGDDFPNNVNTNSASTAQKVQFATSGAVGTSQGA

SEQ ID NO: 3361 - protein, 344 aa, Acinetobacter bereziniae
MSIQSKFNTFNQRIQLTRQDDAYKDAREKDDSITSAIKTKFKEKGYPVIDDFVQGSLITFTAIKEKYKDFDIDRAIVIDHDQAPTDPVEAKKVVLDILENRGFRNAKIKKPCVTADYQSQDLHIDIPIYRKTSWGSYQLAVGKKDSNAENKVWSDSAPRELINWVNDSSAFGEYATQKLYQFRRLVRYLKRWRNFKFSHDVSRKIYSIGLTVMIKQHFKPSIDSEGCPNDLIALKDTVNSLLNWSGYFISYPDDQWKVKVSLPVSPYRDIFHGSSFNTGTRFRNRLSNLNSSLQTVIDETDESKQCSLLIGLFGDDFPEGTNNASATRKAVFATSGAVGTSQGA

SEQ ID NO: 3362 - protein, 344 aa, Acinetobacter nosocomialis
MSIQSKFNTFNQRIQLTRQDDAYKDAREKDDSITGAIKTKFKEKGYPVIDDFVQGSLITFTAIKEKYKDFDIDRAIVIDHDQAPTDPVEAKKVVLDILENRGFRNAKIKKPCVTADYQSQDLHIDIPIYRKTSWGSYQLAVGKKDSNAENKVWSDSAPKELISWVNDSSAFGEYATEKLYQFRRLVRYLKRWRNFKFSHDVSRKIYSIGLTVMIKQHFRPSIDSEGCPNDLIALKDTVNSILNLSGYFISYPDDQWKVKVSLPVSPYRDIFHGSSFNTGTRFRNRLSNLNSSLQTVIDETDESKQCSLLIGLFGDDFPEGTNNASATRKAVFATSGAVGTSQGA

SEQ ID NO: 3363 - protein, 344 aa, Unknown
  Description of Unknown: Acinetobacter calcoaceticus/baumannii complex sequence
MSIQSKFNTFNQRIQLTRQDDAYKDAREKDDSITGAIKTKFKEKGYPVIDDFVQGSLITFTAIKEKYKDFDIDRAIVIDHDQAPTDPVEAKKVVLDILENRGFRNAKIKKPCVTADYQSQDLHIDIPIYRKTSWGSYQLAVGKKDSNAENKVWSDSAPKELINWVNDSSAFGEYATEKLYQFRRLVRYLKRWRNFKFSHDVSRKIYSIGLTVMIKQHFRPSIDSEGCPNDLIALKDTVNSILNLSGYFISYPDDQWKVKVSLPVSPYRDIFHGSSFNTGTRFRNRLSNLNSSLQTVIDETDESKQCSLLIGLFGDDFPEGTNNASATRKAVFATSGAVGTSQGA

SEQ ID NO: 3364 - protein, 344 aa, Acinetobacter sp.
MSIQSKFNTFNQRIQLTRQDDAYKDAREKDDSITGAIKTKFKEKGYPVIDDFVQGSLITFTAIKEKYKDFDIDRAIVIDHDQAPTDPVEAKKVVLDILENRGFRNAKIKKPCVTADYQSQDLHIDIPIYRKTSWGSYQLAVGKKDSNAENKVWSDSAPKELISWVNDSSAFGEYATEKLYQFRRLVRYLKRWRNFKFSHDVSRKIYSIGLTVMIKQHFRPSIDSEGCPNDLIALKDTVNSILNLSGYFISYPDDQWKVKVSLPVSPYRDIFHGSSFNTGTRFRNRLSNLNSSLQTVIDETDESKQCSLLIGLFGDDFPEGTTNASATRKAVFATSGAVGTSQGA

SEQ ID NO: 3365 - protein, 344 aa, Acinetobacter baumannii
MSIQSKFNTFNQRIQLTRQDDAYKDAREKDDSITGAIKTKFKEKGYPVIDDFVQGSLSTFTAIKEKYKDFDIDRAIVIDHDQAPTDPVEAKKVVLDILENRGFRNAKIKKPCVTADYQSQDLHIDIPIYRKTSWGSYQLAVGKKDSNAENKVWSDSAPKELISWVNDSSAFGEYATEKLYQFRRLVRYLKRWRNFKFSHDVSRKIYSIGLTVMIKQHFRPSIDSEGCPNDLIALKDTVNSILNLSGYFISYPDDQWKVKVSLPVSPYRDIFHGSSFNTGTRFRNRLSNLNSSLQTVIDETDESKQCSLLIGLFGDDFPEGTNNASATRKAVFATSGAVGTSQGA

SEQ ID NO: 3366 - protein, 344 aa, Acinetobacter populi
MSLQSKFNTFNQKIQLTRQDDAYKEAREKDDSITSVIKTKFKEKGYPVIDDFVQGSLATFTAIKEKYKDFDIDRAIVIDHNQAPTDPVEAKKVVLDILENRGFRNAKIKKPCVTADYQSQDLHIDIPIYRKTSWGSYQLAVGKKDSNAENKVWSDSAPRELINWVNDSSAFGEYATQKLYQFRRLVRYLKRWRNLKFSHDVNRKIYSIGLTIMIKQHFTPSIDSEGCPNDLIALKNTVNSILNWSGYFITYPDDQWKVQVSLPVSPYRDIFHGSSLNTGTRFRNRLSNLNSSLQTVIDETDESKQCSLLIGLFGDDFPEGTNNASATRKAVFATSGAVGTSQGA

SEQ ID NO: 3367 - protein, 344 aa, Acinetobacter proteolyticus
MSIQSKFNTFNQQIQLTRQDDAYKDAREKDDSITEAIKSKFKENGYSVVDNFVQGSLATFTGIKEKGADFDIDRAIVIDHDEAPTDPVEVKKVVLSILENRGFRNAKIKKPCVTADYQSQDLHIDIPIYRKTYWGSYQLAVGKKDSNAENKVWSDSAPKELISWVNDSSAFGEYATEKLYQFRRLVKYLKRWRNFKFSHDVSRKIYSIGLTVMIKQHFRPSIDSEGCPNDLIALKDTVNSILNLSGYFIAYPDDQWKVQVSLPVSPYRDIFHGSSFNTGTRFRNRLSNLNSSLQTVIDETDESKQCSLLIGLFGDDFPEGTNNASATRKAVFATSGAVGTSQGA

SEQ ID NO: 3368 - protein, 293 aa, Enterobacter cloacae
MSLQNKFFKFHDAILLGIKDVAYNNARLKDDSILKDIKARFKEDGFPVIDDFIQGSMATDTGIRENGQDFDIDRAIVIEASLAPENPITPKKAVLEVLEARGFKNAKIKKPCVTADYKTEDLHIDIPIYRRYENGQYELAVGKTHSDEENRQWSPSAPRELIDWVAAYDNSAVYASKKHDQYRRIVRYLKRWRNFTFSENVRRKIYSIGITVMVKESLVASINDEGFPDDLSALRATIHHILNDGGYFSLVEAEKYKVKVDIPVSHTRDIFDNSSITTGTQFRNQLAGFAKNS

SEQ ID NO: 3369 - protein, 282 aa, Escherichia coli
MSLQNKFFKFHDAILLGIKDVAYNNARLKDDSILKDIKARFKEDGFPVIDDFIQGSMATDTGIRENGQDFDIDRAIVIEASLAPENPITPKKAVLEVLEARGFKNAKIKKPCVTADYKTEDLHIDIPIYRRYENGQYELAVGKTHSDEENRQWSPSAPRELIDWVAAYDNSAVYASKKHDQYRRIVRYLKRWRNFTFSENVRRKIYSIGITVMVKESLVASINDEGFPDDLSALRATIHHILNDGGYFSLVEAEKYKVKVDIPVSHTRDIFDNSSITTGTQF

SEQ ID NO: 3370 - protein, 356 aa, Unknown
  Description of Unknown: Enterobacteriaceae sequence
MSLQNKFFKFHDAILLGIKDVAYNNARLKDDSILKDIKARFKEDGFPVIDDFIQGSMATDTGIRENGQDFDIDRAIVIEASLAPENPITPKKAVLEVLEARGFKNAKIKKPCVTADYKTEDLHIDIPIYRRYENGQYELAVGKTHSDEENRQWSPSAPRELIDWVAAYDNSAVYASKKHDQYRRIVRYLKRWRNFTFSENVRRKIYSIGITVMVKESLVASINDEGFPDDLSALRATIHHILNDGGYFSLVEAEKYKVKVDIPVSHTRDIFDNSSITTGTQFRNQLAALLKTLDKVADENSESKQCELLRKVFGEDFPEHASTSTASAVSTASVVASVGTNTVYASSGAVGTSQGA

SEQ ID NO: 3371 - protein, 356 aa, Unknown
  Description of Unknown: Enterobacteriaceae sequence
MSIQNKFFKFHDAILLGIKDVAYNTARLKDESILKEIKARFKEDGFPVIDDFIQGSMATDTGIREKGQDFDIDRAIVIEASLAPENPITPKKAVLEVLEDRGFKNAKIKKPCVTADYKTEDLHIDIPIYRRYENGQYELAVGKAHSDEENRQWSPSAPRELIDWVTAYDDSAVYASKKHDQYRRIVRYLKRWRNFTFSENVRRKIYSIGITVMVKESLVASINDEGFPDDLSALRATIRHILNDGGYFSLIEAEKYKVKVDIPVSHTRDIFDNSSITTGTQFRNQLAALLKTLDKVADEDSESKQCELLRKVFGEDFPEHASTSTASAVSTASVAASAGANTVYASSGAVGTSQGA

SEQ ID NO: 3372 - protein, 356 aa, Unknown
  Description of Unknown: Enterobacteriaceae sequence
MSLQNKFFKFHDAILLGIKDVAYNTARLKDDSILKEIKARFKEDGFPVIDDFIQGSMATDTGIREKGQDFDIDRAIVIEASLAPENPITPKKAVLEVLEDRGFKNAKIKKPCVTADYKTEDLHIDIPIYRRYENGQYELAVGKAHSDEENRQWSPSAPRELIDWVTAYDDSAVYASKKHDQYRRIVRYLKRWRNFTFSENVRRKIYSIGITVMVKESLVASINDEGFPDDLSALRATIHHILNDGGYFSLIEAEKYKVKVDIPVSHTRDIFDNSSITTGTQFRNQLAALLKTLDKVADEDSESKQCELLRKVFGEDFPEHASTSTASAVSTASVAASAGANTVYASSGAVGTSQGA

SEQ ID NO: 3373 - protein, 356 aa, Morganella morganii
MSLQNKFFKFHDAILLGIKDVAYANARLKDESILKEIKARFKEDGFSVIDDFIQGSMATDTGIREKGQDFDIDRAIVIEASLAPENPITPKKAVLEVLEDRGFKNAKIKKPCVTADYKTEDLHIDIPIYRRYENGQYELAVGKAHSDEENRQWSPSAPRELIDWVTAYDDSAVYASKKHDQYRRIVRYLKRWRNFTFSENVRRKIYSIGITVMVKESLVASINDEGFPDDLSALRATIRHILNDGGYFSLIEAEKYKVKVDIPVSHTRDIFDNSSITTGTQFRNQLAALLKTLDKVADEDSESKQCELLRKVFGEDFPEHASTSTASAVSTASVAASAGANTVYASSGAVGTSQGA

SEQ ID NO: 3374 - protein, 345 aa, Dickeya zeae
MSLQNKFMVFHDAIKLGRKDLEYTNARLKDESITAAIKKRFNEDGYPVIDDFIQGSLATHTGIREKGQDFDIDRAIVIEASLAPENPITPKLAVLEVLEDRKFKNAKIKKPCVTADYKAEDLHIDIPIYRRYENGQYELAVGKRFSDEDNREWAKAAPRDLIDWVNKYDEDDVYGSKKHAQFRRIVRYLKRWRNFTFSEDVCRKIFSIGITVMVKESFSSSLNDEGFPNDLSALRSTIKNILNSGRYFVWAGDKKYNVHVTLPVSPSRDIFYNSSVVTGTQLWNQLTTLRDVLDKVAIEDKESKQCELLKDIFGDDFPECTTSASSASVKTVYANAGAVGTSQGA

SEQ ID NO: 3375 - protein, 347 aa, Klebsiella pneumoniae
MSLQNKFMNFHDAIKLGRQDLEYTTARLKDDSITADIKKRFKEDGYPVIEDFIQGSLATSTGIREKGQDFDIDRAIVIEADLAPENPITPKLAVLEVLEDRGFKNAKIKKPCVTADYKAHDLHVDIPIYRKYENGQYELAVGKKHSDENNREWSRSAPHELIDWVNSYDKNGVYSSKKHDQYRRIVRYLKRWRNVTFGEDVRRKIYSIGIAVMVKECFASSINDEGFPNDLSALRSTINNILNYSNYFTLVDVDKYKVKVALPVSPFRDIFHNSSTATGTQLRNKFSSLSKTLDKVADEEDESKQCELLRSVFGDDFPECASSSSASSVAKKTVYASAGAVGTSQGA

SEQ ID NO: 3376 - protein, 347 aa, Citrobacter sp.
MSLQNKFMNFHDAIKLGRQDLEYTTARLKDDSITADIKKRFKEDGYPVIEDFIQGSLATSTGIREKGQDFDIDRAIVIEADLAPENPITPKLAVLEVLEDRGFKNAKIKKPCVTADYKAHELHVDIPIYRKYENGQYELAVGKKHSDENNREWSRSAPHELIDWVNSYDKNGVYSSKKHDQYRRIVRYLKRWRNVTFGEDVRRKIYSIGIAVMVKECFASSINDEGFPNDLSALRSTINNILNYSNYFTLVDVDKYKVRVALPVSPFRDIFHNSSTATGTQLRNKFSSLSKTLDKVADEEDESKQCELLRSVFGDDFPECASSSSASSVAKKTVYASAGAVGTSQGA

SEQ ID NO: 3377 - protein, 347 aa, Unknown
  Description of Unknown: Enterobacteriaceae sequence
MSLQNKFMNFHDAIKLGRQDLEYTTARLKDDSITADIKKRFKEDGYPVVEDFIQGSLATSTGIREKGQDFDIDRAIVIEADLAPENPITPKLAVLEVLEDRGFKNAKIKKPCVTADYKADDLHVDIPIYRKYENGQYELAVGKKHSDENNREWSRSAPHELIDWVNSYDKNGVYGSKKHDQYRRIVRYLKRWRNVTFSEDVRRKIYSIGIAVMVKECLASSINDEGFPNDLSALRSTINNILNYSNYFTLVDVDKYKVKVALPVSPFRDIFHSSSTATGTQLRNKFSSLSKTLGKVADEEDESKQCELLRSVFGDDFPKCASSSSASSVAKKTVYASAGAVGTSQGA

SEQ ID NO: 3378 - protein, 347 aa, Unknown
  Description of Unknown: Klebsiella sequence
MSLQNKFMNFHDAIKLGRQDLEYTTARLKDDSITAEIKKRFKEDGYPVIEDFIQGSLATSTGIREKGQDFDIDRAIVIEADLAPENPITPKLAVLEVLEDRGFKNAKIKKPCVTADYKADDLHVDIPIYRKYENGQYELAVGKKHSDENNREWSRSAPHELIDWVNSYDKNGVYGSKKHDQYRRLVRYLKRWRNVTFGEDVRRKIYSIGIAVMVKECFVSSINDEGFPNDLSALCSTINNILNYSNYFTLVDVDKYKVKVALPVSPFRDIFHSSSTATGTQLRNKFSSLSKTLDKVADEEDESKQCELLRGVFGGDFPECASSSSASSAAKKTVYASAGAVGTSQGA

SEQ ID NO: 3379 - protein, 347 aa, Unknown
  Description of Unknown: Enterobacteriaceae sequence
MSLQNKFKNFHDAIKLGRKDLEYTTARLKDDSITADIVERFKEDGYPVIEDFIQGSLATSTGIREKGQDYDIDRAIVIEAKLAPENPITPKLAVLEVLEKRGFKNAKIKKPCVTADYKVDDLHIDIPIYRKYDNGQYELAVGKRYSDENTREWARAAPRELIDWVNNYDANEAYGSNKHDQYRRIVRYLKRWRNFTFGDDVRRKIYSIGIAVMVKESFFSSINDEGFPDDLSALRKTINYILNYQNYFTLVEDGKYRIKVTLPVSPYRDIFHGSSIVTGTQFRNKLSALLKILDKVADEDQESRQCELLRSVFGEDFPECAAASSTSSSTVKTVFASAGVVGTSQGA

SEQ ID NO: 3380 - protein, 347 aa, Escherichia coli
MSLQNKFKNFHDAIKLGRKDLEYTTARLKDDSITADIVERFKEDGYPVIEDFIQGSLATSTGIREKGQDYDIDRAIVIEAKLAPENPITPKLAVLEVLEKRGFKNAKIKKPCVTADYKVDDLHIDIPIYRKYDNGQYELAVGKRYSDENTREWARAAPRELIDWVNNYDANEAYGSNKHDQYRRIVRYLKRWRNFTFGDDVRRKIYSIGIAVMVKESFFSSINDEGFPDDLSALRKTINYILNYQNYFTLVEDGKYRIKVTLPVSPYRDIFHGNSIVTGTQFRNKLSALLKILDKVADEDQESRQCELLRSVFGEDFPECAAASSTSSSTVKTVFASAGVVGTSQGA

SEQ ID NO: 3381 - protein, 347 aa, Salmonella enterica
MSLQNKFKNFHDAIKLGRKDLEYTTARLKDDSITADIVERFKEDGYPVIEDFIQGSLATSTGIREKGQDYDIDRAIVIEAKLAPENPITPKLAVLEVLEKRGFKNAKIKKPCVTADYKVDDLHIDIPIYRKYDNGQYELAVGKRYSDENTREWARAAPRELIDWVNNYDANEAYGSNKHDQYRRIVRYLKRWRNFTFGDDVRRKIYSIGIAVMVKESFFSSINDEGFPDDLSALRKTINYILNYQNYFTLVEDGKYRIKVTLPVSPYRDIFHGSSIVTGTQFRNKLSALLKTLDKVADEDQEPRQCELLRSVFGEDFPECAAASSISSSTVKTVFASAGVVGTSQGA

SEQ ID NO: 3382 - protein, 347 aa, Escherichia coli
MSLQNKFKNFHDAIKLGRKDLEYTTARLKDDSITADIVERFKEDGYPVIEDFIQGSLATSTGIREKGQDYDIDRAIVIEAKLAPENPITPKLAVLEVLGKRGFKNAKIKKPCVTADYKVDDLHIDIPIYRKYDNGQYELAVGKRYSDENTREWARAAPRELIDWVNNYDANEAYGSNKHDQYRRIVRYLKRWRNFTFGDDVRRKIYSIGIAVMVKESFFPSINDEGFPDDLSALRKTINYILNYQNYFTLVEDGKYRIKVTLPVSPYRDIFHSSSIVTGTQFRNKLSALLKILDKVADEDQESRQCELLRSVFGEDFPECAAASSTSSSTVKTVFASAGVVGTSQGA

SEQ ID NO: 3383 - protein, 347 aa, Unknown
  Description of Unknown: Enterobacteriaceae sequence
MSLQNKFKKFHDAIKLGRKDLEYTTARLKDDSITADIVERFKEDGYPVIEDFIQGSLATFTGIREKGQDFDIDRAIVIEAELAPENPITPKLAVLEVLEGRGFKNAKIKKPCVTADYKADDLHIDIPIYRKYDNGQYELAVGKKHSAEDNREWARSAPRELIDWVNNYDANEAYGSNKHDQFRRIVRYLKRWRNFTFGDDVRRKIYSIGIAVMVKESFVSSINDEGFPDDLTALRKTINHMLNYRSYFTQVDVDKYSVNVTLPVSPYRDIFHSSSIVTGTQFRNKLSALLKTLDKVADEEQESKQCELLRNAFGEDFPECAETSSASSNAVKTVFASAGVVGTSQGA

SEQ ID NO: 3384 - protein, 347 aa, Raoultella ornithinolytica
MSLQNKFKKFHDAIKLGRKDLEYTTARLKDDSITADIVERFKEDGYPVIEDFIQGSLATFTGIREKGQDFDIDRAIVIEAELAPENPITPKLAVLEVLEGRGFKNANIKKPCVTADYKADDLHIDIPIYRKYDNGQYELAVGKKHSAEDNREWARSAPRELIDWVNNYDANEAYGSNKHDQFRRIVRYLKRWRNFTFGDDVRRKIYSIGIAVMVKESFVSSINDEGFPDDLTALRKTINHMLNYRSYFTQVDVDKYSVNVTLPVSPYRDIFHSSSIVTGTQFRNKLSALLKTLDKVADEEQESKQCELLRNAFGEDFPECAETSSASSNAVKTVFASAGVVGTSQGA

SEQ ID NO: 3385 - protein, 347 aa, Buttiauxella noackiae
MSLQNKFKSFHDAIKLGRKDLEYTTARLKDDSITADIVERFKEDGYPVIEDFIQGSLATFTGIREKGQDFDIDRAIVIEADLAPENPITPKLAVLEVLEGRGFKNAKVKKPCVTADYKADDLHIDIPIYRKYDNGQYELAVGKRHSDEDNREWARAAPRELIDWVNNYDANEAYGSNKHEQFRRIVRYLKRWRNFTFGDDVRRKVYSIGIAVMVKESFNSSINDEGFPDDLTALRKTINHILNYRSYFTLVNVDKYSVNVVLPVSPYRDIFHSSSIVTGTQFRNKLSALLKTLDKVADEEQESKQCELLRSAFGEDFPECAATSSASSTAVKTVFASAGVVGTSQGA

SEQ ID NO: 3386 - protein, 347 aa, Klebsiella pneumoniae
MSLQNKFKSFHEAIKLGRKDLEYTTARLKDDSITSDIIERFKEDGYPVIEDFIQGSLATFTGIREKGQDFDIDRAIVIEAGLAPENPITPKLAVLEVLEDRGFKNAKIKKPCVTADYKADDLHIDIPIYRKYDNGQYELAVGKRHSDEENREWAKAAPRELIDWVNNYDRDEPHGSNKHDQYRRIVRYLKRWRNFTFGDDVRRKIYSIGIAVMVKESFNSSINDEGFPDDLTALRETINHILNYRSYFTMVDVDKYRVNAALPVSPYRDIFHSSSIATGTQFRNKLSALLKILDKVANEEKESEQCELLQSVFGEDFPECAVTSSASSTAVKTVFASAGVVGTSQGA

SEQ ID NO: 3387 - protein, 347 aa, Pantoea rwandensis
MSLQNKFKNFHDAIKLGRKDLEYTTARLKDDSITTDIVNRFKEDGYPVIEDFIQGSLATFTGIREKGQDFDIDRAIVIEAELAPENPITPKLAVLEVLEQRGFKNAKIKKPCVTADYKAEHLHIDIPIYRKYDNGQYELAVGKRHSDEENREWARASPRELIDWVNDYASDEAYGSNKHNQYRRTVRYLKRWRNFTFGDDVRRKIHSIGIAVMVKESFKSSINDEGFPDDLTALRETINHILNYRSYFTLVELDRYRVNVALPVSPNRDIFHCSSVATGTQFRNKLNALLKTLDNVSDEEQESKQCELLRSVFGEDFPECTATSSASSNAVKTVYASSGVVGTSQGA

SEQ ID NO: 3388 - protein, 347 aa, Cronobacter sakazakii
MSLQAKFKKFHDAIKLGRKDLEYTAARLKDESITTDIIERFKEDGYPVIEDFIQGSLATFTGIREKGQDFDIDRAIVIEAGLAPENPITPKLAVLEVLEKRGFKNAKIKKPCVTADYKAQNLHIDIPIYRKYDNGQYELAVGKRHSDEDNREWSRAAPRELIDWVNDYDADEVYGSNKHDQFRRIVRYLKRWRNHTFGDDVRRKIYSIGIAVMVKESFCPSINDEGFPDDLTALRETINHILNYRSYFTLVDVDKYKISVALPVSPYRDIYHNSSVATGTQFRKKLSSLLKNLDKVVDEEQESKQCELLRSEFGEDFPECTATLTASSSVVKTVFASSGVVGTSQGA

SEQ ID NO: 3389 - protein, 347 aa, Enterobacter asburiae
MSLQAKFKKFHDAIKLGRKDLEYTAARLKDESITTDIIERFKDDGYPVIEDFIQGSLATFTGIREKGQDFDIDRAIVIEAGMAPENPITPKLAVLEVLEKRGFKNAKIKKPCVTADYKAQNLHIDIPIYRKYDNGQYELAVGKRHSDEDNREWSRAAPRELIDWVNDYDADEVYGSNKHDQFRRIVRYLKRWRNHTFGDDVRRKIYSIGIAVMVKESFCPSINDEGFPDDLTALRETINHILNYRSYFTLVDVDKYKISVALPVSPYRDIYHNSSVATGTQFRKKLSSLLKNLDKVVDEEQESKQCELLRSEFGEDFPECTATSTASSSVVKTVFASSGVVGTSQGA

SEQ ID NO: 3390 - protein, 345 aa, Stenoxybacter acetivorans
MSIQNKFKIFHDAIKLGRKDIEYTTARLKDDSITAEIVKRFKEDGYPIIEDFIQGSLATSTGIREKGQDFDIDRAIVIEAELAPENPITPKLAVLEVLEKRGFKNAKIKKPCVTADYKADDLHIDVPIYRKYENGQYELAVGKKHADENNREWARAAPHELIDWVNYFDNNETYGQKKHDQYRRIVRYLKRWRNFIFSEEDVRRKVYSIGIAVMVKESFNPSINDEGFPDDLTALRATINRLLNNQGYFSMVDIDKYKVKVILPVSPSRDIFHNSSIATGTQLRNKLNALLRILDKTADEDQESKQCELLRSVFGEDFPECASKTSENVKTVFSTAGAVGTSQGA

SEQ ID NO: 3391 - protein, 347 aa, Photorhabdus asymbiotica
MSIQSKFNTFHKAIKLGRKDPEYKNARSKDDSITEDIKARFKEDGYPIIEDFIQGSLATHTAIKEKGQDFDIDRAIVIEVSLAPDNPIIPKEAVLEVLENRKFKNAKIKKPCVTADYKTENLHIDIPVYRRYENEQYELAIGKRHSDENNREWSTAAPHELIDWINRSDKYGFYESEKIAQYRRIVRYLKRWRNFKFKEEVRQKIFSIGIAVMVKEQFQSSVNTEGFPDDLLALRTTLYGILNCGGYFTEVEEDIYKVKVLLPVSPRRDIFYKSSTNTGTQFRNKLRSLLNILDKTANEENESKQCDLLRSVFGEDFPESTSSNSTGSSSAKTVFATAGAVGTSQGA

SEQ ID NO: 3392 - protein, 347 aa, Xenorhabdus sp.
MSIQSKFNTFHKAIKLGRKDPEYKNARSKDDSITEDIKARFKEDGYPIIEDFIQGSLATHTAIKEKGQDFDIDRAIVIEVSLAPDNPIIPKEAVLEVLENRKFKNAKIKKPCVTADYKTENLHIDIPVYRRYENEQYELAIGKRHSDENNREWSTAAPHELIDWINRSDKYGFYESEKIAQYRRIVRYLKRWRNFKFKEEVRQKIFSIGIAVMVKEQFQSSVNTEGFPDDLLALRTTLYGILNYGGYFTEVEEDIYKVKVLLPVSPRRDIFYKSSTNTGTQFRNKLRSLLNILDKTANEENESKQCDLLRSVFGEDFPESTSSNSTGSSSAKTVFATAGAVGTSQGA

SEQ ID NO: 3393 - protein, 347 aa, Xenorhabdus bovienii
MSIQSKFNIFHKAIKLGRKDPEYKNARSKDDSITEDIKARFKENGYPIIEDFIQGSLATHTAIKEKGQDFDIDRAIVIEVSLAPDNPITPKEAVLEVLESRRFKNAKIKNPCVTADYKTENLHIDIPVYRRYENEQYELAIGKRHSDENNREWSTAAPHELIDWINNSDKYGLYGSEKIAQYRRFVRYLKRWRNFKFKKEVCKKIFSIGITVMVKEQFQSSVNTEGFPDDLSALRATLYGILNYGNYFTEVEEDSYKVKVLLPVSPRQDIFYKSSTDTGTQFRNKLKSLLDTLDKVASEESESKQCDLLRSVFGEDFPKSTSSNSTGSSSAKTVFATSGAVGTSQGA

SEQ ID NO: 3394 - protein, 346 aa, Unknown
  Description of Unknown: Yersinia sequence
MSIQSKFRAFDDKIRLGRKDVAYANARAKDDSITAKIKDVFKENGYPVIEDFIQGSLETWTTIKQQGQDFDIDRAIVIDADDSPNDPIIPKRVVLEILEKRGFKNAKIKKPCVTADYKTEDLHIDIPIYRKYQNGEYELAVGKLNSSEDNKEWSRSAPKELIHWVNNSDIYDNYKSEKLAQFRRLVRYVKRWRNENFSEDVARKVFSIGLTVMLKQHFKPKINDEGFADDITALSATISSILNTGGYFKYKSIDTYTVHVTLPVNPYRDIFKNSSTSTATQLRNKFYSLNSTLQQVIDEDNESKQCEKLIKTFGEDFPTCSSSNSSASSGKTIFSSAGAVGTSQGA

SEQ ID NO: 3395 - protein, 346 aa, Unknown
  Description of Unknown: Yersinia sequence
MSIQSKFRAFDDKIRLGRKDVAYANARAKDDSITAKIKDVFKENGYPVIEDFIQGSLETWTTIKQQGQDFDIDRAIVIDADDSPNDPIIPKRVVLEILEKRGFKNAKIKKPCVTADYKTEDLHIDIPIYRKYQNGEYELAVGKLNSSEDNKEWSRSAPKELIHWVNNSDIYDNYKSEKLAQFRRLVRYVKRWRNENFSEDVARKVFSIGLTVMLKQHFKPKINDEGFADDITALSATISSILNTGGYFKYKSIDTYTVHVTLPVNPYRNIFKNSSTSTATQLRNKFYSLNSTLQQVIDEDNESKQCEKLIKIFGEDFPTCSSSNSSASSGKTIFSSAGAVGTSQGA

SEQ ID NO: 3396 - protein, 351 aa, Yersinia pseudotuberculosis
MSIQSKFRAFDDKIRLGRKDVAYANARAKDDSITAKIKDVFKENGYPVIEDFIQGSLETWTTIKQQGQDFDIDRAIVIDADDSPNDPIIPKRVVLEILEKRGFKNAKIKKPCVTADYKTEDLHIDIPIYRKYQNGEYELAVGKLNSSEDNKEWSRSAPKELIHWVNNSDIYDNYKSEKLAQFRRLVRYVKRWRNENFSEDVARKVFSIGLTVMLKQHFKPKINDEGFADDITALSATISSILNTGGYFKYKSIDTYTVHVTLPVNPYRNIFKNSSTSTATQLRNKFYSLNSTLQQVIDEDNESKQCEKLIKIFGEDFPTCSSSNSSASSGKTIFSSAGAVGTSQGACVNDG

SEQ ID NO: 3397 - protein, 346 aa, Serratia sp.
MSIQQKFNDFDNKIRLGRKDEAYGAARAKDDSITEAIYRQFKENGYPVIDDFIQGSLATYTAIKEKGKDFDIDRAIVISNAEAPDDPLIPKRVVLQLLEKRGFKNAKIKSPCVTADYTSEDLHIDIPVYRRSLYGDYELAVGKNSSSEQHKIWNPCAPKELIDWVNKSSQYGVYSDKKLSQFRRLVRYIKRWRNFTFSDEVGRKIYSIGLCIMFKEQFSNCISDEGIPNDLNALEATLSAVLNSTYFTHDGQGHYTVSVNLPVSSYRDIFDGSSVNTGAQLYNKLVSLRDKLRKVQNEESESKQCDMLITLFGEDFPTSSRASNASQNAGKALYATAGAVGTSQGA

SEQ ID NO: 3398 - protein, 347 aa, Oblitimonas alkaliphila
MTIQKKFLEFNKNIHLTREESVYSDARKKDDSILAKIKERFKEEGYPVVSDFIQGSLSTFTAIKEQSEDFDIDRGIVIDADKAPDNPLKPKEVILDILEQRGFENATIKKPCVTADYKNDNLHIDIPIYKRDSYGNYQLAVGKSNSTKEWSDSDPIGLRDWINDFDMYLYYKDEHRDQFRRLVRYIKKWRNHQFSDSIKKKIFSIGLTVMFKEQFQPSINDEGIADDVQALRDTINAILRADYFIPQDDNKYKIRIDLPVTPYRDIYDGKGSSERGTQLYNRLNRLVDKLNEVSDPSMDLSKQCEIMNKQFGDQFPTVAVTEKNFTESNDSSNIFLSAGIVGTSNGA

SEQ ID NO: 3399 - protein, 365 aa, Desulfobacula sp.
MAIQSHFNKFDKTIYLTNQSDDYKEAKEKDVSILDAIKIKFKENKFSVENSFLQGSFSVDTAIKSKTGDYDIDRSIVINSDTAPEDPLKPKNVILEVLENRNFQDPKVKMPCVTADYLSKNLHIDFTVYSKDQFENYKLSVGKRGSSDDLKEWSDSDPIGLKDWILSTNNYGEGSSIKRKQFKRFVRFIKRWRDVTFGEEVKKKIFSIGLTVMIKNEYKPDTWRSDVDDDLTALKRVIDNILGGAYLNLASSNPDQYRIYVPLPCSPYRDIFQHKNEIGNKESGSDKNIGTQLKNKLTTLQNKLQEAIDETDEVKQCKILNKVFGEDFKVPEKKTDNSSNSSGQKAASVFPSAGAVGTSQGAICK

SEQ ID NO: 3400 - protein, 362 aa, Oceanospirillum linum
MPIQTHFNNFDKAIYLTGQSPGYKKAKEKDDSILNDLKNRFIEEGYPVVETFLQGSFSVNTAINSLEGDYDIDRALVIDADSAPEDPVKPKDVALDVLKKRSFKNPKVKKPCVTADYLSINLHIDYTIYTRDSSGNYKLAVGKLGSLAENKEWSPSDPKGLIDWINEASGYGESSVSKRKQFKRLVRYMKRWRDVNFNEQSRKKLFSIGLTIMIKEQYQPGYCSDVKDDLTALEQVVRNMLNAGYIRQLYSYDQALYRLSVNLPKSPHRDVFQHKVGTLSEPGSDTNIGTLFRNKLTSLLSKLEEASSETDEIKQCGILNKVFGDDFKIPNSSGSKGCESVVGATAASYFPTAGASGTSQGA

SEQ ID NO: 3401 - protein, 368 aa, Vibrio rhizosphaerae
MPIQAYFDKFNKKIYLTSHSEGFKKAKEKDKSILEEIKSAFKDAGYPVVDTFMQGSFAVNTAINSLDGDFDIDRAIVIDAENAPEDPITPKKTIKEILDKRNFKEPRIKKPCVTADYKSINLHIDYTVYKKETSLFSNDTYYLAVGKNGASNEHKEWSEADQKGLIEWIDSVDNFVFGATAKRKQLKRLIRYIKRWRDVNFNSEGVRKKVFSIGLTIMVKEQYHPNPFSAEVDNDLQALKNTVDAILDADYISAPWGTSDYRVSVRLPMAPKRDIFQHKVGGGNADGSDLAVGGQLRNKLLKLQEELKKALDETDERKQCEILNKVFGDDFEVPKEEKQSSSKATSILLTAGAAPLSTAGASGTSQGA

SEQ ID NO: 3402 - protein, 368 aa, Vibrio vulnificus
MPIQAHFNKFNKNIYLTSHSEGYKKAKEKDKSIFEEIKSAFTDAGYPVVDTFMQGSFAVNTAINSLDGDFDIDRAIVIDADKAPEDPIAPKNIIKEILDKRNFKDPRIKKPCVTADYKSINLHIDYTVYKKETSLLGNDTYYLAVGKNGSSTEHKEWSEADQKGLIEWIDSVDDFFLGATAKRKQLKRLIRYIKRWRDVNFNSEEVRKKVFSIGLTIMVKEQYCPNSFSAEVDDDLQALKNTVDAILDADYISAPWGTSDYRVSVRLPKVPKRDIFQHKVKGGHADGSDLTVGAQLRNKLLKLQEELKKALDETDERKQCEVLNKVFGDDFEVPKEEKQSSSNAASTLLTTGAAPLSTAGASGTSQGA

SEQ ID NO: 3403 - protein, 368 aa, Vibrio parahaemolyticus
MPIQAHFNKFNKNIYLTSHSEGYKKAKEKDKSIFEEIKSAFTDAGYPVVDTFMQGSFAVNTAINSLDGDFDIDRAIVIDADKAPEDPIAPKNIIKEILDKRNFKDPRIKKPCVTADYKSINLHIDYTVYKKETSLLGNDTYYLAVGKNGSSTEHKEWSEADQKGLIEWIDSVDDFFWGATAKRKQLKRLIRYIKRWRDVNFNSEEVRKKVFSIGLTIMVKEQYCPNSFSAEVDDDLQALKNTVDAILDADYISAPWGTSDYRVSVRLPKVPKRDIFQHKVKGGHADGSDLTVGAQLRNKLLKLQEELKKALDETDERKQCEVLNKVFGDDFEVPKEEKQSSSNAASTLLTTGAAPLSTAGASGTSQGA

SEQ ID NO: 3404 - protein, 361 aa, Moritella viscosa
MSIQTHFNKFNKNIYLTNQSDGYRKAKEKDESIYNEIKSAFSDAGYPVIETFMQGSFAVNTAINSLDGDFDIDRAIVIDADNAPDDPVAPKKVVLDVLEKRNFKNPRIKKPCITADYKSIKLHIDYTVYQKEKFILADDTYYLAVGKHGSSVAHKEWSESDQKGLIDWVDSVDDYILGALVKRKQLKRSIRYMKRWRDVNFSEEVRKMIFSIGLTVMIKEQYSPNVFSAEVDNDLNALKNIVDKILLSNYIQAPMWTSDYRVYVKLPKVPYRDIFQHKVDGGRADGSDLNVGSQLRNKLTSLQTDLQKAIDETDEIKQCTILNKIFGDDFKIPKKDNNASALIGGATSLSSAGASGTSQGA

SEQ ID NO: 3405 - protein, 364 aa, Endozoicomonas sp.
MAIQKHFNQFDENIYLSRRSSGYKKAKAKDESILDEIKTAFKEAGYPVIETFLQGSFAVDTAISSLKSDYDIDRALVIDASKAPEDPVEPKQVVLKVLEDRNFKNPKIKKPCITADYQSIDLHIDYTVYKKGEDIFGNNAYHLAVGKAGSDQNNKEWSPSDPRGLIGWIRDVERYGAGPLEKGKQYKRLVRYMKRWRDFNFNEETGKKLFSIGLTVMLKEQYKPGWFSSEIKDDLVALKEAVDGILDDSYIRAPLFSENYRVFTELPKKPHRDIFQHKVSGGESEPGSDLNLGEQLKNKLTKLQAELQKAIDQSCEIKQCSILNMIFGDDFAIPEADEKKKAASLVAGAALFASAGASGTSQGA

SEQ ID NO: 3406 - protein, 364 aa, Endozoicomonas ascidiicola
MTIQAHFNTFDKKIYLTNHSKGYQEAKAKDEGILSAIKEAFREAGYPIIDTFFQGSFAVYTAINSLDDDFDIDRALVIDASQAPDDPIAPKKVVKKVLENRNFKEPKIKKPCITADYQSLNLHIDYTVYALDSCPLFGDSYKLAVGKEGSDDNNKEWSPSDPKELIGWIDDAEQYGMKSLEKRKQFRRLVRYMKRWRDESFSAEVKKKLFSIGLTVMLKEQYAPGYLRKELEDDLTVLKKVVDNILDASYLEKDFWTDNYRLSVKLPRKPGRDIFQHKVDGGRSEPGSDYNLGNQFRNKLQRLQDKLQKAQNEESEVKQCTLLNSVFGDDFPIPEEKASNAARVAAASVAYLPVAGASGTSQGA

SEQ ID NO: 3407 - protein, 346 aa, Granulosicoccus antarcticus
MGLQAHFNTFHNKIKLSREDEAYKKARERDNSITADVKEEFKDAGYPVIDDFLTGSHGNNTAIHPLSGDLDIDRTLVIDDDQAPENPLDPKKKTLSVLEDRGFKNAKIKMSCVTADYASDNVHIDYPIYKKSGDSYSLAIGKNNSDEKNREWSPSDPKGLKSWVKDQSVHAAPAEKKHDQYRRLVRYLKRWRDFKFSDPVLSKVYSIGLTVMAKECFVSDLDSEGFPSDLSALSQTVSQILDNEYFTCVDVDADRYKVQVALPVSPYRDIFDGSSADTGTQFRNRLKKMLSKLEEAEGLDDVRKQCQIMNELFGDDFPVPDAPKTPDGKAAKTFSSAGAVGTSQGA

SEQ ID NO: 3408 - protein, 344 aa, Snodgrassella alvi
MATLQTMYLNFKDNIALTRECDRYKKAREKDDVIKDKVSKAFCEEGYEVHSTFLQGSLATHTGIIPIDGDYDIDRAIAITKASSPDNPLEPKKIIKYVLENHNFKEPKIKKPCVTADYINEPFHIDFPTYRVDSIGHYELAVGKEFSDQNNRSWSPSDPKGLVEWITSEKNHQAPYITLTEEEKYQFYRLVRYMKRWRDERYSSKSERKKVYSVALTIMIKESFCPNIDDSGKADDHKALKDTLEIMINRYFTRNSDGNYSIRVTLPVLPYNNIYQDKGEAVGKLLHPRLKNLLNALKEVDTKDTLKAQCELLRKHFGNDFPESNNEIRDKGTKAGLVGVSDGA

SEQ ID NO: 3409 - protein, 344 aa, Snodgrassella alvi; identical to SEQ ID NO: 3408

SEQ ID NO: 3410 - protein, 342 aa, Aeromonas finlandiensis
MATLQSKYNQFIKNIILTRESDEYKKARDKDDIVTPKVEDALNDAGYHVQARFLQGSLASNIAIKPLDGDYDIDRAVVITKESSPENPVDVKKIVRDVLIKHGFKEPKIKKPCVTADYKNENYHIDFPIYRIDENQNYQLAVGKEFSDENNREWANSEPKKLKEWIASLSIPKEITDDERSQYYRLVRYLKRWRDFVYTNEVERKKVYSIALTIMVKESFSPCIDNDGKVNDNQALIDTLTNILKDYKYFIPASNGYEVHVNLPVTPYSDTFQKNGETVGTLLRKRMQYLLDALNETNDMSSLKKQCEKLRQYFGDDFPESEDEPTRDSSRSAGLVGVSNGA

SEQ ID NO: 3411 - protein, 350 aa, Psychromonas hadalis
MSLQSQYKKFTETISLTRQDSGYKDAREKDDLIYGKIKVAFKEEKYDISDTFLLGSMGVYTGIKPIDGDHDIDRAIVVTKESSPENPIDIKKVVKKVLKDHGFSDPKIKKPCITADYKNKPIHIDYVVFRIDDNDDNADIELAVGKETSNEDNRKWDESDPKGLKSWLVWEGEGKSTEERAQYYRLVRIMKRWRDYKYTDVKKRKKVYSIGLAVMLKEKICFSIDENGKADDHLALRNTIDNILADNTYFKKDIFSTLLGEVKYDLIVNLPKSPNRDIFDNHGKTVGTTLRERLSKLRDILDEVTEQKNLKNQCEILEKSAFGNDFPIPSDNEKREQTDSSGVMSVSSGA

SEQ ID NO: 3412 - protein, 339 aa, Pseudoalteromonas luteoviolacea
MSLQSQYDDFAKKIKLTRESDKYKEAREKDDTIYGKIKDAFKEKGYKISRTKILGSMGSYTSVVPLNGDYDIDRGIFVTKESAPTNPIEIKKVIKDVLKNHGFSEPKIKKPCVTADYKSKPIHIDYVVFREEGDVIELAVGKENSSEDNRKWDKNDPDGLQDWLTWKDEGTTSAQRQQFYRLTGYLKRWRDHKYSSNESERKKVYSIGLAVMLKEQFDASVNNKGIPNDNEALKNTVEGILNSNYFRKSWFSDKYDIRVDLPKSPYRDIFDGRGENVATTLRNRLDKLKGVLEKVDEEEDLHKQCEMLRGEFGEDFPLPTKNNRVKARGAGVVGVSNGA

SEQ ID NO: 3413 - protein, 348 aa, Candidatus Magnetomorum sp.
MSLQTQFIKFEEKIRLTWQDDRLKKIREKDESIRKNIRDAFKEAGYPIIDFFKQGSYATKTTIVPLAEDYDIDVGVVVDTKNAPENPVDAKKTLKKVLEKRNFKEPKIKLPCVTAQYYKQGDPHFHLDYPVYKKDENDNYYISIGKEHSNEEIRKWEESDPKGLINWLNKLDDFSDEKSYYQYKRLVKYIKKWRDFKFSNSEKKNVYSIGLAVMIRESFQNAISSDGDITDIKSLKDTVDRILSNHYFKKIGYDSNSNAQYEIVVKLSKKPYRNIFEKHRKTVGTLIFNRLTKLSNHLQNVLNETNVKKQSEILRDKVFGDDFPVPENENSENKKFKESGFVASPQGA

SEQ ID NO: 3414 - protein, 339 aa, Clostridium sp.
MGAKLYKQFQDFHNTIKLDKETSQLKEKRETLQTDIKNKLPQKLEGIGIEITKSDLHFFDQGSYRQNVSTGIVSDAPDRDVAVDFELDIEAYNDPRKIKKCVRDALKIENKRNPLIKEPCVTVKYLKAGEEKIHIDFPVYAKHNGNYYLARGKEFSQSYEWEHCDPYGLNEHLDNLFAGAKGNQLRRIVRYLKKWKLENYGDSYSKDQIPPSIAFTLMAGDAFVYKITDGQDDDLLALNTVVNSIKNKFSCNLITGKYTIKYSLPVRPWSNVFYKMTEDYQDRFYRKWLTLCIKVQNAVDASEEYEAAKFLQEIFGTDFELPPKPQTKTGTARNEYSYA

SEQ ID NO: 3415 - protein, 339 aa, Ruminococcus sp.; identical to SEQ ID NO: 3414

SEQ ID NO: 3416 - protein, 356 aa, Clostridium spiroforme
MNLKNKIKYYLNFKVVQKEVVFTMKLKKQFQDFHDYIKSPLTDQLKEKRAMFEDEIKNNFSTVCDEKGIEIKKSDLNFFMQGSYSISTAIDAYDSSVDLDLAVAFEFNVEDNSDCREIKGYMRDSIDNYNRTIDYKIPCITVTYFEDGEESYHIDFPIYAIHNNQYYLAKGKEYSSDYKWELSDPKGLKKYLESYLANNSQLRRVVRYLKCWKLNAFDRNNGNEVPPSIALTLLACKYFEEKKEDNQDYDLEALYNVVKKIKDSIDSYSDDPYYYVNLPVVPYTDTMFKINSNSSYRKKFKSKIYDFELQLRNAKNAGDEHTAGEYVRKVLGEEFEVPEKQVDAGENKFRRTSQFG

SEQ ID NO: 3417 - protein, 333 aa, Clostridium spiroforme
MKLKKQFQDFHDYIKSPLTDQLKEKRAMFEDEIKNNFSTVCDEKGIEIKKSDLNFFMQGSYSISTAIDAYDSSVDLDLAVAFEFNVEDNSDCREIKGYMRDSIDNYNRTIDYKIPCITVTYFEDGEESYHIDFPIYAIHNNQYYLAKGKEYSSDYKWELSDPKGLKKYLESYLANNSQLRRVVRYLKCWKLNAFDRNNGNEVPPSIALTLLACKYFEEKKEDNQDYDLEALYNVVKKIKDSIDSYSDDPYYYVNLPVVPYTDTMFKINSNSSYRKKFKSKIYDFELQLRNAKNAGDEHTAGEYVRKVLGEEFEVPEKQVDAGENKFRRTSQFG

SEQ ID NO: 3418 - protein, 333 aa, Clostridiales bacterium
MKLKKQFQDFHDYIKSPLTDQLKEKRAMFEDEIKNNFPSVCDEKGIEIKKSDLHFFMQGSYSISTAIDAYDSSVDLDLAVAFEFNVEDNSDCREIKGYMRDSIDNYNRTIDYKIPCITVTYFEDGEESYHIDFPIYAIHNNQYYLAKGKEYSSDYKWELSDPKGLKEYLESHLANNYQLRRVVRYLKCWKLNAFDRNNGNEVPPSIALTLLACKYFEEKKEDNQDYDLEALYNVVKKIKDSIDSYSDDPYYYVYLPVVPYTDTMFKINSNSSYRKKFKSKIYDFELQLRNAKNAGDEHTAGEYVRRVLGEEFEVPEKQVDAGENKFRRTSQFG

SEQ ID NO: 3419 - protein, 337 aa, Enterococcus faecalis
MLQKEFENFNKNIQIEGESEALRTKRDMLKKDFKVKFPELCQEKNIDLKSSEINFIMQGSFKLGTTIKSKDGDIDLDQGVSFPLNIYDNEDTREIKKLGKSALEISGKRVPKIKEPCITVDYIRQGEDWLHLDFPMYAEYGGSFYLARGKQHGSYSWEIADPKGLNEYILAKLSSNEGGQLRRLIRFLKKWKQEVYTDNDTTEKRPPSIGLTLLAVDLYQKNDSDLIAFKNLCESILREFTVVKDINGNVISASIKKNLPVRPYSDVFKKFENSENHTITFYKRFNRAVENLTNALECDNDHDAAKYIVKILGEEFEIPEKEVKSYATKVKPEHSFG

SEQ ID NO: 3420 - protein, 337 aa, Enterococcus faecalis
MLQKEFENFNKNIQIEGESEALRTKRDMLKKDFKVKFPELCQEKNIDLKSSEINFIMQGSFKLGTTIKSKDGDIDLDQGVSFPLNIYDNEDTREIKKLGKSALEISGKRVPKIKEPCITVDYIRQGEDWLHLEFPMYAEYGGSFYLARGKQHGSYSWEIADPKGLNEYILAKLSSNEGGQLRRLIRFLKKWKQEVYTDNDTTEKRPPSIGLTLLAVDLYQKNDSDLIAFKNLCESILREFTVVKDINGNVISASIKKNLPVRPYSDVFKKFENSENHTITFYKRFNRAVENLTNALECDNDHDAAKYIVKILGEEFEIPEKEVKSYATKVKPEHSFG

SEQ ID NO: 3421 - protein, 337 aa, Enterococcus faecalis
MLQKEFENFNKNIQIEGESEALRTKRDMLKKDFKVKFPELCQEKNIDLKSSEINFIMQGSFKLGTTIKSKDGDIDLDQGVSFPLNIYDNEDTREIKKLGKSALEISGKRVPKIKEPCITVDYIRQGEDWLHLDFPMYAEYGGSFYLARGKQHGSYSWEIADPKGLNEYILAKLSSNEGGQLRRLIRFLKKWKQEVYTDNDTTEKRPPSIGLTLLAVDLYQKNDSDLIAFKNLCESILREFTVVKDINGNVISASIKKNLPVRPYSDVFKKFENSENHAITFYKRFNRAVENLTNALECDNDHDAAKYIVKILGEEFEIPEKEVKSYATKVKPEHSFG

SEQ ID NO: 3422 - protein, 340 aa, Ruminococcus lactaris
MKLKKQFKDFYDEICIHEESEDLKEKRDTLQKDIEDKFPGEMKDHGIELKKSDIEIFDQGSYKYSTTIKSSVIDRDVAVMIPLDIKEYPDSRKIKGYLRDAVNHVAARTVKIKEPCVNVSYYENGVEWMHIDLPLYAKSDDKVYLARGKEFSEKYLWEIADPKGLNDDLCGKINKNEQLRRVIRYIKKWRNDKYENSTLDHEVPPSIGLTYLACDCFVSSATSEGEDDLMALQQTMSNMKSMFTLTYEDEKLVKADISRYLPVEPFTDVFQKMKDASDSYGVTFYNRLSTAVQNLTDAVNVESEHDAGNYVKKVLGEEFKVPAKQTSSPIPQNKKEHSFG

SEQ ID NO: 3423 - protein, 340 aa, Blautia obeum
MKLKKQFKDFYDEICIHEESEDLKEKRDTLQKDIEDKFPGEMKDHGIELKKSDIEIFDQGSYKYSTTIKSSVIDRDVAVMIPLDIKEYPDSRKIKGYLRDAVNHVAARTVKIKEPCVNVSYYENGVEWMHIDLPLYAKSDDKVYLARGKEFSEKYSWEIADPKGLNDDLCGKINKNEQLRRVIRYIKKWRNDKYENSTLDHEVPPSIGLTYLACDCFVSSATSEGEDDLMALQQTMSNMKSMFTLTYEDEKLVKADISRYLPVEPFTDVFQKMKDASDSYGVTFYNRLSTAVQNLTDAVNVESEHDAGNYVKKVLGEEFKVPAKQTSSPIPQNKKEHSFG

SEQ ID NO: 3424 - protein, 349 aa, Clostridium sporogenes
MKLKKQFEDFYKEITIDTEVEDLIEKREILEKDFKDNFPSECGKHDIEVKKSDIETFDQGSYKLHTTIKNNHDGSIDRDVAVMFPLDIDQNSDPRKIKGYSRDAINLWNRATTIKEPCLNVSYVKDGTEWMHIDLPLYAKYNGNVYLARGKEFATEGNYSWELADPKGLNDYLLDKINGNDQLRRIIRYIKKWKLEKYYSSTLDHEVPPSIGITLLACDCFVASTSSEGDDDLTSLQKTIQNIANKFSLTYEDGILVKADISRCLPVTPWTDVFKKMKDSSDTYGVKFYNRLNTALQNLTDAYNEESEHDAGVSVQKVFGDEFKVPAKQVNVSNSSSASSKKEHNFGRK

SEQ ID NO: 3425 - protein, 352 aa, Clostridium magnum
MKLKKQFEDFYKEITIDTEVEDLIEKRETLENNFKSNFPSECEKHDIEVKKSDIEIFDQGSYKLHTTIKNNHGGSIDRDVAVMFPLDIDQNSDPRKIKGYGRDAINLWNRSVTIKEPCLNVSYVENGTEWMHIDLPLYAKHNGNIYLARGREFATEGNYSWEPADPKGLNDYLIGKINGNNQLRRIIRYIKKWKLEKYYNSTLDHEVPPSIGLTLLACDCFIASTSSEGDDDLSSLQKTIQGIINKFSLTYENGVLVKANISRSLPVTPWTDVFKKMKDSSDTYGVKFYDKLNTALQNLTDACNEESEHDAGLSVQKVFGDEFKVPVKQVNVSTSSNASSKKEHNFGGESNY

SEQ ID NO: 3426 - protein, 340 aa, Pseudobutyrivibrio sp.
MKLKKEFSDFHKEIRISSEADNLREKREILEDEIKTKLPGKLKDHGITVNKSDIRMFIQGSYKYNTTIVSDVVDMDVAVMIPLNIDENPDPRKIKRYLKESIDISKRSVDIKEPCVRASYYENGEEWMHIDLPLYADDDGDIYLARGKDTGIYKWEEADPDGLNENLCNKINGNDQLRRIICFVKKWRNEIYSNSKLDHEVPPSIGLTYLVCDNFVECTSDDGDDDLLALKKTMESIKNSFTNVYYDASGAVISADISKRLPVKPYTDIFSKMRESSKTYMVTFYKRLCVAVDNLTNAVNVESEHDAAKYVQKVLGEQFVVPEKKAMSASTNTKKEHNFG

SEQ ID NO: 3427 - protein, 340 aa, Clostridium clostridioforme
MKLKKEFEDFYKCIRIDSETQNLIDKRETLEKEIKDKFPAIMKNYDIELNKSDIRMIDQGSYKYNTTIKSAVVDRDVAVMIPLDTYENSDPRKIKKYLKESIDIPVRSVSIKEPCVRASYYEKGEEWMHIDLPLYADDNGIIYLARGKASSGEYLWELADPDGLNDDLCGKINGHDQLRRIICFIKKWKNEKYSSSTRDHEVPPSIGLTYLACDCFSEQTSKDGDDDLLALQKTMKAIKDKFSYTKNAQGEIVSADISRYLPVQPYTDVFKKMKDSSSSYMVTFYKRLSIAVDNLTNAVNVESAHDAAEYVQKVLGTEFTVPAKEATTAATQSKKEHSFG

SEQ ID NO: 3428 - protein, 339 aa, Anaerolineaceae bacterium
MKLKKEFEDFYKEIRIDCETHALKEKREVLENDIKTKLPGILGDHSISISRSDIRMIDQGSYKYNTTIKDDIVDRDVAVMIPLDTSANSDPRKIKGYLRDAINISSRTVTIKEPCVRASYYENREEWLHIDLPLYATDCGCVFLARGKEFSSNYSWEYADPDGLNDYLCGRINGNDQLRRIICFIKKWRNEQYSGSSNDYEVPPSIGLTLLACDCFSAQSTNEGDDDLLSLQKTMNGILDKFTYTVDSNGNLIKTITRYLPVTPYTDVFKKMKDSSSLYMTTFYNRLSKAVDNLTNAVNVESAHDAGEYVQKVLGDSFTVPAKEAVAASAQNKREHSFG

SEQ ID NO: 3429 - protein, 354 aa, Alkaliphilus sp.
MARLDKEFKTFYSEEVKYYANKEIRDKKNKLKTDFKSNFPTKFKEYFDDEFKAENIRFIDQGSYAIGTTINHGNKAFDIDVATILDIDVTKYSNPVEIKKIARDSLSSTNRNPIIKEPCITVKYTKEGEEKYHVDFPVYANHNGRLYLARGYEYSSEENRKWELADPEGLNDYFKTDNLQIEGLELSGDEKEQRNQKRRLIRYFKWWKAEKYSNPQSDNEVPPSIALTILVCKYFKYSKIDEKYNDLDSLYKTVNKIIEEIFYDGYDTEWNEIKKIRNCNLPTIPNSDCFSNLKNSDNYVKKFYDKMEYFKNQLEIAVNESNERKAGESICKVFGEKFPLPEEDKANEEDSFAE

SEQ ID NO: 3430 - protein, 354 aa, Clostridium beijerinckii
MAILKNEFITFYNDEVKYYGNSEVREKKKKLKDDFKSKFPTNFKEKYDEEIKVSEIRFIDQGSYSINTTINHGDTAFDIDVATIIDLDINKYEDALEIKKIVRDSLKNTNREPKIKEPCVTVKYTKAGEEKYHIDFPVYANNGGELYLARGKESDDGDDIKWEIADPEGLNEYFKKDNLQVEGLDLDDEEKDKRKQKRRIIRYIKWWKAEKYGTSRRDHQIPPSIALTILVCENFISAKVDDEYNDLKSLYDTVKNITEKVFEKTSDEYEEETIILKECNLPKKPGSDCFFKIRNSYSYIKTFYSRWTTFEENLRKAVEENDERAAGEILVKVFGDKFPLPEVDEVNSEDSFAK

SEQ ID NO: 3431 - protein, 354 aa, Clostridium sp.
MAILKSEFITFYNEEVKYDGNNEIREKKKKLKEDFKSKFPTKFKEKYEEDIKVSDIRFIDQGSYNINTTINHTDTAFDIDVATIINLDINKYNNVLEIKQLVRDALKNTNREPKIKEPCVTVKYTKAGEEKYHIDFPIYASHEGKLYLARGKESDKEEDIKWEIADPEGLSEYFKKDHLQIEGLNLDEEEKKKRKQKRRIIRYIKWWKAEKYGTSRRDHSIPPSIALTILVCEHFESAKIDDEYNDLNALYKTVKNIAGELFEKTFDEDDEEIISLKECKLPKDPGSDCFFKIRNSYSYIKTFYTRWTTFESNLKKAVEEDDERTAGEIVAKMFGDKFPLPEVDEVNSEDSFAK

SEQ ID NO: 3432 - protein, 435 aa, Haemophilus influenzae
MANIQKYFEQFNERIRTGYKYNFELKEKRDTLISNLEDHLHLDFDHFNQGSYGMGTGVKPEDGDFDIDVGIILKESDNNVFNCPYDIKNKVYIALQHQNRTVKIKRPCVTVQYTSGEKDKYHVDFAIYKEDKSGRIHFARGKSPNDEELRWELAEPKDLVNKIKNKFTNDAEKAQYKRCIRALKRWRSNRLNHKNLPSIAITVAAYYDFEPSFYNNEKDNPNDVEALVKFLGKLDYAIFRKNILLPTPPYSNLLGNLTDAQANDLRAKLRKLKDDLEETRNENKRVEDACKKMRKHFGQDFPIPENTNLPTEEFIEDKFSLSKEMKPLNLSLKVSNYSPLIYSVISRFDRSLKLIPKGRELVFRVENVEDFIGCDFYWKVLNVGEEADRRGIRGQIEKGSTLKKEHSDFSGEHYVECYVIRNSVCIARETIDVPI

SEQ ID NO: 3433 - protein, 435 aa, Haemophilus influenzae; identical to SEQ ID NO: 3432

SEQ ID NO: 3434 - protein, 435 aa, Rodentibacter ratti
MANIQQYFEKFNETIRTGYKYNEELKEKRDKLLENLKNNLNLTFSYFNQGSYGMETGVKPIDGDFDIDVGLIFKESDAETLDCPFQLKNKVYQELIHTNRTVRIKRPCVTVQYVEDGEDKYHVDFAIYKENQFGELFFARGKSLDDKELNWESASPKELVNLIKEKFPEGQERKQYKRCIRALKRWKSYKLNHKNLPSIAITVAAYQYFEPKFYDDNKDLPNDVEALITFLDNLDNCLRDKYLALPTKPNSNLLENLTDKQSQELRAKLRKLRDDLDDSQDEKSSPRDACKKMKKHFGQDFPVPEGTNLSTEQFIEEIFALSKELRPLSLSMKISNYDSLICSVLSRFDRDLKLIPKGRTLTFKVGNTSDFIGCDFYWKVMNIGEEAEKRGIRGQIVKGHYIHTEHSDFSGEHYVECYVIKNDICIARETIEVPI

SEQ ID NO: 3435 - protein, 308 aa, Francisella tularensis
MEKNIDKWLSKLYEDIKLGYKDGSDIKSKRTQLLGEVKEKLKGSEYNLVDSFDQGSYALRLGTKPIGSESYDIDVALVFDNIPENEECKKVKKEIFNILNKVHMRQVYYKTPCVTVEYNDGYHIDFAIYKKDSYEDLYLAYGKESSNNQEWKQMDPEGLISHIKEQSNNNELFRQITRLIKYWKKKNYQNLSGEPASIGITLMLVDYFKCFPSSSSNVIEKLLLALKYLKNQNFESYNLPVENYSKIFYKMTTKQADDFKNKLGDFIEALECAIEEDDIKILQKCFGRKDIDVKTESVKPYVTSGLNA

SEQ ID NO: 3436 - protein, 310 aa, Haloplasma contractile
MYTKEINSFIDIITIGNLKSVDLRKSRDAIKGLIIGKFYKDYKIDFKGQGSYDMSTLINPIRGKKYDLDMGVYITIDNSNPYDFYSPQTVKNKLKEVVDEHTGPKTKIKKSCVRVDYSSKDYYIDLPVYLKIGNVNYLARGNDEWMESYPSENTDWFREQVKEKGEELRRIIKLFKAWKDKQSIKFSGLAITILCSQLYVNQGDIFSSFQYVATRLFDTLNFNFICRKPYKPYNDVIEELTSNQRDVFSSRLQSLILKLSKIEETESVDIVNSKFQSLFGDRFPKVNKLDSSKIITNPKRAIVKNKNETA

SEQ ID NO: 3437 - protein, 463 aa, Clostridium sp.
MALYLKDLTKKDINEMFDVFYVNNVILPINKINQLYDKKQLNIDRLKAGLKEYNNENNTDYEIQEIIVQGSIAMGTSVSADEKNYDIDIAIVMDKEKLPEGTLASKRIISESLKKKCYNMKNEPDPTGNSITIEYEEGYHLDFALYGKKGDVYYHCGANEWEERNPKAISRWFNNKNQENNGILKETVKFIKFFCKQNTEWLMPGGLIISVLVEEALKKDYLNMTMDNILKNIINNIIGRLECNNDVLNPTDSSKSLIKKDKDVKKIDNLYKRLKSRISKINELTEDSNIKEICDAWNYFFGDDYFNENFELKKEECEDTEEQIENLYDVELNKNEEQLITCQLSSIEGNTTGRTLRNYESNQPLSVTRFKDQQLIFTANINCNQEYIVLWKIKNNGALAVKNNSIRGEILFSNNSDDFNYIDYNENKRYERISFVGHHYVECYIVKNNIVVNKDRFLVNLID

SEQ ID NO: 3438 - protein, 463 aa, Clostridium sp.; identical to SEQ ID NO: 3437

SEQ ID NO: 3439 - protein, 449 aa, Clostridium sp.
MDKIKNLMNNFYYNEVILSNDKVTELREKKNINITRLKDGINKYNKDNNTDYKLYENLEQGSIAMSTAIEPEYDDFDIDVAIIFEKEKIPSSTDEMKDLIIDFLRPYNYYFKENPKKKNNCIRIEYQDNYHIDFAVYRVSNDYYEHCGLNWTERDPRSINNWFHEQNNLYDDKLRKITRLIKYFSKTRKDWDICGGFIITILVNEALANITLNVDIDKLLLDVIKSISNRINFNTSVKNPTNNQELINDDKNKKRLKNLKEKLDEHISDIENAYLNNDEEDVKRKWNKFFKTDYFTTDSQQRSRCEDNEMFIENIYSIDKLMPIKFEIKCQRYISKDNFKNSTYVNCFDNQKFSITQNKDEKLCFSIDTTIPKPYILLWKIKNNGNYAIENNSLRGEIYYGNNLNSFADDPQSFKRFESISFKGNHYVECYLIKDNKCIAKSRFNVNIQ

SEQ ID NO: 3440 - protein, 449 aa, Clostridium sp.; identical to SEQ ID NO: 3439

SEQ ID NO: 3441 - protein, 356 aa, Xanthomonas campestris
MTIRAHNAWRNGTVPPHGMDQLNSTRRFACGAAHGTRSASMPLSNTELRHYDSHVLRLPADKRSEYHQQVDRLINALTKRLHEQQVVKITKVVKAGSFAKFTILRKTSEDPVDVDVVFYIADRNADHETLASLSEEIYKALIALYPNKAIEDFEIQRKAATVTFTGSGLSVDIVPVIEDASRPGYGWQFDLQDGTKVQTCAPCQIKFVKDRKDQDADFRTLVRMAKRWRRHAGLDHLKSFAVELIMAHVLEINGTAGSIEKRFRDFLLYIAQSELQEHISFPENGAVSTTFTSPVVILDPVCSTNNVTSRLSEEERREIVTTAAEAWATANFASAEDDWELWKELFGPRFKVSEDA

SEQ ID NO: 3442 - protein, 316 aa, Xanthomonas campestris
MPLSNTELRHYDSHVLRLPADKRSEYHQQVDRLINALTKRLHEQQVVKITKVVKAGSFAKFTILRKTSEDPVDVDVVFYIADRNADHETLASLSEEIYKALIALYPNKAIEDFEIQRKAATVTFTGSGLSVDIVPVIEDASRPGYGWQFDLQDGTKVQTCAPCQIKFVKDRKDQDADFRTLVRMAKRWRRHAGLDHLKSFAVELIMAHVLEINGTAGSIEKRFRDFLLYIAQSELQEHISFPENGAVSTTFTSPVVILDPVCSTNNVTSRLSEEERREIVTTAAEAWATANFASAEDDWELWKELFGPRFKVSEDA

SEQ ID NO: 3443 - protein, 316 aa, Xanthomonas citri
MPLSNTELRYYDSNVLRLPADKRSEYHQQVDRLINALTKRLHEQQVVKITKVVKAGSFAKFTILRKTSEDPVDVDVVFYIADRNADHETLASLSEEIYKALIALYPNKAIEDFEIQRKAATVTFTGSGLSVDIVPVIEDASRPGYGWQFDLQDGTKVQTCAPCQIKFVKDRKDQDADFRTLVRMAKRWRRHAGLDHLKSFAVELIMAHVLEINGAAGSIEKRFRDFLLYIAQSELKEHISFPENGAVSATFSSPVVILDPVCSTNNVTSRLSEEERQEIVTTAAEAWATANFASAEDDWALWKELFGPRFKVTEDA

SEQ ID NO: 3444 - protein, 316 aa, Burkholderia ambifaria
MSLNNTEIRYYDSNVLRLPADKRKEYHEQVDRLVTELSKRLKDQSEIKITKVVKAGSFAKYTILRKTSEDPVDVDVVFYISGRSVDKETLASLSQLIYDALIKLYPNKAVEDFEIQRKAATVTFVGSGLSVDIVPVIEDPARPGYGWQFDIHDNTKVQTCAPCQIKFVRDRKDVDGDFRTLVRLAKKWRNRVELKPLKSFAIELIMAHLLAKNGKDGSIEKRFRDFLLYIAQSGLKEVITFPENGKVSPAFADPVVILDPVCNTNNVTSRISEDERLEIVAAATEAWETANFASTEDDIEIWKELFGPRFKVKEEA

SEQ ID NO: 3445 - protein, 316 aa, Burkholderia vietnamiensis
MPLNNTQIRYYDSTVLRLPEDKRKEYHAQVDRLISALTKRVHEQSEIKITKVVKAGSFAKYTILRKTSEDPVDVDVVFYISGRSVDKESLASLTELIYDAMIKLYPNKSVENFEIQRKAATVTFIGSGLSVDIVPVIEDPARAGYGWQFDIHDGTKVQTCAPCQIKFVRDRKDIDPDFRTLVRLAKKWRNRVELKPLKSFAIELIMAHVLAKNGKDGSIEKRFRDFLLYIAQSGLKEVITFPENGLVFPSFTDPVVILDPVCNINNVASRISEDERKEIVAAALAAWETANFASMEDDIEIWKELFGPRFKVEEEE

SEQ ID NO: 3446 - protein, 316 aa, Zoogloea sp.
MSLSNTEIRYYDSTVLRLPADKRKEYHAQVDRLISALTKRVHEQSDIKITKVVKAGSFAKYTILRKTNEDPVDVDVVFYISGRSVDKESLASLTQLIYDTLIKLYPSKSVEDFEIQRKAATVTFAGTGLSVDIVPVIEDSTRAGYGWQFDIHDGTKVQTCAPCQIKFVRDRKDKDPDFRTLVRLAKKWRNRIELKPLKSFVIELIMAHVLSINGKDGTLEKRFRDFLLYIAQSELQEAISFPENGLVFHTFDDPVVILDPVCNNNNVASRITEEERKEIVAAAQEAWETANFASIEDDIDIWKELFGPRFTIEEAA

SEQ ID NO: 3447 - protein, 316 aa, Pelomonas sp.
MSLSNTEIRYYDSTVLRLPADKRKEYHAQVDRLISALTSRLHEQSDVKVTKVVKAGSFAKFTILRKTSEDPVDVDVVFYISGRNVDKETLGTLTQLIYDTLLKLYPGKSVENFEIQRKAATVQFVGSGLSVDIVPVIEDAARPGYGWQFDIHDGTKMQTCAPCQIKFVRDRKEKDSDFRTLVRLAKKWRNRIELTQLKSFTIELIMAHVLAKKGTEGSIEKRFRDFLLYIAQSGLKEVISFPENGLVFTQFNDPVVILDPVCNSNNVASRITEDERKEIVAAALEAWETAVFASEEDDIEVWKELFGPRFKVKEEA

SEQ ID NO: 3448 - protein, 316 aa, Dyella ginsengisoli
MPLSNTEIRYYDSNVLRLPADKRKEYHEQVDRLVAALGKRLRDQTDITVTKVVKAGSFAKFTILRKTSEDPVDVDVVFYISGRNVTQETLASLSQTIYDALIKLYPNKSVEDFEIQRKAATVTFAGSGLSVDLVPVIEDAGRPGYGWQFDIHDGTRMQTCAPCQIKFVRDRKEQDSDFRTLIRLAKKWRNRIELKPLKSFAIELIMAHVLAKNGTTGSIEKRFRDFLLYIAQSGLKEVISFPESGPVTTAFTDPVVIIDPVCATNNVASRISEAERGEIVAAATEAWETAMFASTEDDLDVWKEIFGPRFAVGESA

SEQ ID NO: 3449 - protein, 318 aa, Janthinobacterium lividum
MPLSNAKLQYYDSNVLRLPADKRKEYHEQVDRLVTALGVKLKEQTDIKVTKVVKAGSFAKYTILRKTNEDPVDVDVVFYISGRNVDHETLESLMQTIYDALVKLYPNKSVEHFEIQRKAATVNFVGSGLSVDIVPVIENPWKPGYGWQYDIHDGSRVETCAPCQVKFVQTRKDTDANFRTLVRLGKRWSRHAEIKLKSFMVELVLAHLLDKNGKSGSIEQRFRDFLLYIAQSGLKEVISFPENGLGLLTPTFDDPVVILDPVNSSNNVASRLTEAERVEIVDAAQSAWETAYFASESDGEEEAWKELFGARFKVEEAA

SEQ ID NO: 3450 - protein, 316 aa, Hafnia alvei
MPLSNTELRYYDSNVLRLPSDKRTEYHAQVDRLIAELKKSVKEQDEIKITKVVKAGSFAKFTILRKTHEDPVDVDVVFYISGKDVTQETLESLSEKIFNALVKLYPNKSVEDFQLQRKAATVTFVKSGLNVDVVPVIEDTDKVGYGWQFDIHEGTKLHTCAPCQIKFIRDRKDTDNDFRTLVRLAKKWRNHAGLTHLKSFTIELILAYLLDNKGKEGSIESRFRQFLLYIAQSGLKEKIFFPENGNDIPDFSDPVVIIDPVCVTNNVASRLSEDERLEIVDAAAEAWEIAHHASVEDDLAIWKELFGPRLKVREEA

SEQ ID NO: 3451 - protein, 316 aa, Pluralibacter gergoviae
MPLSNTELRYYDSNVLRLPSDKRTEYHAQVDRLIAELKKSVKEQDEIKITKVVKAGSFAKFTILRKTHEDPVDVDVVFYISGKDVTQETLESLSEKIFNALVKLYPNKSVEDFQLQRKAATVTFVKSGLNVDVVPVIEDTDKAGYGWQFDIHEGTKLHTCAPCQIKFIRDRKDTDNDFRTLVRLAKKWRNHAGLTHLKSFTIELILAYLLDKNGKEGSIESRFRQFLLYIAQSGLKEKIFFPENGNDIPDFSDPVVIIDPVCVTNNVASRLSEDERLEIVDAAAEAWEIAHHASVEDDLAIWKELFGPRLKVREEA

SEQ ID NO: 3452 - protein, 316 aa, Unknown
  Description of Unknown: Enterobacteriaceae sequence
MPLSNTELRYYDSNVLRLPSDKRTEYHAQVDRLIAELKKSVKEQDEIKITKVVKAGSFAKFTILRKTHEDPVDVDVVFYISGKDVTQETLGSLSEKIFNALVKLYPNKSVEDFQLQRKAATVTFVKSGLNVDVVPVIEDIDKAGYGWQFDIHEGTKLHTCAPCQIKFIRDRKETDNDFRTLVRLAKKWRNHAGLTHLKSFTIELILAFLLDKNGKEGSIESRFRQFLLYIAQSGLKEKIFFPENGNDIPDFSDPVVIIDPVCVTNNVASRLSDDERIEIVEAAAEAWEIAHHASVEDDLAIWKELFGPRLKVREEA

SEQ ID NO: 3453 - protein, 316 aa, Klebsiella oxytoca
MPLSNTELRYYDSNVLRLPSDKRTEYHAQVDRLITELKKSVKEQDEIKITKVVKAGSFAKFTILRKTHEDPVDVDVVFYISGKDVTQETLGSLSEKIFNALVKLYPNKSVEDFQLQRKAATVTFVKSGLNVDVVPVIEDIDKAGYGWQFDIHEGTKLHTCAPCQIKFIRDRKETDNDFRTLVRLAKKWRNHAGLIHLKSFTIELILAFLLDKNGKEGSIESRFRQFLLYIAQSGLKEKIFFPENGNDIPDFSDPVVIIDPVCVTNNVASRLSDDERIEIVDAAAEAWEIAHHASVEDDLAIWKELFGPRLKVREEA

SEQ ID NO: 3454 - protein, 316 aa, Serratia sp.
MPLSNTELRYYDSNVLRLPSDKRTEYHAQVDRLITELKKSVKEQDEIKITKVVKAGSFAKFTILRKTHEDPVDVDVVFYISGKDVTQETLASLSEKIFNALVKLYPNKSVEDFQLQRKAATVTFVKSGLNVDVVPVIEDTDKAGYGWQFDIHEGTKLHTCAPCQIKFIRDRKDTDNDFRTLVRLAKKWRNHAGLTHLKSFTIELIMAYLLDKNGKEGSIENRFRQFLLYIAQSGLKEKIFFPENGNDIPDFSDPVVIIDPVCVTNNVASRLSEDERLEIVDAAAEAWEIAHHASVENDLAIWKELFGPRLKVREEA

SEQ ID NO: 3455 - protein, 316 aa, Unknown
  Description of Unknown: Enterobacteriaceae sequence
MPLSNTELRYYDSNVLRLPSDKRTEYHAQVDRLIAELKKSVKEQDEIKITKVVKAGSFAKFTILRKTYEDPVDVDVVFYISGKDVTQETLASLSEKIFNALVKLYPNKAVEDFQLQRKAATVTFIKSGLNVDVVPVIEDADKAGYGWQFDIHEGTKLHTCAPCQINFIRDRKDTDKDFRTLVRLAKKWRNHAGLTHLKSFTIELIMAYLLDKNGKEGSIESRFRQFLLYIAQSGLKEKIFFPENGNDIPDFSDPVVIIDPVCVTNNVASRLSEDERLEIVDAAAEAWEIAHHASVENDLAIWKELFGPRLKVREEA

SEQ ID NO: 3456 - protein, 316 aa, Ewingella americana
MPLSNTELRYYDSNILRLPSDKRTEYHAQVDRLIAELKKSIKNQDEIKITKVVKAGSFAKFTILRKTHEDPVDVDVVFYISGKDVTQETLASLSEKIFNALVKLYPNKSVEDFQLQRKAATVTFVKSGLNVDVVPVIEDTDKVGYGWQFDIHEGTKIHTCAPCQIQFIRDRKNSDNDFRTLVRLAKKWRNHAGLTHLKSFTIELIMAYLLDKNGKDGSIESRFKQFLLYIAQTGIKEKIFFTENGNDIPEFSDPVVIIDPVCVTNNVASRLSETERLEIVDAATEAWEIAHHASVEDDLAIWKELFGPRLKVREEA

SEQ ID NO: 3457 - protein, 316 aa, Buttiauxella ferragutiae
MALSNTELRYYDSNILRLPADKRTQYHAQVDRLINELKKTLHNQNEIRITKVVKAGSFAKFTILRKTHEDPVDVDVVFYISGEDVSQETLSSLNEKIFDALVELYPTKSVEDFVLQRKATTVTFVKSGINVDVVPVIEDTDKKGYGWQFDIKEGTKLHTCAPCQIQFIRDRKNVDPDFRTLVRLAKKWRNHAELSHLKSFAIELIMAHLLDTRGKSGNIESRFRAFLLYIAHAGLKEVISFKENEGHIPNFNDPIVIIDPVCNTNNVASRITEAERVEIVEAALLAWETAHLASVEDDLAIWKELFGSRLKVREDA

SEQ ID NO: 3458 - protein, 314 aa, Pseudomonas nitroreducens
MPLTNTQIKYYDSNVLRLPKDKRETYNAQVDRLIAALKDSLKKQDKITIKKVVKAGSFAKHTILRPNAQNPADVDVVFYISGQNVDEETFATLSQKIYDALINLYPNKSVEDFEIQRKAAKVTFVGTGLEVDIVPVIENPNKENYGWQFDRIDGSKTETCAPCQVNFVKVRKDEDPDFRTLVRLAKRWRTWKEVPLKSFHIELIMAHVLEVNGKAGSLEKRFRDFLLYIVQSGLKEVIKFPENGWVRQFPDTVVIIDPVCDTNNVASRITEDERKEIVQLAEESWETAHFASIEDDFEVWKELFGKGFKVEDAA

SEQ ID NO: 3459 - protein, 314 aa, Unknown
  Description of Unknown: Pseudomonas putida group sequence
MPLTNTQIKYYDSNVLRLPKEKRETYNAQVDRLIAALKDSLKKQDKITIKKVVKAGSFAKHTILRPNAQNPADVDVVFYISGQKVDEETFATLSQKIYDALVNLYPNKSVEDFEIQRKAAKVTFVGTGLEVDIVPVIENPNKENYGWQFDRIDGSKTETCAPCQVNFVKVRKDEDPDFRTLVRLAKRWRTWKEVPLKSFHIELIMAHVLEVNGKAGSLEKRFRDFLLYIVQSGLKEVIKFPENGWVSQFQDAVVIIDPVSDTNNVASRITEDERKEIVQLAEESWETAHFASMEDDFEVWKELFGKGFKVEDAA

SEQ ID NO: 3460 - protein, 314 aa, Pseudomonas japonica
MPLTNTQIKYYDSNVLRLPKEKRETYNAQVDRLIAALKDSLKKQDKITIKKVVKAGSFAKHTILRPNAQNPADVDVVFYISGQKVDEETFATLSQKIYDALVNLYPNKSVEDFEIQRKAAKVTFVGTGLEVDIVPVIENPNKDGYGWQFDRIDGSKTETCAPCQVKFVKDRKDEDPDFRILVRLAKRWRTWKEVPLKSFHVELIMAHVLEVNGKAGSLEKRFRDFLLYIVQSGLKEVIKFPENGWVPQFRDTVVIIDPVCDTNNVASRITEDERKEIVQLAEESWETANFASMEDDFEVWKELFGKGFKVEDAA

SEQ ID NO: 3461 - protein, 314 aa, Pseudomonas sp.
MPLTNTQIKYYDSNVLRLPKDKRETYNAQVDRLIAALKDSLKKQDKITIKKVVKAGSFAKHTILRPNAQNPADVDVVFYISGQKVDEETFATLSQKIYDALVNLYPNKSVEDFEIQRKAAKVTFVGTGLEVDIVPVIENPNKDGYGWQFDRIDGSKTETCAPCQVNFVKVRKDEDPDFRTLVRLAKRWRTWKEVPLKSFHIELIMAHVLEVNGKAGSLEKRFRDFLLYIVQSGLKEVIKFPENGWVPQFKDTVVIIDPVCDTNNVASRITEDERKEIVQLAEESWETANFASMEDDFEVWKELFGKGFKVEDAA

SEQ ID NO: 3462 - protein, 314 aa, Pseudomonas sp.
MPLTNTQIKYYDSNVLRLPKDKRETYNAQVDRLIAALKDSLKKQDKITIKKVVKAGSFAKHTILRPNAQNPADVDVVFYISGQKVDEETFATLSQKIYDALVSLYPNKSVEDFEIQRKAAKVTFVGTGLEVDIVPVIENPNKEGYGWQFDRIDGSKTETCAPCQVNFVKARKDDDPDFRTLVRLAKRWRTWKEVPLKSFHIELIMAHVLEVNGKTGSLEKRFRDFLLYIVQSGLKEVIKFPENGWVPQFKDTVVIIDPVCDTNNVASRITEDERKEIVQLAEESWETAHFASIEDDFEVWKELFGKGFKVEDAA

SEQ ID NO: 3463 - protein, 314 aa, Pseudomonas borbori
MPLTNTQIKYYDSNVLRLPKDKRETYNAQVDRLIAALKDSLKKQDKITIKKVVKAGSFAKHTILRPNAQNPADVDVVFYISGQKVDEETFATLSQKIYDALINLYPNKSVEDFEIQRKAAKVTFVGTGLEVDIVPVIENPNKENYGWQFDRIDGSKTETCAPCQVNFVKVRKDEDPDFRTLVRLAKRWRTWKEVPLKSFHIELIMAHVLELKGKTGSLEKRFRDFLLYIADSGLKDVIKFPENKQVPDFSDTVVIIDPVCDTNNVASRITEEERQEIVQLAEESWETAHFASVEDDFEIWKELFGKGFKVEDAA

SEQ ID NO: 3464 - protein, 314 aa, Unknown
  Description of Unknown: Pseudomonas sequence
MPLTNTQIKYYDSNVLRLPKDKRETYNAQVDRLIAALKDSLKKQDKITIKKVVKAGSFAKHTILRPNAQNPADVDVVFYISGEKVDEETFATLSQKIYDALIKLYPNKSVEDFEIQRKAAKVTFVGTGLEVDIVPVIENPSKENYGWQFDRIDGSKTETCAPCQVKFVKDRKDVDPDFRTLVRLAKRWRTWKEVPLKSFHIELIMAHVLELKGKTGSLEKRFRDFLLYIAESGLKEVIKFPENGNVPEFSDTVVIIDPVCDTNNVASRITEDERKEIVQLADESWETAHFASVEDDFEIWKELFGKGFKVEDAA

SEQ ID NO: 3465 - protein, 314 aa, Pseudomonas aeruginosa
MPLTNTQIKYYDSNVLRLPKDKRETYNAQVDRLIAALKDSLKKQDKITIKKVVKAGSFAKHTILRPNAQNPADVDVVFYISGEKVDEETFATLSQKIYDALIKLYPNKSVEDFEIQRKAAKVTFVGTGLEVDIVPVIENPSKENYGWQFDRIDGSKTETCAPCQVKFVKDRKDVDPDFRILVRLAKRWRTWKEVPLKSFHIELIMAHVLELKGKTGSLEKRFRDFLLYIAESGLKEVIKFPENGNVPEFSDTVVIIDPVCDTNNVASRITEDERKEIVQLADESWETAHFASVEDDFEIWKELFGKGFKVEDAA

SEQ ID NO: 3466 - protein, 314 aa, Unknown
  Description of Unknown: Pseudomonas sequence
MPLTNTQIKYYDSNVLRLPKDKRETYNAQVDRLIAALKDSLKKQDKITIKKVVKAGSFAKHTILRPNAQNPADVDVVFYISGEKVDEETFATLSQKIYDALIKLYPNKSVEDFEIQRKAAKVTFVGTGLEVDIVPVIENPSKENYGWQFDRIDGSKTETCAPCQVKFVKDRKDVDPDFRTLVRLAKRWRTWKEVPLKSFHIELIMAHVLELKGKTGSLEKRFRDFLLYIAESGLKEVIKFPENGNVPEFSDTVVIIDPVCDTNNVASRITEDERKEIVQLADESWETAHFASVEDDFDIWKELFGKGFKVEDAA

SEQ ID NO: 3467 - protein, 314 aa, Unknown
  Description of Unknown: Pseudomonas sequence
MPLTNTQIKYYDSNVLRLPKDKRETYNAQVDRLIAALKDSLKKQDKIIIKKVVKAGSFAKHTILRPNAQNPADVDVVFYISGQKVDEETFATLSQKIYDALIKLYPNKSVEDFEIQRKAAKVTFVGTGLEVDIVPVIENPNKENYGWQFDRIDGSKTETCAPCQVNFVKVRKNEDPDFRTLVRLAKRWRTWKEVPLKSFHIELIMAHVLEIKGKTGLLEKRFRDFLLYIAESGLKDVIKFPENGNVPEFSDTVVIIDPVCDTNNVASRITEDERKEIVQLADESWETAHFASVEDDFEIWKELFGKGFKVEDAA

SEQ ID NO: 3468 - protein, 315 aa, Pseudomonas aeruginosa
MFPLSRHDPKYYDSNVLRLPKDKRETYNAQVDRLIAALKDSLKKQDKITIKKVVKAGSFAKHTILRPNAQNPADVDVVFYISGEKVDEETFATLSQKIYDALIKLYPNKSVEDFEIQRKAAKVTFVGTGLEVDIVPVIENPSKENYGWQFDRIDGSKTETCAPCQVKFVKDRKDVDPDFRTLVRLAKRWRTWKEVPLKSFHIELIMAHVLELKGKTGSLEKRFRDFLLYIAESGLKEVIKFPENGNVPEFSDTVVIIDPVCDTNNVASRITEDERKEIVQLADESWETAHFASVEDDFEIWKELFGKGFKVEDAA

SEQ ID NO: 3469 - protein, 314 aa, Unknown
  Description of Unknown: Pseudomonas sequence
MPLTNTQIKYYDSNVLRLPKDKRETYNAQVDRLIAALKDSLKKQDKITIKKVVKAGSFAKHTILRPNAQNPADVDVVFYISGPKVDEETFATLSQKIYDALVKLYPNKSVEDFEIQRKAAKVTFVGTGLEVDIVPVIENPNKEGYGWQFDRIDGSKTETCAPCQVKFVKDRKDEDPDFRTLVRMAKRWRTWKEVPLKSFQIELIMAHVLEVNVKEGSLEKRFRDFLLYIAESGLKEVIKFPENGNVPEFSDTVVIIDPVCDTNNVASRITADECKEIVQLAEESWETAHFASVEDDFEIWKELFGKGFKVEDAA

SEQ ID NO: 3470 - protein, 314 aa, Pseudomonas aestusnigri
MPLTNTQIKYYDSNVLRLPKDKRETYNAQVDRLIAALKDSLKKQDKITIKKVVKAGSFAKHTILRPNAQNPADIDVVFYISGQKVDEETFATLSQKIYDALVKLYPNKSVEDFEIQRKAAKVTFVGTGLEVDIVPVIENPNKEGYGWQFDRIDGSKTETCAPCQVKFMKDRKDEDPDFRTLVRMAKRWRTWKEVPLKSFHIELIMAHVLEVNGKEGSLEKRFRDFLLYIAESGLKEVIKFPENGNVPEFSDTVVIIDPVCDTNNVASRITADECKEIVQLAEESWETAHFASVEDDFNLWKELFGKGFKVEDAA

SEQ ID NO: 3471 - protein, 314 aa, Pseudomonas amygdali
MPLTNNQIKYYDSNVLRLPKDKRETYNAQVDRLIAALKDSLKKQDKIIIKKVVKAGSFAKHTILRPNSQFPADVDVVFYISGQKVDEETFATLSQKIYDALIKLYPNKSVEDFEIQRKAAKVTFVGTGLEVDIVPVIENPNKEGYGWQFDRVDGTKTETCAPCQVKFVKDRKDQDPDFRTLVRMAKQWRSWKGVPLKSFHIELIMAHVLEVNGKAGLLEKRFRDFLLYIAESGLKEVIKFPENGWVSQFSEPVVIIDPVCDTNNVASRITEEERKEIVQIAQESWETAHFASIEDDLEVWKELFGKGFKVEGAA

SEQ ID NO: 3472 - protein, 314 aa, Pseudomonas fragi
MPLTNTQIKYYDSNVLRLPKDKRETYNAQVDRLIAALKDSLKKQDKIIIKKVVKAGSFAKHTILRPNSQFPADVDVVFYISGQKVDEETFATLSQKIYDALIKLYPNKSVEDFEIQRKAAKVTFVGTGLEVDIVPVIENPNKEGYGWQFDRIDGTKTETCAPCQVKFVKDRKDQDPDFRTLVRMAKQWRSWKGVPLKSFHIELIMAHVLEVNGKAGLLEKRFRDFLLYIAESGLKEVIKFPENGWVSQFSEPVVIIDPVCDTNNVASRITEEERKEIVQIAQESWETAHFASIEDDLEVWKELFGKGFKVEGAA

SEQ ID NO: 3473 - protein, 314 aa, Pseudomonas syringae
MPLTNTQIKYYDSNVLRLPKDKRETYNAQVDRLIAALKDSLKKQDKIIIKKVVKAGSFAKHTILRPNSQFPADVDVVFYISGQKVDEETFGTLSQKIYDALIKLYPNKSVEDFEIQRKAAKVTFVGTGLEVDIVPVIENPNKEGYGWQFDRIDGTKTETCAPCQVKFVKDRKDQDPDFRTLVRMAKQWRSWKGVPLKSFHIELIMAHVLEVNGKAGLLEKRFRDFLLYIAESGLKEVIKFPENGWVSQFSEPVVIIDPVCDTNNVASRITEEERKEIVQIAQGSWETAHFASIEDDLEVWKELFGKGFTVEGAA

SEQ ID NO: 3474 - protein, 314 aa, Pseudomonas stutzeri
MPLTNTQIKYYDSNVLRLSKDKRETYNAQVDRLIAALKDSLKKQDKITIKKVVKAGSFAKHTILRPSAQNPADVDVVFYISGQKVDEETFATLSQKIYDALIKLYPNKSVEDFEIQRKAAKVTFVGTGLEVDIVPVIENPNKENYGWQFDRIDGSKTETCAPCQVNFVKVRKDEDPDFRTLVRLAKRWRTWKEVPLKSFHIELIMAHVLELKGKTGSLEKRFRDFLLYIADSGLKDVIKFPENKQVPDFSDTVVIIDPVCDTNNVASRISEEERQEIVQLAEESWETAHFASVEDDFEIWKELFGKGFKVEDAA

SEQ ID NO: 3475 - protein, 314 aa, Escherichia coli
MPLTNTQIRYYDSNVLRLPKDKRETYNAQVDRLITALRKKLKDQDKITIKRVVKAGSFAKHTILRKTSDSQVDVDVVFYVSGEKVAEETFASLSEKIYEALLKMYPNKAVEDFEIQRKAATVSFVGTGLDVDIVPVIENPDKEGYGWQFDRIDGSKTETCAPCQIKFVKDRKDQDPDFRTLVRLAKRWRTNMECPLKSFHIELIMAHVLEVNGKDGSLEKRFRDFLLYIAESGLKEVITFPENSTIPAFSHPVVILDPVCDTNNVTSRITEDERKEIVRIAEESWATANFASVEGDYDIWKELFGRSFKVEDTA

SEQ ID NO: 3476 - protein, 314 aa, Escherichia coli
MPLTNTQIRYYDSNVLRLPKDKRETYNAQVDRLITALRKKLKDQDKITIKRVVKAGSFAKHTILRKTSDSQVDVDVVFYVSGEKVAEETFASLSEKIYEALLKMYPNKAVEDFEIQRKAATVSFVGTGLDVDIVPVIENPDKEGYGWQFDRIDGSKTETCAPCQIKFVKERKDQDPDFRTLVRLAKRWRTNMECPLKSFNIELIMAHVLEVNGKDGSLEKRFRDFLLYIAESGLKEVITFPENSTIPAFSHPVVILDPVCDTNNVTSRITEDERKEIVRIAEKSWATANFASVEGDYDIWKELFGRSFKVEDAA

SEQ ID NO: 3477 - protein, 314 aa, Unknown
  Description of Unknown: Enterobacter cloacae complex sequence
MPLTNTQVRYYDSNVLRLPKDKRETYNAQVDRLITALRKKLKDQDKITIKRVVKAGSFAKHTILRKTSDSQVDVDVVFYVSGEKVAEESFASLSEKIYEALLKMYPNKAVEDFEIQRKAATVSFVGTGLDVDIVPVIENPDKEGYGWQFDRIDGSKTETCAPCQIKFVKDRKDQDPDFRTLVRLAKRWRTNMECPLKSFHIELIMAHVLEVNGKDGSLEKRFRDFLLYIAESGLKEVITFPENSTIPAFSHPVVILDPVCDTNNVTSRITEDERKEIVRIAEESWATANFASEEGDYDIWKELFGRSFKVEDAA

SEQ ID NO: 3478 - protein, 314 aa, Budvicia aquatica
MSLTNTQIRYYDSNVLRLPKDKRETYNAQVDRLISALRKKLKEQDKITIKRVVKAGSFAKHTILRKTSDSQVDVDVVFYVSGKKVVEESFASLSEKIYEALVKVYPNKAVEDFEIQRKAATVSFVGTGLDVDIVPVIENPDKEGYGWQFDRFDGSKTETCAPCQIKFVKDRKDLDPDFRTLVRLAKRWRTNVECPLKSFHIELIMAHVLEVNGKDGSLEKRFRDFLLYIAESGLQEFITFPENSTVPAFTDPVVILDPVCDTNNVTSRITEDERKEIVRLADESWATANFASTGGDFDLWKELFGRAFKVEDAA

SEQ ID NO: 3479 - protein, 314 aa, Pseudomonas chlororaphis
MPLTNTQVRYYDSNVLRLPKDKRETYNAQVDRLIAALRDSLKKQDKISIKRVVKAGSFAKHTILRKTSEDAVDVDVVFYISGEKVDEETFSSLSQKIYEALIKLYPNKAVEDFEIQRKAATVTFVGTGLDVDIVPVIENPNKEGYGWQFDRIDGSKTETCAPCQVKFVKDRKDQDPDFRTLVRLAKRWRTKAECPLKSFHIELIMAHVLEVNGKEGSLEKRFRDFLLYIVESGLQKVIKFPENRAASDFTDPVVILDPVCDTNNVASRITEDERKEIVRIAEASWETANFASVEGDFEIWKELFGRAFKVEDAA

SEQ ID NO: 3480 - protein, 314 aa, Pseudomonas sp.
MPLTNTQVRYYDSNVLRLPKDKRETYNAQVDRLIAALRDSLKKQDKISIKRVVKAGSFAKHTILRKTSEDAVDVDVVFYISGEKVDEETFSSLSQKIYEALIKLYPNKAVEDFEIQRKAATVTFVGTGLDVDIVPVIENPNKEGYGWQFDRIDGSKTETCAPCQVKFVKDRKDQDPDFRTLVRLAKRWRTKAECPLKSFHIELIMAHVLEVNGKEGSLEKRFRDFLLYIAESGLQQVIKFPENRAASDFTDPVVILDPVCDTNNVASRITEDERKEIVRIAEASWETANFASVEGDFEVWKELFGRAFKVEDAA

SEQ ID NO: 3481 - protein, 314 aa, Pseudomonas sp.
MPLTNTQVRYYDSNVLRLPKDKRETYNAQVDRLIAALRDSLKKQDKISIKRVVKAGSFAKHTILRKTSEDAVDVDVVFYISGEKVDEETFSSLSQKIYEALIKLYPNKAVEDFEIQRKAATVTFVGTGLDVDIVPVIENPNKEGYGWQFDRIDGSKTETCAPCQVKFVKDRKDQDPDFRTLVRLAKRWRTKAECPLKSFHIELIMAHVLEVNGKEGSLEKRFRAFLLYIAESGLQQVIKFPENRAASDFTDPVVILDPVCDTNNVASRITEDERKEIVRIAEASWETANFASVEGDFEVWKELFGRAFKVEDAA

SEQ ID NO: 3482 - protein, 314 aa, Pseudomonas chlororaphis
MPLTNTQVRYYDSNVLRLPKDKRETYNAQVDRLIAALRDSLKEQDKITIKRVVKAGSFAKHTILRKTSEDAVDVDVVFYISGEKVDEETFSSLSQKIYEALIKLYPNKAVEDFEIQRKAATVTFVGTGLDVDIVPVIENPNKEGYGWQFDRVDGSKTETCAPCQVKFVKDRKDQDPDFRTLVRLAKRWRTKAECPLKSFHIELIMAHVLEVNGKEGSLEKRFRDFLLYIVESGLQDVIKFPENRTISEFTDPVVILDPVCDTNNVASRITEAEREEIVRIADASWETANFASVEGDFEIWKELFGRSFKVEDAA

SEQ ID NO: 3483 - protein, 314 aa, Pseudomonas sp.
MPLTNTQVRYYDSNVLRLPKDKRETYNAQVDRLIAALRDSLKKQDKIIIKRVVKAGSFAKHTILRKTSEDAVDVDVVFYISGEKVDEETFSSLSQKIYEALIKLYPNKAVEDFEIQRKAATVTFVGTGLDVDIVPVIENPNKEGYGWQFDRVDGSKTETCAPCQVKFVKDRKDQDPDFRTLVRLAKRWRTKAECPLKSFHIELIMAHVLEVNGKEGSLEKRFRDFLLYIVESGLQDVIKFPENRTISEFTDPVVILDPVCDTNNVASRITEAEREEIVRIADASWETANFASVEGDFEIWKELFGRSFKVEDAA

SEQ ID NO: 3484 - protein, 314 aa, Pseudomonas sp.
MPLTNTQVRYYDSNVLRLPKDKRETYNAQVNRLIAALREKLKEQDKISIKRVVKAGSFAKHTILRKTSEDSVDVDVVFYISGKKVDEESFSSLSEKIHEALIKLYPTKAVEDFKIQRKAATVTFVGTGLDVDIVPVIENPDKPNYGWQFDRFDGSKTETCAPCQVNFVKDRKNIDPDFRTLVRLAKRWRTKVECPLKSFHIELIMAHVLEVNGKEGSLEKRFRDFLLYIVESGLKEVITFAENGKVSAFTDPVVILDPVCDTNNVASRITEDERKEIVRLAEESWETAHFASVEDDFEIWKELFGRSFKVEDAA

SEQ ID NO: 3485 - protein, 314 aa, Acetobacter aceti
MPLTNTQIKYYDSNVLRLPRDKRQTYNAQVDRLIAALRESLKKQENIIIKRVVKAGSFAKHTILRKTSEDAIDVDVVFYITGQKVDEETFSSLSDKIYETLVKLYPQKSVEDFVIQRKAATVSFVGTGLDVDIVPVIENPDKEGYGWQFDRVDGSKTETCAPCQVRFVKDRKDQDPDFRTLVRLAKRWRTKMECPLKSFHIELILAHVLAVNGREGSLEKRFCDFLLYIAHSELKELIKFPENGTVPKFYDPVIILDPVCDRNNVASCITEDERKEIVRIADHSWETAHFASEEDDSDLWKELFGRGFKVEELA

SEQ ID NO: 3486 - protein, 315 aa, Marinomonas sp.
MPLSNTQIRYYDSKVLRLPKEKREAYNAQVDRLISALRKTLKEQDKITIKRVVKAGSFAKHTILRKTSDSPVDVDVVFYISGKKVAEESYDSLSQKIHDALLTLYPNKAVEDFKIQRKAATVTFVGSGLDVDIVPVIENPDKEGYGWQFDRFDRSKTETCAPCQIKFVKDRKDEDPDFRTLVRLAKRWRNNMECPLKSFHIELIMAHVLEVNGKEGTLEKRFMDFLLYIAESELLEVISFPENRIVPSFNDLVVILDPVCDTNNVASRITEDERKEIVRLADESWATANFASVEGDYDLWKELFGRLFKVEDAAS

SEQ ID NO: 3487 - protein, 316 aa, Stenotrophomonas maltophilia
MPLSNTQLLYYDSTVLRLTAEKRTEYHKQVDRLVAALSERVHEQTEVKITRVVKAGSFAKYTILRKSAMDPVDVDVVFYISGRSVDEETLSSLSELIYKALIELYPNKSVEDFTIHRKAATVEFIGSGLSVDIVPVIEDPTRDGYGWQFDIHDGSKVQTCAPGQIKFVKVRKEEDKHFRTLVRLAKKWRNQAELKPLKSFAIELIMAHVLATQGKEGSIEQRFRNFLLYIAQSGLKEVIFFPENGGIVPAFTHPVVILDPVSSDNNVAGRISEAERKEICKAAEDAWEIANHASTDGDMDIWKELFGPRFKVEDEV

SEQ ID NO: 3488 - protein, 316 aa, Bradyrhizobium sp.
MPLNNTELLYYDANILRLPADKRKEYHAQVDRLIAELSRSIRDKTTIKITKVVKAGSFAKFTILRKTSTDPVDVDVVFYISGKSVDTETLQTLNDTIYKLLIEIYPNKDVEDFEIQRKAATVSFVSSGLSVDVVPVIEDPNKPGYGWQFDLQDGSAMETCAPCQIQFVRDRKNEDGDFRTLVRLAKKWRNHAELKALKSFIIELIMAYILDKEGKSGSIERRFRRFLLYIAQSGLKDTISFPENAAPLGMFSDPVVIIDPVNSKNNVASRITEAERAAIVAAAEAAWEAAHFASAEDDNDVWKELFGPRFRVEEDA

SEQ ID NO: 3489 - protein, 316 aa, Bradyrhizobium sp.; identical to SEQ ID NO: 3488

SEQ ID NO: 3490 - protein, 316 aa, Hyphomicrobium zavarzinii
MPLTNSEIRFYDSNVLRLPADKRKEYHAQVDRLITELSRSIRNQTEIQITKVVKAGSFAKFTILRKTSTDPVDVDVVFYISGKNIDRDTLESLNNTIHALLLKVYPNKHVEDFEIQRKAATASFVGSGLSVDIVPVIEDPSRPGYGWQFDIKDGTALQTCAPCQIKFVQVRKDNDADFRTLVRLAKRWRNFSELSALKSFTIELIMAYLLDRDGANGTIEEKFRKFLLYIAQSGLKELIAFPENARPLGQFSNPVVIIDPVYSHNNVAARITEQERQEIVSAAQASWEAAHFASAENDNEVWKEIFGPRFRIEDQA

SEQ ID NO: 3491 - protein, 314 aa, Proteobacteria bacterium
MGLSNTQLRYYDSNVLRLPGDKRKEYHAQVDRLITELCKSVRDKTEIKITKVVKAGSFAKFTILRRTALDPVDVDVVFYISGRDATKETLDSLSATIYDLLVKTYPNKSVEDFEIQRKAATVKFVGSGLSVDIVPVVEDAGRPGFGWQYDIHDGSKIQTCAPCQIQFVRDRKNQDGDFRTLVRMAKKWRNYAEIKPLKSFAIELIMAHVLATQGKAGGIEQRFRDFLLYIAQSGLKEEIRFPENTAPFGSFSDPVVILDPVYSLNNVASRISEAERKEIVAAAQEAWEAANFASVEDDNGVWKELFGPGFKVED

SEQ ID NO: 3492 - protein, 314 aa, Unknown
  Description of Unknown: Proteobacteria sequence
MGLSNTQLRYYDSNVLRLPGDKRKEYHAQVDRLITELCKSVRDKTEIKITKVVKAGSFAKFTILRRTASDPVDVDVVFYISGRDATKETLDSLSATIYDLLVKTYPNKSVEDFEIQRKAATVKFVGSGLSVDIVPVVEDAGRPGFGWQYDIHDGSKIQTCAPCQIQFVRDRKNQDGDFRTLVRMAKKWRNYAEVKPLKSFAIELIMAHVLATQGKSGSIEQRFRDFLLYIAQSGLKEEIRFPENTAPFGYFSDPVVILDPVYSLNNVASRISEAERKEIVAAAQEAWEAANFASVEDDNGVWKELFGPGFKVED

SEQ ID NO: 3493 - protein, 314 aa, Sphingobium baderi
MSLSNAQLRYYDSNVLRLPAEKRKEYHAQVDRLITELCKSVRDKTEIKITKVVKAGSFAKFTILRRTASDPVDVDVVFYISDRDATKETLDSLSATIYDLLVKIYPTKSVEDFEIQRKAATVKFVGSGLSVDIVPVIEDASRPSYGWQYDIHDGSKIQTCAPCQIQFVRDRKNQDGDFRTLVRMAKKWRNYAELKPLKSFAIELIMAHVLATQGKAGGIEQRFLNFLLYIAQSGLKEEIRFPENTSPFGSFFDPVVILDPVYSLNNVASRISEAERKEITAAAQEAWETANFASVEDDNGVWKELFGPGFKVED

SEQ ID NO: 3494 - protein, 314 aa, Sphingobium faniae
MDLSNTQLRYYDSNVLRLPADKRKEYHAQVDRLITELCKSVRDKTEIKITKVVKAGSFAKYTILRRTASDPVDVDVVFYISDRDATKETLDSLSATIYDLLVKIYPTKSVEDFEIQRKAATVTFVGSGLSVDIVPVIEDAARSGYGWQYDIHDGSKIQTCAPCQIQFVRDRKNQDGDFRTLVRMAKKWRNYAELKPLKSFGIELIMAHVLATQGKAGSIEQRFRHFLLYIAQSGLKDEIRFPENTAPFGSFSDPVVILDPVYSLNNVASRISEAERKEIVAAAQEAWETANFASVENDNGVWKELFGPGFKVED

SEQ ID NO: 3495 - protein, 314 aa, Sphingobium chungbukense
MALSNTQLRYYDSNVLRLPADKRKEYHAQVDRLITELCKSVRDKTEIKITKVVKAGSFAKYTILRKTVSDPVDVDVVFYIAGRDVTKETLDSLSATIYDLLIKIYPTKSVEDFEIQRKAATVKFVGSGLSVDIVPVIEDAARPGYGWQYDIHDGSKIQTCAPCQIQFVRDRKNQDGDFRTLVRMAKKWRNYAEVKPLKSFAIELIMAHVLATQGKAGSIEQRFRNFLLYIAQSGLKEQISFPENTAPFGSFSDPVVILDPVYSLNNVTSRISETERKEIVTAAQDAWETANFASVENDNGVWKELFGPGLKVED

SEQ ID NO: 3496 - protein, 314 aa, Sphingomonas haloaromaticamans
MALSNTELRYYDSNVLRLPADKRKDYHAQVDRLITELCKSVRDKTEIKITKVVKAGSFAKYTILRKTVSDPVDVDVVFYISDRDATKETLDSLSATIYDLLIKIYPTKSVEDFEIQRKAATVKFVGSGLSVDIVPVIEDAARAGYGWQYDIHDGTKIQTCAPCQIQFVRDRKNQDGDFRTLVRMAKKWRNYAEIKPLKSFAIELIMAHILATQGKAGSIEQRFRNFLLYIAQSGLKDQISFPENTAPFGSFSDPVVILDPVYSLNNVTSRISEAERKEIVAAAQEAWETANFASAENDNGVWKELFGPGFKVED

SEQ ID NO: 3497 - protein, 314 aa, Rhizobium sp.
MALSNTEFRYYDSNILRLPTDKRTEYHAQVDRLIDELRKSVRDKTEIKITKVVKAGSFAKFTILRKTAYDPVDVDVVFYISGKDVTKETLDSLSQTIYELLIKIYPTKSVEDFEIQRKAATVTFVGTGLSVDIVPVIEDEGRPGYGWQFDIHDGSKMQTCAPCQIQFVRNRKNQDSDFRTLVRMAKKWRNYAEIKPLKSFAIELIMAHVLAAQGKEGSIEQRFRNFLLYIAQSGLKDKISFPENTLPLGSFSDPVVIIDPVYSLNNVTSRISEAERKEIVAAAQEAWETANFASVENDNSVWKEIFGPGFKVEE

SEQ ID NO: 3498 - protein, 314 aa, Unknown
  Description of Unknown: Rhizobium sequence
MALSNTEIRYYDSNVLRLPADKRKEYHAQVDRLIEELRKSVRDKTEIKITKVVKAGSFAKFTILRKTTYDPVDVDVVFYISGKDVTKETLDSLSQTIYDLLIKIYPTKSVEDFEIQRKAATVTFVGTGLSVDIVPVIEDETRPGYGWQFDIHDGSRMQTCAPCQIQFVRDRKNQDSDFRTLVRLAKKWRNYAEIKPLKSFAIELIMAHVLQTQGSQGSIEQRFRNFLLYVAQSGLKEKISFLENTQPHGSFSDPVVILDPVYSFNNVASRISEQERKDIVAAAQEAWETANFASVEDDNAVWKEIFGPGFKVED

SEQ ID NO: 3499 - protein, 314 aa, Acidomonas methanolica
MALTNTELRNYDSNVLRLPADKRKEYHAQVDRLIDVLRKSVKDKTEIKITKVVKAGSFAKFTILRKTTYDPVDVDVVFYISGRDASKETLDSLSATIYDLLIKIYPNKSVEDFEIQRKAATVTFVGTGLSVDIVPVIEDENRPGYGWQFDIHDGSKIQTCAPCQIQFVRDRKNHDGDFRTLVRMAKKWRNYAEIKPLKSFAIELIMAHVLAIQGKDGSIEQRFRNFLLYIAQSGLKEQISFPENTLPLGTFSDPVVIFDPVYSLNNVTSRISEAERQEIVAAAQEAWETVNFASVEDDDAVWKEVFGPGFKVED

SEQ ID NO: 3500 - protein, 314 aa, Tanticharoenia sakaeratensis
MALTNTELRYYDSNVLRLPADKRKEYHAQVDRLIEELRKSVKGKTEIKITKVVKAGSFAKFTILRKTTYDPVDVDVVFYISGRDASKETLDSLSATIYELLIKIYPNKSVEDFEIQRKAATVTFVGTGLSVDIVPVIEDESRPGYGWQFDIHDGSKIQTCAPCQIQFVRDRKNQDGDFRTLVRMAKKWRNYAEIKPLKSFAIELIMAHVLATQGKEGSIEQRFRNFLLYIAQSGLKDQISFPENTLPLGSFSDPVVILDPVYSFNNVTSRISEAERQEIVTAAQEAWETVNFASVEDDDAVWKEVFGPGFKVED

SEQ ID NO: 3501 - protein, 314 aa, Aeromonas hydrophila
MAITNTEFRYYDNNVLRLQAEKRKEYHAQVDRLIEELRKSVKDKTEIKITKVVKAGSFAKFTILRKTTYDPVDVDVVFYISGRDVSKETLDSLNTTIYDLLVKIYPNKSVEDFELQRKAATVTFVGTGLSVDIVPVIEDESRPGYGWQFDIHDGSKIQTCAPCQIQFVRDRKKQDNDFRTLVRMAKKWRNYAEIKPLKSFAIELIMAHLLATQGKDGSIEQRFRNFLLYIAQSGLKEHISFPENTLPLGTFSDPVVIFDPVYSLNNVTSRISEDERLEIVAAALDAWETVNFASVTDDVTVWKEVFGPGFKVED

SEQ ID NO: 3502 - protein, 313 aa, Oligotropha carboxidovorans
MLNNTQLRYYDSNVLRLPADKRKEYHEQVDRLIDELRKTVRDKTEIKITKVVKAGSFAKYTILRKTAVDPVDVDVVFYISGRDASKETLDSLNDTIYALLIKQYPNKSVEDFEIQRKAATVTFVGTGLSVDIVPVIEDENRAGYGWQFDIHDGTKTQTCAPCQIKFVRDRKDQDADFRTLVRMAKKWRNQAELKPLKSFAIELIMAHVLAKQGNGGSIEQRFRNFLLYVAQSQLKEEIKFPENVAPFTTFSDPVVILDPVYSLNNVTSRISEEERKEIAAAAQEAWETANFASAENDNEVWKEIFGPRFKTED

SEQ ID NO: 3503 - protein, 313 aa, Bradyrhizobium yuanmingense
MLNNTQLRYYDSNVLRLPADKRKEYHEQVDRLIDELRKTVRDKTEIKITKVVKAGSFAKYTILRKTAVDPVDVDVVFYISGRDASKETLDSLNDTIYALLIKQYPNKSVEDFEIQRKAATVTFVGTGLSVDIVPVIEDENRAGYGWQFDIHDGTKTQTCAPCQIKFVRDRKGQDADFRTLVRMAKKWRNQAELKPLKSFAIELIMAHVLAKQGNGGSIEQRFRNFLLYVAQSQLKEEIKFPENVAPFTTFSDPVVILDPVYSLNNVTSRISEDERKQIVAAAQEAWETANFASAENDNEVWKEIFGPRFKTED

SEQ ID NO: 3504 - protein, 314 aa, Methyloceanibacter stevinii
MALSNTELRNYDSDVLRLPAEKRKEYHEQVDRLIEELRKSVRDKTEIKITKVTKAGSFAKYTILRKTNVDPIDVDVVFYISGRDASQETLASLNDTIYDLLIRLYPNKSIEDFEIQRKAAKVTFVGTGLSVDIVPVIEDEGRPGYGWQFDIHDGSKIQTCAPCQIKFVRDRKDQDSDFRTLVRMAKKWRNHAEVRPLKSFAIELIMAHLLATQGNTGTVEQRFRNFLLYIAQSGLKEPISFPENTAPFGTFSDPVVILDPICSLNNVTSRVSEDERKEIVAAAEAAWETANFASAEDDNEVWKEIFGPRFKTED

SEQ ID NO: 3505 - protein, 316 aa, Bradyrhizobium elkanii
MALSNTELRYYDSNVLRLPDDKRKEYHEQVDRLIAELCKTVRDKTEIKITKVVKAGSFAKYTILRKTSVDPVDVDVVFYISGRDAEKETLDSLNNTIYDLLIEQYPNKSVEDFEIQRRAATVTFVGTGLSVDIVPVIQDENRPDYGWQFDIHDGSKIQTCAPCQIEFVRDRKNQDSDFRTLVRLAKKWRNHAEIKPLKSFAIELIMAHMLATQGNFGSIEQRFRNFLLYIAQSDLKEQISFPENTAPFGTFTDPVVILDPVYSLNNVTSRISEAERKEVVAAAEAAWETANFASAENDNEVWKEIFGPRFKTEGLR

SEQ ID NO: 3506 - protein, 314 aa, Mesorhizobium loti
MGLSNTELRYYDSNVLRLPADKRKEYHEQVDRLIDELRKSVKDKTEIKITKVVKAGSFAKYTILRKTSVDPVDVDVVFYISGRDASQETLDSLNDTIYQLLIKVYPTKSVEDFEIQRKAATVTFVGTGLSVDIVPVIEDESRPGYGWQFDIHDGSKLQTCAPCQIKFVRDRKDQDGDFRTLVRLAKKWRNQAELKPLKSFAIELIMAHVLETQGNGGSIEQRFRNFLLYIAQSGLKDQIRFPENTAPFGTFCDPVVILDPVYSLNNVTSRISEAERTEIVAAAEAAWEAANFASAENDNEVWKELFGPRFKTGD

SEQ ID NO: 3507 - protein, 314 aa, Caulobacter sp.
MALSNTELRYYDGNVLRLPADKRKEYHAQVDRLITELCKRVRDKTEIKITKVVKAGSFAKYTILRKTAVDPVDVDVVFYISGRDINHETLKSINDQIYDLLIKIYPTKSVEDFEIQRKAATVTFVGSGLSVDIVPVIEDPNQAGYGWQFDIHDGSKVQTCAPCQIKFVRDRKDQDKDFRTLVRMAKKWRNHAGIKPLKSFVIELIMAHVLAEQGADGSIEQRFRNFLLYIAQSGLKDEIRFPENVAPFTVFTDPVVILDPVYSRNNVASRISESERLEIVAAATEAWETANFASADNDNDVWKEIFGPRFKTEE

SEQ ID NO: 3508 - protein, 316 aa, Sphingomonadaceae bacterium
MALSNTQLRYYDSEVLRLPAEKRKEYHAQVDRLVANLCSNVRDKTSIKITRVVKAGSFAKFTILRKTSDTRVDVDVVFYIAGEDVDAETLEDLTARIYDLLLEQYPTKSVEDFEIQRKAATVTFVGSGLMVDIVPVIEDPDRHGYGWQYDIRDGSKVETCAPCQIKFVRDRKNVDSDFRTLVRMAKKWRNWTELKPLKSFAIELIMAYLIDTRGNAGSIEQRFRDFLLYIAQSGLKEVISFPENSGVIPAFTDPVVIIDPVANDNNVASRISEAERKEIVAAAQEAWETANFASVENDPAVWKELFGPQFRTEDAK

SEQ ID NO: 3509 - protein, 315 aa, Sphingobium sp.
MPLSNTQLRYYDSNVLRLPADKRTEYHQQVDRLIENLRKNVRDKTKIKITKVVKAGSFAKYTILRKSADSPVDVDVVFYVSGKDAGSETGESLSKQIYDLLLDQYPNKSVEDFTIQRKAATVQFVKSGLNVDIVPVVQDESREDYGWQFDVQDGTKVQTCAPCQIKFVKDRKDKDSDYRTLVRLAKKWRNHTELKPLKSFAIELIMAYLLDKQGKGGSIEERFRQFLLYIAQSGLKDVISFPENSVIRPTFNDSVVILDPVCSSNNVASRITEDERKQIVAAAHDAWETVHFASTEDDVSVWKEVFGRSFKTEAS

SEQ ID NO: 3510 - protein, 315 aa, Sphingomonas sp.
MALNNTQLRYYDANVLRLPADKRKEYNALVDRLIDNLSANVRDRTEIKITRVVKAGSFAKHTILRKTTEDPVDVDVVFYISGKDASAETIEGLTADITKLLIAQYPTKSVEDFTIQSKAATVAFVGSGLSVDIVPVIEDEGKAGYGWQFDIRDGSRNHTCAPCQVDFVYKRKLADSDFRALVRLGKRWRNRAEIKPLKSFHIELIFAFLQDRDGKPTSIEQRFRDFLLYIAHSGLKERISFPENGTGIPAFTDPVVIVDPVCDSNNVASRITEAERKAIVEAASEAWEVAHFASAENDDEVWKELFGPKFRTKDQ

SEQ ID NO: 3511 - protein, 314 aa, Novosphingobium pentaromativorans
MALSNTALRYYDSNVLRLPADKRKEYHEQVDRLVTELCKSLRNRTEVKITKVVKAGSFAKYTILRKTSVDPVDVDVVVYIADRDADHETLQSLNDTIYELLIKQYPTKSVEDFEIQRKAATVTFAGTGLSVDIVPVIEDPDRPGYGWQFDLQTGDPVETCAPGQIKFVRDRKDVDGDFRTLVRMAKKWRNHHSITKLKSFTIELIMAHVLDTQGTGGSIEQRFRNFLLYIAQSGLLDEISFPENTLPLGEFNDAVVILDPVSSQNNVASRLSEQERRDIVAAANEAWETASFASAENDNEVWKEIFGPRFKTED

SEQ ID NO: 3512 - protein, 314 aa, Unknown
  Description of Unknown: Citromicrobium sequence
MALSNTALRYYDNNVLRLPADKRKEYHEQVDRLVTELCKSLRNRTEVKITKVVKAGSFAKYTILRKTSVDPVDVDVVVYIADKNADQETLQSLNDTIYELLIKQYPTKSVEDFEIQRKAATVTFAGTGLSVDIVPVIEDPERPGYGWQFDLQTGDPVETCAPGQIKFVRDRKDADGDFRTLVRMAKKWRNHHGITKLKSFTIELIMAHVLDTQGTGGSIDQRFRNFLLYVAQSGLLDEISFPENTLPLGEFNDPVVILDPVSSQNNVASRLSEQERRDIVAAANEAWETASFASAENDNEVWKEIFGPRFKTED

SEQ ID NO: 3513 - protein, 314 aa, Erythrobacter sp.
MALSNTALRYYDNNVLRLPADKRKEYHEQVDRLVTELCKSLRNRTEVKITKVVKAGSFAKYTILRKTSVDPVDVDVVVYIADKNADQETLQSLNDTIYELLIKQYPTKSVEDFEIQRKAATVTFAGTGLSVDIVPVIEDPERPGYGSQFDLQTGDPVETCAPGQIKFVRDRKDADGDFRTLVRMAKKWRNHHGITKLKSFTIELIMAHVLDKQGTGGSIDQRFRNFLLYVAQSGLLDEISFPENTLPLGEFNDPVVILDPVSSQNNVASRLSEQERRDIVAAANEAWETASFASAENDNEVWKEIFGPRFKTED

SEQ ID NO: 3514 - protein, 314 aa, Sphingopyxis sp.
MALSNTALRYYDSNVLRLPADKRKEYHEQVDRLVTELCKSLRNRTEVKITKVLKAGSFAKYTILRKTSVDPVDVDVVVYIADKDADQETLQSLNDTIYELLIKQYPTKSVEDFEIQRKAATVTFAGTGLSVDIVPVIEDPDRPGYGWQFDLQTGDPVETCAPGQIKFVRDRKDVDGDFRTLVRMAKKWRNHHGITKLKSFTIELIMAHVLDTQGTGGSIDQRFRNFLLYIAQSGLLDEISFPENTLPLGEFNDPVVILDPVSSQNNVASRLSEQERRDIVAAANEAWETASFASAENDNEVWKEIFGPRFKTED

SEQ ID NO: 3515 - protein, 316 aa, Ruegeria sp.
MPLTNTQLRYYDSNVLRLPSDKRTEYHKQVDRLIAELSKSIREKTKIKITKVVKAGSFAKFTILRKTASDPVDVDVVFYIDANSVDGETLQTLNNKIYELLIDVYPTKSVEDFEIQRKAAKVSFVGTGLDVDIVPVIADESRDGYGWQYDLQDGSKVETCAPCQIKFVRDRKDKDNDFRTLVRMAKRWRNYAEVTHLKSFHIELILAYILDQEGSEGSIEQRFRRFLLYIAQSELKEIISFPENTLPLTSFTDPVVIIDPVCSANNTASRLSESERQEIVQAADEAWEAANFASAENDNEIWKEVFGPRFKVEDAA

SEQ ID NO: 3516 - protein, 315 aa, Sphingopyxis baekryungensis
MALNDAQLRRYDSNVLRLPADTRKEYHEQVDRLIDNLCKNVRNKTEIKITKVVKAGSFAKFTILRRTSEDPVDVDVVFYIEGKDADAESLESLSSQIHDLLVDQYPNKSVEDFKIQRKAATVQFVGSGLAVDIVPVIEDDTRDGYGWQFDLSDGSKMETCAPCQIKFARDRKNADKDFRTLVRMGKRWRNRAEIKLKSFMIELIFAYLLDRDGPEGGIEQKFRDFLLYIAQSGLKETISFPENSAFFRPQFDDPVVILDPVCSSNNVASRVTEDERLEIVAAAQEAWEAAYFASTEDDDEVWKEIFGPKFNTEDA

SEQ ID NO: 3517 - protein, 315 aa, Unknown
  Description of Unknown: Citromicrobium sequence
MALNDAQLRRYDSNVLRLPADKRKEYHEQVDRLIDNLRKNVRNKTEIKITKVVKAGSFAKFTILCRTSEDPVDVDVVFYIEGKDADAESLESLSSQIHDLLVDQYPNKSVEDFKIQRKAATVQFVGSGLAVDIVPVIEDVTRDGYGWQFDLSDGSKMETCAPCQIKFVRDRKNADKDFRTLVRMGKRWRNRAEIKLKSFMIELIFAYLLDRDGPEGGIEQKFRDFLLYIAQSGLKETISFPENSAFFRPQFDDPVVILDPVCSSNNVASRVTEDERLEIVAAAQEAWEAAYFASTEDDDEVWKEIFGPKFNTEDA

SEQ ID NO: 3518 - protein, 185 aa, Stenotrophomonas maltophilia
MPLANSDLEYFDHNVLRLPGEKRKEYHAQVDNLVSELKKRITDKSKIKVTKVVKAGSFAKYTILRRVDDYPTDVDVVFYVTGVDEDGKSYESLCNKIYDLLIDIYPTKKVEDFEIQRRAAKVTFVKSGLEVDVVPVLQDSFDADHGWQFDIQSGAKNLTCAPCHIQFVKTRKDKDKHFRTLVRLA

SEQ ID NO: 3519 - protein, 315 aa, Serratia marcescens
MPLSNSELEYFDHNILRLPAEKRKEYHAQVDNLVVELKKRITDKSKIKVTKVVKAGSFAKYTILRKVDDYPTDVDVVFYLTGVDEDGKSYENICNKIYDLLIEIYPTKKVEDFEIQRRAAKVTFVKSGLEVDVVPVLQDSSNADHGWQYDIQSGAKNLTCAPCHIQFVKTRKDKDKHFRTLVRLAKRWRHFHDVPGLKSFHIELIFGYLLDRDGPADTIEKRFREFLAYIASTKLGERIDFPENSGKPVSNFDTPVIIIDPVSPENNVASRITKDEQALIAKAAESSLDTATYASVENDNEVWKEIFGGRFKTKD

SEQ ID NO: 3520 - protein, 203 aa, Pseudomonas syringae
MPLSNTELEYFDHNVLRLPAEKRKEYHAQVDNLVSELKKRITDKSELKVTKVVKAGSFAKYTILRKVDDYPTDIDVVFYITGVSEDSKSYEKLCNRIYELLLEIYPTKKVEDFEIQRRAATVVFVKSGLSVDIVPVLQDSSKPDHGWQLDIKTGEKNLTCAPCHIQFVRNRKDKDKRFRTLVRLAKRWKHFHDLPGLKSFHMS

SEQ ID NO: 3521 - protein, 315 aa, Aeromonas sp.
MPLSNTELEYFDHNVLRLSAEKRKEYHAQVDNLVSELKKRITDKSKIKVTKVVKAGSFAKYTILRKVDDYPTDVDVVFYITGVDENSESYKDLCNKIYDLLIEIYPTKKVDDFEIQRRAAKVTFVKSGLEVDVVPVLQDSSNADHGWQYDIQSGARNLTCAPCHIQFVKTRKDKDKHFRTLVRLAKRWKHFHNIPGLKSFHIELIFGHILDTDGPADNIEKRFREFLAYIASTKLSKRIDFPENSGKPIANFSDPVVIIDPVSPENNVASRITKDEQELIAKAAETALDTATYASVENDNELWKEVFGNRFKTKD

SEQ ID NO: 3522 - protein, 315 aa, Franconibacter helveticus
MSLSNTALEYFDHNVLRLPGEKRKEYHAQVDNLVSELKKRITDKSKLKVKKVVKAGSFAKYTILRKIDDYPTDVDVVFYITGVEENSKSYEVLCNRIYDLLIEIYPTKKVEDFEIQRRAAKVTFVKSGLEVDVVPVLQHSTLADHGWQYDIQSGARNLTCAPCHIQFIRTRKDKDKHFRTLVRLAKRWKHFHDIPGLKSFHIELILAHLVDTDGAAENIEKRFREFLVYIARTKLGERIDFPENEGKTSVSFSDPVVIIDPASPENNVASRITKDEQEQIAKAAEAAWEVATYASTKNDDDLWKEIFGGRFKTKD

SEQ ID NO: 3523 - protein, 315 aa, Pseudomonas syringae
MPLSNTELEYFDHNVLRLPAEKRKEYHAQVDNLVSELKKRITDKSELKVTKVVKAGSFAKYTILRKVDDYPTDIDVVFYITGVSEDSKSYEKLCNRIYELLLEIYPTKKVEDFEIQRRAATVVFVKSGLSVDIVPVLQDSSKPDHGWQLDIKTGEKNLTCAPCHIQFVRNRKDKDKRFRTLVRLAKRWKHFHDLPGLKSFHIELIMAHLVDTEGPAENIEKRFREFLLYIAQTRLKKRIDFPENNGKTEVSFSDPVVIIDPVSPENNVASRITKDEQELIGAAAEAAWEAATYASVKNSDDVWKEIFGGRFKIRD

SEQ ID NO: 3524 - protein, 316 aa, Vibrio parahaemolyticus
MPLSNAELEYFDHNVLRLTSKKRSEYHAQVDNLVSELKKRITDKSKLKVTKVVKAGSFAKYTILRKIDGYPTDVDVVFYVTGVDEDSKSYEELCNRIYDLLVDIYPTKKVEDFEIQRRAAKVTFVKSGLEVDIVPVLQHSTEPDHGWQFDIQSGERNLTCAPCHIKFIQARKDKDKHFRTLVRLAKRWKHFHDIPGLKSFHIELILAYLIDTEGPATSIEKRFRDFLVYIARTRLSERIDFPENEGKPQASFSDPVVIIDPVSPENNVASRISKDEQALIAKAAEEAWENANYASVENDYEVWKEIFGGRFKTKEE

SEQ ID NO: 3525 - protein, 316 aa, Halomonas sp.
MPLSNTELEYFDHNFLRLPGPKRTEYHKQVDNLISELKKRITGKSELEITKVVKAGSFAKFTIMQKLDGYPTDIDIVFYITGVEENSKSYEALCNQVHDLLIDIYPTKKVEDFEIQRRSAKVTFVKSGLEVDVVPVLQHGTDLDHGWQYDIQSGARNLTCAPCHIQFIRTRKDKDKHFRTLVRLAKRWKHFHDIPGLKSFHIELIMAHLVDTDGPAVSIERRFREFLVYIARTKLSERIDFPENSGKPIVSFNDPVVIIDPVSPENNVASRITKDEQELIAKHAETTWETATYASVENNNEVWKEIFGNRFKVKDQ

SEQ ID NO: 3526 - protein, 174 aa, Burkholderia ambifaria
MPLTNTQLLWYDSNVLRLTQQKRTEYHEQVERLIKELRKHAENRSELTVTKVVKAGSFAKYTILRKTNDDPVDVDVVFYITGEDVDHKTFAELSETIYQLLIKIYPTKKVEDFEIQRRAATVTFVGSGLAVDIVPVLEDATRADFGWQFDIQDGSKSLTCTRWAQSNNEPLRAK

SEQ ID NO: 3527 - protein, 317 aa, Burkholderiales bacterium
MPLTNTQLLWYDSNVLRLTQKKRTEYHEQVDRLIKELRKHVENREELKVTKVVKAGSFAKYTILRKTNDDAVDVDVVFYITGKDASHETFKQLSDTIYELLIKIYPKKKVEDFEIQRRAAKVTFIGSGLAVDIVPLIQDPARPDYGWQFDIQDGSKSETCAPCSIKFVADRKDTDTHFRTLVRMGKRWKNHHKPAGLKSFHIELIMAHLLEMNGNEGSIEKRFRDFLLYVAQSGLKDRIDFVENRSSSAVKFGDPVVIVDPVNNRNNAASRITEAERIEIKQAANKSWEDAVFASQEDDVELWKEIFGPRFKVEDDE

SEQ ID NO: 3528 - protein, 317 aa, Collimonas sp.
MGLTNTELSYYDGNVLRLPAEKRKEYHQQVDRLIDELRKHVTEKSALKITKVVKAGSFAKYTILRKTTDDPVDVDVVFYISGKDANQETLDSLSEMIHSLLINIYPSKSVEDFEIQKKAATVTFIGSGLSVDVVPIVQDPSRENHGWQYDLSTGVKSSTCAPCQIKFVRDRKEDDAHFRTLVRLAKRWRNHAQPPGLKSFHIELIMAYLLDRDGAQESIEKRFRDFLLYIAQSGLKERIDFRENHGKTATAFTTPVVIVDPANSENNVASRISEDEREEIVKIADESWETAIHASEEGDVSVWKEIFGPRFKIKDAE

SEQ ID NO: 3529 - protein, 314 aa, Pandoraea apista
MPLTNTDLRYYDSNVLRLSSDKRTEYHAQVDRLIAELRKHVTQQSDLKITRVVKAGSFAKYTILKKTADDPIDVDVVFYISGRDVESSTLETLSELIHSLLLKIYPTKSVEDFEIQRRAATVTFVGSGLSVDVVPVIQDEYNQDHGWQYDLSTGEKNLTCAPCQLQFVQDRKKKDDNYRTLVRMAKRWKNFSQPPGLKSFHIELILAYLLDRDGATDSIEKRFRDFLLYIAQSELKERIDFVENQGRHKSFSDPVQIVDPANHENNVASRITDEERKKIVRMADEAWEIANHASTQPDEETWKEVFGPRFKTKD

SEQ ID NO: 3530 - protein, 315 aa, Pseudomonas mandelii
MPLTNTDLQYYDSKVLRLSAEKRKEYHGQVDNLVTELRKHVTARSDLKISKVVKAGSFAKHTILNKTQEDPIDVDVVFYINDQSLDTSTRDGLSELIHSLLIKIYPSKAVEDFEIQRRAAKVTFVKSGLSVDVVPVVQDGNNPDHGWQFDKETKEKNLTCAPCHIQFIRDRKDKDKHYRTLVRMAKRWKNFANPPGLKSFHIELILAYLVDRDGPAESIEKRFREFLGYIAQTELNERIDFPENNGKLKKAFTDPVVIVDPANHENNVASRITTDEKMKIAKAALEAWETAFHASVQEDEEVWKEIFGNRFKIKE

SEQ ID NO: 3531 - protein, 315 aa, Klebsiella variicola
MSLTNTDLQHYDSNVLRLSQEKRTEYHKQVDNLVSELRKHVIAHSELKITKVVKAGSFAKYTVLKKTTEDPIDVDVVFYIGGQSVDKSTYDGLNALIHSLLIKIYPTKAVEDFEIQRRAATVTFVKSGLSVDVVPVIQDDSNPDHGWQFDRESGAKNLTCAPCHIQFVRDRKNEDKHYRTLVRMAKRWKNFTNPPGLKSFHIELILAYLLDRDGPTQNIEQRFREFLGYIAQTKLDERIDFPENQGKPWKAFSDPVVIIDPANHENNVASRITVDEKNKITEIALSSWETAYYASAQGENDVWKEIFGNRFKIKD

SEQ ID NO: 3532 - protein, 315 aa, Unknown
  Description of Unknown: Acinetobacter sequence
MSLKNSDLQYYDGNILRLSSEKRKEYHAQVDNLIAELRKHITVNSDLKVKKVVKAGSFAKFTILKKTAEDDIDVDVVFYIDGKNIDNTTLDNLNDLIYSLLTKIYPTKAVEDFEIQRRAATVTFVKSGISVDIVPVIQDESNPNHGWQYDLKSKERNLTCAPCHIQFIRDRKNSDKHYRTLVRMAKRWKNFENPPGLKSFHIELILAYLQDRDGPTENIEQRFREFLGFIAQSKLNERIDFPENSSKVQKYFSDPVVIIDPANHENNVASRITEKEKSEIIAKALQAWEAAHYASVEDDNDVWKEIFGPKFKIKD

SEQ ID NO: 3533 - protein, 315 aa, Acinetobacter sp.
MSLKNSDLQYYDGNILRLSSEKRKEYHAQVDNLIAELRKHITVNSDLKVKKVVKAGSFAKFTILKKTAEDDIDVDVVFYIDGKNIDDTTLDNLNDLIYSLLTKIYPTKAVEDFEIQRRAATVTFVKSGISVDIVPVIQDESDPNHGWQYDLKSKERNLTCAPCHIQFIQDRKNSDKHYRTLVRMAKRWKNFACPPGLKSFHIELILAYLQDRDGPTQNIEQRFREFLGFIAQSELNKRIDFPENSAKTEKYFSDPVVIIDPANHENNVASRITPNEKEQIVNIALKAWETANYASVEDDIDIWKEVFGNKFKIKD

SEQ ID NO: 3534 - protein, 335 aa, Paraburkholderia phenazinium
MSRQARARVTTNSEKLQMPLANKELLYYDHEVLRLPADKRKEYHEQVDRLVGELSQSLKDKAEIKVTRVVKAGSFAKHTILRKTNDDPVDVDVVFYIDGKDIGTETLKSLGDTIYDLLIKQYPNKSVSDFQIQRRAATVEFIGSGLAVDIVPVIQMPSNPDYGWQYDLADGSRNLTSAPGQIKFVRDRKNADGNFRTLVRLGKRWRRHTEVPGLKSFHIELVIAHLLEVNGNVGSIEQRFLDFLLFLAQDKLKPRIDFQENRGYPQVAFNDPVVVVDPVSNGNNTTARITDTERLEIANIAQNSWETAYTASMEDDVDQWKEIFGPRFRVKDKEQ

SEQ ID NO: 3535 - protein, 318 aa, Paraburkholderia phenazinium
MPLANKELLYYDHEVLRLPADKRKEYHEQVDRLVGELSQSLKDKAEIKVTRVVKAGSFAKHTILRKTNDDPVDVDVVFYIDGKDIGTETLKSLGDTIYDLLIKQYPNKSVSDFQIQRRAATVEFIGSGLAVDIVPVIQMPSNPDYGWQYDLADGSRNLTSAPGQIKFVRDRKNADGNFRTLVRLGKRWRRHTEVPGLKSFHIELVIAHLLEVNGNVGSIEQRFLDFLLFLAQDKLKPRIDFQENRGYPQVAFNDPVVVVDPVSNGNNTTARITDTERLEIANIAQNSWETAYTASMEDDVDQWKEIFGPRFRVKDKEQ

SEQ ID NO: 3536 - protein, 314 aa, Rhizobium leguminosarum
MPLTNSALLNYDHNVLRLPADKRKEYHEQVDRLVSELGKTLKGRADIKITRVLKAGSFAKFTIVKKTTQDPVDVDIVIYVAGVDPDKETLEQLLDDIHAALISIYPSKSVEDFEIQRKAATVKFVGSGLYVDIVPVVEDPYRPGYGWQFDRDGGKIETNPPGHLKFIRDRKDIDRHFRTLVRMGKRWSRHAELSALKGFHVELITAHVLAKYGATESIEKRFRDFLLYIAQSGLKEKISFPENTGVHGSFTDPVVILDPVNSENNVTSRITEAERQEIVKAADQSWEDANYASAEDDDDIWKEVFGTRFSVEEA

SEQ ID NO: 3537 - protein, 314 aa, Agrobacterium sp.
MPLTNTALLNYDHNVLRLPADKRKEYHEQVDRLVSELSKTLKGRADIKITRVLKAGSFAKFTILKKTSQDPVDVDLVIYVAGVDPDKESLEQLLDDIHAALISAYPSKSVEDFEIQRKAATVKFVGSGLYVDIVPVVEDPYRPGYGWQFDREGGKTETNPPGHLKFIKDRKDTDRHFRTLVRMGKRWSRHAELTALKGFHIELIMAHVLARYGATESIEKRFRDFLLYIANSGLKEKISFPENTGVQGTFTDPVVILDPVNGENNVTSRITEAERQEIVKAADQSWEDANFASAEDNDDIWKEVFGNRFSVEEA

SEQ ID NO: 3538 - protein, 314 aa, Rhizobium leguminosarum
MALSNSAFLRYDHNKLRLPQDKRTEYHGQVDRLVDELSKTLKGRTDIKITRVLKAGSFAKYTILRKTTDDPVDVDLVIYVTGVDANLETLEKLLADIHKALIANYPTKSVSDFEIQQKAATVTFVGTGLAVDVVPVVEDPNRPGMGWQFGRDGSKIETNPPGHLKFIRDRKDIDKHFRPLVRLGKRWRRQAELNALKGFHVELIMAHLVDTKGPAASIDERFREYLLYIADTGLKERIIFPENKGSLQTFSDPVVILDPVNSQNNVTSRITEEEREEIAAAADQYWEKAHYASAEPDEKYWKEVFGPRFSIEEL

SEQ ID NO: 3539 - protein, 316 aa, Unknown
  Description of Unknown: Mesorhizobium sequence
MPLTNTALLNYDHNVLRLPADKRTQYHAQVDRLVIELNKTLKGRTDIKITRVLKAGSFAKYTILRRTNEDPVDVDLVIYVSAGNADGNTLEQLVDAIHKALIDIYPTKSVEDFEIQRKAATVTFAGTGLSVDVVPIIEDPDRPGYGWQFDIRDGTKVETNPPGQLKFVRDRKDADKNFRTLVRIGKRWRRHAELEALKGFHIELIMAHVLEVNGNAGSIEKRFRDFLLYIAQSGLKEEIRFPENTGPYDTFSDPVVILDPVNSQNNVTSRITKAEREEIVAAANSAWEVAHYASAENDNDIWKEVFGPRFSTEEAA

SEQ ID NO: 3540 - protein, 316 aa, Mesorhizobium sp.
MPLTNTALLNYDHNVLRLPSDKRTQYHAQVDRLVTELNKTLKGRTDIKITRVLKAGSFAKFTILRRTNEDPVDVDLVIYVSGDNVDGSTLEQLVDAIHKALIDIYPTKSVEDFEIQRKAATVTFAGTGLSVDVVPIIEDPDRPGYGWQFDIRDGTKVETNPPGQLKFVRDRKDADKNFRTLVRIGKRWRRHAELEALKGFHIELIMAHVFEVNGNSGSIEKRFRDFLLYIAQSGLKEEIRFPENTGPYVTFSDPVVILDPVNSQNNVTSRITEAEREEIVAAANTAWEAAHYASAENDNDVWKEVFGPRFSTEEAA

SEQ ID NO: 3541 - protein, 327 aa, Spirosoma linguale
MRFDNQQLSHFIHKIKLQPENMGKYRDQLANLKKRLETKIAQDDSHGLKVTKYLIGGSWKKHTILRPTGDHPIDIDLLLFVEGDSNIQNDLKKLYGFIVDYLVSIYPQKDIRKEYDAQGNNKSVTIIFSGTGLEVDIVPVVPLDNLPDYVWQPSRRGGKKYITSVSRQLTFSLAHRKQNASYTAIVRAIKWWRNYKELYPTDDEPGLSSFAIELITAYLDEQYGVEENIEEGIIRFFQFVSGASFPIIQFEAAIKHVPKSFDPPIYVGDNTNNENNVARRMTEDKWAEIVSEAEEAFDTLNMAIARNNEGDTIQEWKSVFGPTFNIK

SEQ ID NO: 3542 - protein, 327 aa, Spirosoma linguale; identical to SEQ ID NO: 3541

SEQ ID NO: 3543 - protein, 327 aa, Unknown
  Description of Unknown: Bacteroidetes sequence
MKLSNKDLQNFIEKIKLQPENMGKYRDQINNLKEKLEKKIAEDDSHGLKVQKYIIAGSWKKHTILKPTGENPIDIDLVLFISGDKEIHNDLPKLYDYIVSYLKSIYPQKDIQRDVDAKGNTKSITISFSGTGLQVDIVPVVPLQDIAEYVWQPSRRGGKKYITSISKQLSFSLEKRQKNPSYTSIVRTIKWWKNYKELQPTDNEPGLSSFSIELIVAYLDENYGIEESIEEGVIRFFQFVSNPSFPIIEFKDSIKSIPGNYDSPIYIADNTNKENNIVKRLDKNKWDEIIEEAEDAFDTLNIAESKNNKGDTIQEWKRVFGPTFNLD

SEQ ID NO: 3544 - protein, 327 aa, Chryseobacterium balustinum
MKLSNQELQNFIEKIKLQPENMGKYRDQINNLKEKLEKKISDDNSHGLKVQKYIIAGSWKKHTILKPTGENPIDIDLVLFIAGDKEIHNDLPKLYNFIISYLESIYPQKDIRRDVDAKGNTKSITISFSGTGLQVDIVPVVPLTDIADYVWQPSRRGGKKYITSISKQLSFSLEKRQNNSSYTSIVRAIKWWKNYKELQPTDNEPGLSSFSIELIVAYLDDNYGILESIEEGLIRFFQFVSSPSFPIIQFKDSIKSVPVNYDSPIYIADNTNKENNIVKRLDKNKWDEIIEEAEDAFDTLNIAESKNNKGDTIQEWKRVFGPTFNLD

SEQ ID NO: 3545 - protein, 327 aa, Fluviicola taffensis
MLLNNNQLGVFVKKIKLQPENMAKYRDQLTNLKEKLEKKISDDTSNGLKVTKYLIAGSWKKHTILKPTGENPIDIDLILFVSGDNNVQNDLKKLYDYIIEYLKAIYPQKDIDRDVDAEGNTKSLTITFTGSGLQVDIVPVVSLASPAEYVWQPSRRGGKKYITSISKQLGFSANLRKNNPSYTSIVRSLKWWKNYKELCPTDSEPGLSSFTIELIVAYLDEEFGVETNIEEGIIRFFQFMSSPNFPIIKFSDSINSVPATFDSPIYVADNTNKENNVVKRLDRTKWQEIFDEAEAAFDTLNIAQSKNNEGDTIQEWKSVFGPSFNIK

SEQ ID NO: 3546 - protein, 326 aa, Bacteroidales bacterium
MELTNTQLNVFVDKIRLKSENMSKYREQLENLKNKLDNKIKEDKRTGLKVTKFIIAGSWKKHTILKPTGDNPIDIDLVLFVEGDEKIQDDLKKLHDFIVEYLEEIYPQKDINRDVDAEGNTKSITIKFSGTGLEVDIVPVVPLSTPKEYVWQPQRGGRGKYITSVSKQLDFSADLRRNNVSYTSIVRALKWWRNYKELHPTDDEPGLSSFAIELIVGYLDVNHGVENNIEEGIIRFFQFISCPDFPIIKFRDAIKSVPTFETPIYIADNTNNENNVVRKLTKSKWKEVVAEAEEAFDTLNIAESRKGEGATVDEWKRIFGPTFNIK

SEQ ID NO: 3547 - protein, 328 aa, Chryseobacterium sp.
MKLSDKDLQFFISKIKLQPENMGKYRNQVNNLKEKLDKKIAEDDRHGLKVEKYLLAGSWKKHTILKPTGDHPIDIDLVLFVTGDEDIHNDIGKLFDFIVEYLEEIYPQKDISKDVDAAGNTKSVTIYFSGSGLSVDIVPVVPLSTPKDYVWQPSRHGNGKKYITSISKQLSFSLNRRQENSAYTSIVRAIKWWRNYKELKPSDNEPGLSSFAIELIVAYLDINKGIQTNIEEGIIRFFEFVSSSEFPEIIFQDSILNVPSQYDSPIYVADNTNKENNVAKRMTIPRWNEIIEEAEEAFDTLNFAQARNNEGDTIQEWKSVFGPTFNIK

SEQ ID NO: 3548 - protein, 328 aa, Chryseobacterium sp.
MKLSDKDLQFFISKIKLQPENMGKYRDQVNNLKEKLDKKIAEDDRHGLKVEKYLLAGSWKKHTILKPTGDHPIDIDLVLFVTGDEDIHNDIGKLFDFIVEYLEEIYPQKDISKDVDAAGNTKSVTIYFSGSGLSVDIVPVVPLSIPKDYVWQPSRHGNGKKYITSISKQLSFSLNRRQGNSAYTSIVRAIKWWRNYKELKPSDNEPGLSSFTIELIVAYLDINKGIQTNIEEGIIRFFEFVSSTEFPEIIFQDSIRSVPSQYDSAIYVADNTNKENNVAKRMTKPRWNEIIEEAEEAFDTLNFAQARNNEGDTIQEWKSVFGPTFNIK

SEQ ID NO: 3549 - protein, 328 aa, Unknown
  Description of Unknown: Chryseobacterium sequence
MKLSDKDLQFFISKIKLQPENMGKYRDQVNNLKEKLDKKIAEDDRHGLKVEKYLLAGSWKKHTILKPTGDHPIDIDLVLFVTGDEDIHNDIGKLFDFIVEYLEEIYPQKDISKDVDAAGNTKSVTIYFSGSGLSVDIVPVVPLSTPKDYVWQPSRHGNGKKYITSISKQLSFSLNRRQENSAYTSIVRAIKWWRNYKELKPSDNEPGLSSFTIELIVAYLDINKGIQTNIEEGIIRFFEFVSSTEFPEIIFQDSIRSVPTQYDSAIYVADNTNKENNVAKRMTKPRWAEIIEEAEEAFDTLNFAQARNNEGDTIQEWKSVFGPTFNIK

SEQ ID NO: 3550 - protein, 328 aa, Elizabethkingia miricola
MKLSNKDLQFFISKIKLQPENMGGYREQVNNLKEKLDKKIAEDDRHELKVDKYLLAGSWKKHTILKPTGDHPIDIDLVLFVTGDEDIHNDIGRLFDFIVEYLEEIYPQKDISKDVDAEGNTKSVTIFFSTSGLSVDIVPVVPLSSPVDYVWQPSRYGNGKKYITSISKQLGFSLTRRQDNPNYTSIVRAIKWWRNYKELKPSDDEPGLSSFTIELIVAYLDINKGIQANIEEGIIRFFEFISSSEFPQVTFQDAIRTVPLYYDSPIYVADNTNKENNVTKRMTNLKWNEIIEDAEEAFDILNLAQARNNEGDTIREWKSVFGPTFNIK

SEQ ID NO: 3551 - protein, 327 aa, Flavobacterium chungangense
MKYTNDELGFFIDKIKLKAEDMPKYRTQINNLKEKLENKIKNDDSHGLKVTKYILAGSWKKHTILKPTGDFPIDIDLVLFVGGDDNIQNDLNKLFEYIITYLEEIYPQKDIRKVVDAKGNTKSITIIFSGSGLEVDIVPVVPISSPVEYVWQPSRRGGSKYITSISKQLDFSVNNRKNNPSYTSIVRALKWWRNEKEIKPTDDEPGLSSYVIELIVAYLDINYGIETNIEEAIIRFFQFVSGPNFPVISFKNAINTVPTYYTSSIYVADDTNNENNVSKRMTDSKWKEIVEEASEAFDSLNIAQSKRNEGDTLSEWKHVFGSTFNIK

SEQ ID NO: 3552 - protein, 326 aa, Flavobacterium daejeonense
MNLENDQLLFFVDKIKLQSENMQKYRDQINNLKEKLEAKIKNDQTTGLKVTKFLLAGSWKKRTILKASGDNPIDIDLVLFVGGDENIQDDLEKLHDYIVKYLEQIYPQKDIKRDVDAKGNTKSITIRFSGSGLEVDIVPVVPINKPQRYVWQPQRGGGGKYITSVENHLDFSLKKRQNNTSYTAIVRMLKHWKNYKELKPTDYECGISSFAIELIVAYLDEKQGVETNIEEAIIRFFQFISTSNFPNIKFDQAINSIPYYSTPIYIADDTNNENNAAKKIDQPKWDEIIEEAEKAFDALNYAQSIKTEGNTIEEWKTVFGPTFNIK

SEQ ID NO: 3553 - protein, 326 aa, Flavobacterium omnivorum
MKLENNQLLYFVDKIKLQKDNMQKYRDQINNLKTKLEDKIKNDESNGLKVTKYLLAGSWKKHTILKLTGDNPIDIDLILFVGGGDNIQNDLKKLHDFIVKYLQEIYPQKDINRDVDPEGNTKSITIRFSGSGLEVDIVPVVSISNPERYVWQPQRGGGGKYITSIENHIDFSISLRKNNPSYTAIVRSLKWWKNYKELRPTDTEPGITSFAIELIVAYLDETLGVETNIEEAIIRFFQFVSGSNFPNIKFDHAINKIPTYSTPIYIADDTNNENNASKKIDSTVWQEIIEQAEDAFDCLNYAQSKNNEGATIEEWKRVFGPTFNIN

SEQ ID NO: 3554 - protein, 331 aa, Cyclobacterium qasimii
MKLTNTQLHNFIGRIKLKEENMPKYREQVNNLKERLEKKIIEDDRTGLKVTKYLLAGSWKKRTILRPTGENPIDIDLVLYVGGDESLKNDLNRLHDFIVGYLREIYPNKDIDRDVDAEGNTKSITIKFSGTGLELDIVPVVPIPNSNEYVWQPQRGGGGKRYTTSVTKQIDFARERKAENTSFTSIVRAIKWWKNYKELKPIGDDPGLSSFVIELIVSHLELTEGTENDIETGIIRFFRFVSDPNFPIIKFKDAINSVPILFDSPVYIADPTNNDNNASKKLDNSIWDEIIHEANDAFDALFIAQSKISQGDTIEEWKHIFGPKFSITKED

SEQ ID NO: 3555 - protein, 322 aa, Roseivirga ehrenbergii
MKLTNTQLQNFIGRIKLKRDNMPKYKGQIENLVSKLEDKIKNDDSTGLRVTRVLRAGSWKKGTILRPTGDFPIDIDLVFFIKGDETVKNDVQKLHDFVVDYLESIYPSKDIYRDVDASGNTKSIKIKFSGTGLEVDIVPVVPLSSPEGYVWQPERGGKGKYITSVDGQLEFAKERKNANSSFTSVVRAVKWWRNYKELDVLKSFSVELIVSHLDLTKGVETNIEEALIRFFEFASSEKLKELNFIGAINTIPYYTTPVYIADPTNNENSTTNKITESDWNEIQEEAEEAYETLTLAQARGTMGDAISEWKSIFGPHFNITEE

SEQ ID NO: 3556 - protein, 324 aa, Sphingobacteriales bacterium
MKLTNTQLQNFVSRIKLKIENMPTYRDQVKNLIEDLEKYITTDTSTGIRVTRAIIAGSWKKGTILRATGENPIDIDLVLYVEGEKNLQDDLERLHDLIINYLKKIYPNKDIVRDTDAKGKTKSVKIKFIGTGLEIDIVPVVPMETPKEYVWQPQRGGAGDKYVTSVTKQLDFANGYRKQNASYTAVVRALKWWRNYKELDQLSSFTIELIVSYLETNKGLETNIEEGIIRFFKLVSDPSFPTINFLNAINNLPVPIPKIFVADPTNNENNAARKIDETNWDEIKEEADKAFEALNIAQSKNYEGDTIEEWKFVFGSSFNIKPEN

SEQ ID NO: 3557 - protein, 284 aa, Chondromyces apiculatus
MTNAIHANSSLRITKINQAGSWRKGTALKPKDGFEIDIDLIVYLDVAEATRSDVSTLHGIIVGLLRDVYGSKASDDFKESKKTVGIEFRTSGLKVDLVPVIPVQSPADYVWQPEVGGGGSFLTSPTKQLGFVLALKDRDPRYTSVVRLLKRWRNMAELRDELSSFTLELICAHIVGTQGPPPRIEEGLLRVLTYIATTELKQPVSFADAIRSCPSTASPVRIFDPTNNENNVTSRLGEQERRTIVARAADALETLNYARTVDAKGTTMECWKEVFGPSFRIEEV

SEQ ID NO: 3558 - protein, 320 aa, Chondromyces apiculatus
MQLTDQQLGFYSENILAFSREDKRKYQSQIDNLKEKLTNAIHANSSLRITKINQAGSWRKGTALKPKDGFEIDIDLIVYLDVAEATRSDVSTLHGIIVGLLRDVYGSKASDDFKESKKTVGIEFRTSGLKVDLVPVIPVQSPADYVWQPEVGGGGSFLTSPTKQLGFVLALKDRDPRYTSVVRLLKRWRNMAELRDELSSFTLELICAHIVGTQGPPPRIEEGLLRVLTYIATTELKQPVSFADAIRSCPSTASPVRIFDPTNNENNVTSRLGEQERRTIVARAADALETLNYARTVDAKGTTMECWKEVFGPSFRIEEV

SEQ ID NO: 3559 - protein, 317 aa, Archangium gephyra
MQLTDRQLNDYIDDVLFFGREEKQRYERQIDHLKQTLVNALQANSSLRAWKILHAGSWHKGTALRPFGTQDIDIDIILYLNVPETGRGDLADLHPLLLRSLRAAYPTKDPNDFTTSRKTVGIEFRTSGLLVDLVPVIPTEQPEGYVWQTERGGRGTSLTSPEGQLEFIRQCKARDPRYVQVVRLAKRWRNHRRLHALPSFAIELLVAHLGLTQGVPDTIEQGFYRFFLYLVRGLKERITFPGALGHPPRSACPVQIHDPTNNENNVTARMEPDEVTALLHEAVVALQAVNHAMSVERRGDTEKLWKQVLGPEFSLSR

SEQ ID NO: 3560 - protein, 334 aa, Streptomyces lividans
MAGERHVDQRVLADFAENRVNVPSVEAKERRTQVKHLRERLEAYIADHPDYNLVKLRASGSTAKHTAIWRRRGEGSDADVAAYVRVAGTDVDEAGLLEWLRDRCIEVYGKTKVAEDFVISQHAVGITLRGSGLKIDVAPVLYTGEPDDKGHLITRQGEKVLTSVTLHLRFIEKRKHPDAAGPGYTELIRLLKAWIREGKRNDPDLRCKSFLLELLVAHLWEHGWNGELLQVNDYPRAIEQVLSYIAVTGLKTPIVFTDYYEADAVASSSDSIQVWDPVNPDNNVASSYTEYDRQRLVDHANTALEAVAWAAGAPTKGEANDAWRELFGPSFQGA

SEQ ID NO: 3561 - protein, 334 aa, Streptomyces sp.; identical to SEQ ID NO: 3560

SEQ ID NO: 3562 - protein, 334 aa, Streptomyces sp.
MAGERHVDQRVLADFAENRVNVPSVEAKERRTQVKHLRERLEAYIADHPDYNLVKLRASGSTAKHTAIRRRRGEGSDADVAAYVRVAGTDVDEAGLLEWLRDRCIEVYGKTKVAEDFVISQHAVGITLRGSGLKIDVAPVLYTGEPDDKGHLITRQGEKALTSVTLHLRFIEKRKHPDAAGPGYTELIRLLKAWIREGKRNDPDLRCKSFLLELLVAHLWEHGWNGELLQVNDYPRAIEQVLSYIAVTGLKTPIVFTDYYEADAVASSSDSIQVWDPVNPDNNVASSYTEYDRQRLVDHANTALEAVAWAAGAPTKGEANDAWRELFGPSFQGA

SEQ ID NO: 3563 - protein, 323 aa, Streptomyces sp.
MADFAENRVNVPSVEAKERRTQVKHLRERLEAYIADHPDYNLVKLRASGSTAKHTAIRRRRGEGSDADVAAYVRVAGTDVDEAGLLEWLRDRCIEVYGKTKVAEDFVISQHAVGITLRGSGLKIDVAPVLYTGEPDDKGHLITRQGEKALTSVTLHLRFIEKRKHPDAAGPGYTELIRLLKAWIREGKRNDPDLRCKSFLLELLVAHLWEHGWNGELLQVNDYPRAIEQVLSYIAVTGLKTPIVFTDYYEADAVASSSDSIQVWDPVNPDNNVASSYTEYDRQRLVDHANTALEAVAWAAGAPTKGEANDAWRELFGPSFQGA

SEQ ID NO: 3564 - protein, 323 aa, Streptomyces lividans
MADFAENRVNVPSVEAKERRTQVKHLRERLEAYIADHPDYNLVKLRASGSTAKHTAIWRRRGEGSDADVAAYVRVAGTDVDEAGLLEWLRDRCIEVYGKTKVAEDFVISQHAVGITLRGSGLKIDVAPVLYTGEPDDKGHLITRQGEKVLTSVTLHLRFIEKRKHPDAAGPGYTELIRLLKAWIREGKRNDPDLRCKSFLLELLVAHLWEHGWNGELLQVNDYPRAIEQVLSYIAVTGLKTPIVFTDYYEADAVASSSDSIQVWDPVNPDNNVASSYTEYDRQRLVDHANTALEAVAWAAGAPTKGEANDAWRELFGPSFQGA

SEQ ID NO: 3565 - protein, 323 aa, Unknown; identical to SEQ ID NO: 3564
  Description of Unknown: Streptomyces sequence

SEQ ID NO: 3566 - protein, 334 aa, Streptomyces sp.
MPGESHVDHKVLAVFAENRVNVPGVEAKERRRQVKHLRERLEGYIAEHPDYDLVKLRASGSTAKHTAIRRRRGEGSDADVAAYVRVADTDVDEAGLLEWLRDRCIEVYGKTKVAEDFVISQHAVGITLRSSGLKIDVAPVLYTGEPDDKGHLITRQGEKVLTSVTLHLRFIEKRKHPDAAGPGYTELIRLLKAWIREGKRNDPDLRCKSFLLELLVAHLWRHGWNGEPLKVNDYPRAIEQVLSYMAVTGLKTPIVFTDYYQADAVASSSDPIQIWDPVNPENNVASSYTEYHRQRLVDYANTALEAVAWAAGAPSKGEANDAWRELFGPSFQGA

SEQ ID NO: 3567 - protein, 323 aa, Streptomyces sp.
MAVFAENRVNVPGVEAKERRRQVKHLRERLEGYIAEHPDYDLVKLRASGSTAKHTAIRRRRGEGSDADVAAYVRVADTDVDEAGLLEWLRDRCIEVYGKTKVAEDFVISQHAVGITLRSSGLKIDVAPVLYTGEPDDKGHLITRQGEKVLTSVTLHLRFIEKRKHPDAAGPGYTELIRLLKAWIREGKRNDPDLRCKSFLLELLVAHLWRHGWNGEPLKVNDYPRAIEQVLSYMAVTGLKTPIVFTDYYQADAVASSSDPIQIWDPVNPENNVASSYTEYHRQRLVDYANTALEAVAWAAGAPSKGEANDAWRELFGPSFQGA

SEQ ID NO: 3568 - protein, 323 aa, Streptomyces sp.
MAAFAENRVNVPGVEAKERRRQVRHLRERLEAYIMEHPDYDLVKLRASGSTAKHTAIRRRRGEGSDADVAAYVRVADTDVDEAGLLEWLRDRCIEVYGKTKVAEDFVVSQHAVGITLRGSGLKIDVAPVLYTGEPDDKGHLITRQGEKVLTSVTLHLRFIEKRKHQDAAGPGYTELIRLLKAWIREGKRNDLDLRCKSFLLELLVAHLWEHGWNGEPLQVNDYPRAIEQVLSYIAVTGLKTPIVFTDYYGADAVASSSDPIQVWDPVNPENNVASSYTEYHRQRLVDHANTALEAVAWAAGAPTKGEANDAWRELFGPSFQGV

SEQ ID NO: 3569 - protein, 310 aa, Streptomyces lividans
MEAKERRTQVKHLRERLEAYIADHPDYNLVKLRASGSTAKHTAIWRRRGEGSDADVAAYVRVAGTDVDEAGLLEWLRDRCIEVYGKTKVAEDFVISQHAVGITLRGSGLKIDVAPVLYTGEPDDKGHLITRQGEKVLTSVTLHLRFIEKRKHPDAAGPGYTELIRLLKAWIREGKRNDPDLRCKSFLLELLVAHLWEHGWNGELLQVNDYPRAIEQVLSYIAVTGLKTPIVFTDYYEADAVASSSDSIQVWDPVNPDNNVASSYTEYDRQRLVDHANTALEAVAWAAGAPTKGEANDAWRELFGPSFQGA

SEQ ID NO: 3570 - protein, 333 aa, Streptomyces sp.
MAAERHVDHKVLKAFAETRVNVPAQEAAERRRQVNHLRERLERHIAAHPDFELVKLRASGSTAKFTAIQRRGGGSDADVAAYLRTADPDVDEASLLEWLRERCIQVYGDTKVADDFKISDHAVGITLRGSGLKIDVAPVLYAGEPDDKGYLVTRQGTRVLTSVTLHLRFIEKRKSSDAAGPGYTELIRLLKAWIRQSKLHDPDLRCKSFLLELLVAHLWETGWNGELLQVNDYPRAIEQVLAYIARTGLKRPIVFTDFYPAGDVASSSDPIQVWDPVNPDNNVAGTYTEQDRLRLVEHANTALEDVAWAAGAPTRGEANDAWRELFGPTFQGA

SEQ ID NO: 3571 - protein, 332 aa, Streptomyces fulvoviolaceus
MAGESHVSHKVLAKHAENKVNVLRDDAKERRRQVNHLRERLESFIDDHPDYDLVKLRASGSTAKHTAIKRRKGEGSDADVAAYVRSCDPDAPEADLLEWLRDRCIEVYGKTKVADDFVISQHAVGITLRGSGLKIDVAPVLDTGESDDKGYLITRQGERVLTSVTQHLEFIRTRKRKAGHGYAELIRLLKAWIRESKRLDPDLRCKSFLLELIVAHLWDNGWNGESLEVDDYPRAIEQVLAYIVRTGLKSPIVFDDFYDPADVLTTYEAIQVWDPVNPENNVASSYTEHDRQRLVDQAATSLDEISWAATAPTKGDANDAWRTLFGPSFEGA

SEQ ID NO: 3572 - protein, 321 aa, Streptomyces fulvoviolaceus
MAKHAENKVNVLRDDAKERRRQVNHLRERLESFIDDHPDYDLVKLRASGSTAKHTAIKRRKGEGSDADVAAYVRSCDPDAPEADLLEWLRDRCIEVYGKTKVADDFVISQHAVGITLRGSGLKIDVAPVLDTGESDDKGYLITRQGERVLTSVTQHLEFIRTRKRKAGHGYAELIRLLKAWIRESKRLDPDLRCKSFLLELIVAHLWDNGWNGESLEVDDYPRAIEQVLAYIVRTGLKSPIVFDDFYDPADVLTTYEAIQVWDPVNPENNVASSYTEHDRQRLVDQAATSLDEISWAATAPTKGDANDAWRTLFGPSFEGA

SEQ ID NO: 3573 - protein, 332 aa, Unknown
  Description of Unknown: Streptomyces sequence
MAGEPYVDHEVLKTFAGNKVNVPREEAKERRRQVNHLRERLESYIADHPDFDLVKLRASGSTAKHTAIRRRSGEGSDADVAAYLRVADPKVDVSTVLDWLRDRCIEVYGKTKVADDFVPSDHAVGITMRGTGLKIDVVPVLYTGEPDDKGYLVTSKGIKVLTSVTLHLQFMRKRKDAVGDAYRELIRLLKAWIRESKITDPDLRCKSFLLELLVAHLWETGWNGESLQVNDYPRAIEQVLSYIVRTGLQQPIVFTDYYEANEIAHSWAPIQVWDPVNPENNVTSTYTELDRQRLVKHAKSTLDTVAWAAHATTKGDANDAWRELFGPSFPGA

SEQ ID NO: 3574 - protein, 332 aa, Unknown
  Description of Unknown: Streptomyces sequence
MAGEPYVDHEVLKTFAGNKVNVPREEAKERRRQVNHLRERLESYIADHPDFDLVKLRASGSTAKHTAIRRRSGEGSDADVAAYLRVADPKVDVSTVLDWLRDRCIEVYGKTKVADDFVPSDHAVGITMRGTGLKIDVVPVLYTGEPDDKGYLVTSKGIKVLTSVTLHLQFMRKRKDAAGDAYRELIRLLKAWIRESKITDPDLRCKSFLLELLVAHLWETGWNGESLQVNDYPRAIEQVLSYIVRTGLQQPIVFTDYYEANEIAPSWAPIQVWDPVNPENNVTSTYTELDRQRLVKHAKSTLDTVAWAAHATTKGDANDAWRELFGPSFPGA

SEQ ID NO: 3575 - protein, 332 aa, Streptomyces natalensis
MAGELYVDHEVLKTFAGNKVNVPGEEAKERRRQVNHLRERLESYIADHPDFDLVKLRASGSTAKHTAIRRRSGEGSDADVAAYLRVADPKVDVSTVLDWLRDRCIEVYGKTKVADDFVPSDHAVGITMRGTGLKIDVVPVLYTGEPDDKGYLVTSKGSKVLTSVTLHLQFMKKRKDAAGDAYRELIRLLKAWIRESKITDPDLRCKSFLLELLVAHLWETGWNGESLQVNDYPRAIEQVLSYIVRTGLQQPIVFTDYYEANEIAPSWATVQVWDPVNPENNVTSTYTELDRQRLVKHAKTTLDTVAWAAHATTKGDANDAWRELFGPTFPGA

SEQ ID NO: 3576 - protein, 332 aa, Streptomyces sp.
MAGEPYVDHDVLKAFAQGKVNVPKEEAKERRRQVNYLRERLEDYIADHPDFDLVKLRASGSVAKHTAIRRRKGEGSDADVAAYLRVADPEVDVATVLDWLRKRCIEVYGKTKVAEDFVPSDHAVGITMRGTGLKIDVVPVLYTGEPDDRGYLVTSQGIKVLTSVTLHLQFIKKRKDAAGDAYRELIRLLKAWIRESKSVDPDLRCKSFLIELLVAHLWETGWNGEPLQVKDYPRAFEQVLSYIVRTGLREPIVFTDYYKANEVSSSNASIQVWDPVNPENNVASTYTELDRQRLVKHAKTTLDTISWAAHATTKGDAIDAWRELFGPAFPGA

SEQ ID NO: 3577 - protein, 332 aa, Saccharopolyspora spinosa
MAGERYVHHKVLKAFAQSKVNVPAEEAKERRRQVNHLRERLEDYIAAHPDFDLVKLRASGSTAKRTAIRRRSGTGSDADVAAYLRTTDTDIDVSTMLTWLRDRCIEVYGATKDADDFKPSDHAVGITMRSSGLKIDVVPVLYTGEPDDRGCLVTADGTKVLTSVTLHLQFIQRRKDKAGDGYREVIRLLKAWIRESKEVDAELRCKSFLIELLVAHLCDVGWNGKPLQVDDYSAAIEQVLSYIVRTGLRTPIVFTDYYKAETVNATADPIHVWDPVNPENNVARGYTEQDRQRLVHHAKTTLDTISMAAHAATKGEAVDAWRELFGPAFPGD

SEQ ID NO: 3578 - protein, 332 aa, Microtetraspora glauca
MAGERYVDHKVLKAFAQSKVNVPVEEAKERRRQVNHLRERLEDYIATHPDFDLVKLRASGSTAKHTAIRRKSGTGSDADVAAYLRTTDTDIDVSTMLTWLRDRCIEVYGATKDEDDFKPSDHAVGITMRSSGLKIDVVPVLYTGEPDDRGYLVTADGTKVLTSVTLHLEFIKTRKDKAGDGYRELIRLLKAWIRESKEVDPELRCKSFLIELLVAHLWDVGWNGEPLKVDDYPAAIEQVLSYITRTGLKTPIVFTDYYKADAVSTTADNIQVWDPVNPENNVARGYTEQHRQRLVNHSRTTLDTITMAAYAATKGEALDAWRELFGPTFPGD

SEQ ID NO: 3579 - protein, 332 aa, Actinopolyspora iraqiensis
MAGERYVDHTVLEAFVQSRVNVPREEAKERRRQVNYLRERLEDYIAAEPDFDLVKLRASGSTAKHTAIRRRSGTGSDADVAAYLRTTDTDIDVTTMRTWLRDCCIKVYGATKDEGDFQPSDHAVGITMRSSGLKIDVVPVLYTGEPDDRGYLVTTDGTKVPTSVTLHLQFIKTRKHEAGDGYRAVIRLLKAWIRESKEVNPELRCKSFLLELLVAHLWDVGWNGQPLQVDDYPAAIEQVLSYIVRTGLTTPIVFTDYYTAGEVNAAADPIQVWDPVNPENNVARGYTEQDRQRLVDHASTTLDTISLAAYAATKGEALDAWRKVFGPTFPGE

SEQ ID NO: 3580 - protein, 332 aa, Streptomyces sp.
MAGERYVDHKVLQAFAQSKVNVPAEEAKERRRQVNHLRERLEGYIATHPDFDLVKLRASGSTAKHTAIRRKSGTGSDADVAAYLRVGDPDVHVSTLLTWLEERCKEVYGKTKVAEDFKPSDHAVGITMRGSGLKIDVVPVLYTGEPDDRGYLVTSSGTKVLTSVTLHLRFIEKRKEEAGDGYRELIRLLKAWIRESKTVDTQLRCKSFLIELLVAHLWDAGWNGKTLQVDDYPAAIEQVLAYIVRTGLKEPILFTDYYKGNAVGATTDPIQVWDPVNPENNVARGYSELDRLRLVNHAKTTLDTLMMAAYAATKGEALDAWRELFGPAFPGE

SEQ ID NO: 3581 - protein, 332 aa, Streptomyces pathocidini
MAGESYVDHEVLKAFAKNKVNVPKEEAKERRRQVNYLRERLEDYIAAHPDFDLVKLRASGSTAKHTAIRRRGGTGSDADVAAYLRVGGPDIGVSTVLAWLEERCKEVYGKTKVAGDFKPSDHAVGITMRGSGLKIDVVPVLYTGEPDDRGYLVTSGGTKVLTSVTLHLRFIEKRKGEAGDGYRELIRLLKAWIRESKEGDPELRCKSFLIELLVAHLWDVGWNGKPLQVDDYPQAIEQVLSYIVRTGLKTPIVFTDYYTADDVRTTTDPIRVWDPVNPENNVARGYTEFDRQRLVNHAKATLDTLTTAAYATTKSEALDLWRELFGPTFPGE

SEQ ID NO: 3582 - protein, 332 aa, Actinospica robiniae
MAGKTYVDHRVLAQFAQDHVNVPVDEAEERRAQVNHLRRRLELHIAKHPEYDLVKLRASGSTAKHTAIRRRKSEGSDADVAAYLRTGDIEIDEHLLLEWLLKRCREVYGETKDEADFAISQHAVGITMRGSGLKIDVAPVLYTGEPDDKGFLVTRQGQRVLTSVTLHLRFIEARKREAGRGYAELIRLLKAWIRWTKTQDSSLRCKSFLLELLVAHLWENGWHSEALQVNDYPRAFEQVLSYIATTGLKTPILFDDYYGADEVITSSDPIQVWDPVNPGNNVASSYNDMERRRLVDAAASALDSVSWAAMAPTKAEAADAWRELFGPTFPGV

SEQ ID NO: 3583 - protein, 321 aa, Actinospica robiniae
MAQFAQDHVNVPVDEAEERRAQVNHLRRRLELHIAKHPEYDLVKLRASGSTAKHTAIRRRKSEGSDADVAAYLRTGDIEIDEHLLLEWLLKRCREVYGETKDEADFAISQHAVGITMRGSGLKIDVAPVLYTGEPDDKGFLVTRQGQRVLTSVTLHLRFIEARKREAGRGYAELIRLLKAWIRWTKTQDSSLRCKSFLLELLVAHLWENGWHSEALQVNDYPRAFEQVLSYIATTGLKTPILFDDYYGADEVITSSDPIQVWDPVNPGNNVASSYNDMERRRLVDAAASALDSVSWAAMAPTKAEAADAWRELFGPTFPGV

SEQ ID NO: 3584 - protein, 333 aa, Nocardia araoensis
MHDHVRHADLAKYAQAKVNVPSDKAKARRTQVAHLRSRLENYIAEHPDYDLVKMRESGSVAKHTAIRAGSDTDVAAYVRASAVGGIDPEESKLLEWLRDRCIEVYGDTKDADDFQISHHAVGITMHGSGLKIDVAPVLYEGEANDRGHLITPSGEKVLTSVTQHLEFLNKRKNQVGSEYKEFIRLVKKFISRATKEAEAVGPELRFKSFLAELIVAHLWDNGWNGEGFAIKDYPRAFEQFFGYIVTTELRKPIMFTDYYSASDVGQSDAPVQVWDPVNPLNNVTKSYTDADRQRLVERCAQALEQITWAGTAPFKGEAVDAWRTVFGPTFSVV

SEQ ID NO: 3585 - protein, 324 aa, Nocardia araoensis
MAKYAQAKVNVPSDKAKARRTQVAHLRSRLENYIAEHPDYDLVKMRESGSVAKHTAIRAGSDTDVAAYVRASAVGGIDPEESKLLEWLRDRCIEVYGDTKDADDFQISHHAVGITMHGSGLKIDVAPVLYEGEANDRGHLITPSGEKVLTSVTQHLEFLNKRKNQVGSEYKEFIRLVKKFISRATKEAEAVGPELRFKSFLAELIVAHLWDNGWNGEGFAIKDYPRAFEQFFGYIVTTELRKPIMFTDYYSASDVGQSDAPVQVWDPVNPLNNVTKSYTDADRQRLVERCAQALEQITWAGTAPFKGEAVDAWRTVFGPTFSVV

SEQ ID NO: 3586 - protein, 324 aa, Nocardia soli
MAKYAQDKVNVASDTAKARRTQVSHLRSRLESYIAEHPDYDLVKMRASGSVAKHTAIRAGSDTDVAAYVRASAVGGVAPEESKLLEWLRDRCIEVYGATKDAEDFLISHHAVGITMHGSGLKIDVAPVLYEGEANDRGHLITPSGEKVLTSVTQHLEFLNKRKNQVGSEYKEFIRLVKQFISRAKKEAEAVGPELRFKSFLAELIVAHLWDNGWNGEGFAVKDYPRAFEQFFGYIVATELRQPIVFGDYYSVRDVDPSGEPVQVWDPVNPFNNVTKSYSDLDRQRLVERCSQALDQITWAGTAPFKGDAVDAWCTVFGPTFSVA

SEQ ID NO: 3587 - protein, 324 aa, Rhodococcus hoagii
MATFAVNKVNVPSETAKSRRVQVTHLRNRLDAYIKDHPDYDLVKMRGSGSVAKHTAIRTSSDTDIAAYVRATAVGGVDVDETKLLEWLCERCKEVYGATKDASDFEISHHAVGITMRGTGLKIDVAPVLYEGEPDDRGHLVTQTGDRVLTSVTLHKEFLNKRRAVAGPEYKEFIRLAKSFVHRAKIEAAASGPELRFKSFLVELIAAHLWDNGWLSKPFAIDDYPRAFEQFLAYIVMTELKDPIVFTDYYQASDIDTCVDAVQVWDPVNPANNVTRGYSDYDRQRIVQRCSEALDKVNTASAATNKTAAVAAWKTLFGPTFPGA

SEQ ID NO: 3588 - protein, 324 aa, Rhodococcus sp.
MVTFAVKRVNVPSATAKSRRTQVAHLRSRLEAYIADHPDYNLVKMRGSGSVAKHTAINSSSDTDIAAYVRAAAVGGVDVDETKLLEWLRDRCIEVYGATKEASDFEISHHAVGITMHGTGLKIDVAPVLYEGEPDDRGHLVTQTGDRVLTSVTLHKEFLNKRRAVAGPEYREFIRLVKAFVHRAKLEAAASGPELRFKSFLVELIVAHLWDNGWLSKPFAIKDYPRAFEQFFAYIVMTELKEPIVFTDYYQASEVDICVDAVQVWDPVNPSNNVTKGYSESDRLRLVQRCSEALDKVNTASSATNKTAAVTAWKSLFGPTFPGA

SEQ ID NO: 3589 - protein, 313 aa, Lechevalieria aerocolonigenes
MNVAKEDACKRREQVGHLRARLEAHISVNPDYDLVKLRASGSTAKHTAIKAVRGEGSDADVAAYLRTGDPDLDEAKILEWLHERCVEVYGKTKVADDFTISQHAVGIVLRGSGLKIDVAPVLYLNDPDDQGYLVTRRGERVLTSVTLHLRFIAKRKAAAGPGYAELIRLLKAWIRHAKRHDPQLRCKSFLLELVVAHLWEVGWHAVPLQVNDYPAAFEQVLSYLTVTELKQPIVFNDFYQPDAVGPSTDAVQIWDPVNAANNVASTYSDLDRRRLVDLAGEALDNVSWAATTPAKGTANDAWRQLFGPTFPGI

SEQ ID NO: 3590 - protein, 321 aa, Unknown
  Description of Unknown: marine actinobacterium sequence
MSEVTHQQIAAFAADRINLPHADAVKHRSQVNGLRDRLASKIAADPGYGLIKSLHAGSVAKSTALKSVNDLDLAVYVKSAEAPADDAELVPWLADRLFEATTNMDRAQFEEQTHCVTVHYRSSGLDVDVVPVLYEGEPNDVGYLIKKRTGDRLKTSTRLHLDFIGSRRKTYGLEFLELIRLTKWWKRQIVVRVDPDFKFKSFMIELIWAHLADSGVSLSDYPKALEAFFEWIVRTGLEERVTFTDYTPASTFPARGSAPIEILDPVNPENNVAIRYDNAGRDKILDAAASAYDALTDARFATTKGRAVDDWQELLGPTFKG

SEQ ID NO: 3591 - protein, 321 aa, Leifsonia aquatica
MSEITHQHVATFAADRVNLPRQDAAKHRTQVNGLRDRLSSKIAADPGYGLVKSLHAGSVAKGTALKNVNDLDLAVYVKAGEAPSSDSQLVPWLADRLYEATTNMDRDQFEEQTHCVTVHYRGSGLDVDVVPVLYEGEANDIGYLIKKYTGDRLKTSTRLHLDFIGGRRKTYGLEFLELIRLTKWWKRQIITRADPDFKFKSFMIELIWAHLADSGVPLSDYPRALEAFFEWIVKTGLDKRIAFTDYTPASDFPKRGSAPIDILDPVNTENNVAIRYDSVGRDKIVDAAASAYDALTDARFATTKGRAVDGWQEILGPTFKG

SEQ ID NO: 3592 - protein, 321 aa, Unknown
  Description of Unknown: Frankia sequence
MKITHDDLAVFAGRVVNLPKATADEDRKQVNHLRERLHAHIAKHPNFSLVKMLHAGSVAKGTALRNVLDYDVAVYVRLAEAPQDGAELVDWLAERLREAYGGLIDPSQIEATTHCVNIHFKSSGIDVDVVPVLYEGDPDDRGYLVSKSDGRRLLTSVRLHLDFVRARKRACPTDWAQVVRLVKWWVHAQKDRDADFRFKSFMVELLCAHLLDTDKIVFSDYVTALDGFFDLVVRTELNERIAFTDYYPAYALPRQRTDVIEIFDPVNPENNAARLYTMKDQQRIVTAAERALDAITEARHATTRAQAIECWQVVLGDRFRG

SEQ ID NO: 3593 - protein, 321 aa, Frankia sp.
  MOD_RES (73)..(73): Any amino acid
  MOD_RES (285)..(285): Any amino acid
  MOD_RES (293)..(293): Any amino acid
MKITHDDLAVFAGRVVNLPKATADEDRKQVNHLRERLHAHIAKHPNFSLVKMLHAGSVAKGTALRNVLDYDVXVYVRLAEAPQDGAELVDWLAERLREAYGGLIDPSQIEATTHCVNIHFKSSGIDVDVVPVLYEGDPDDRGYLVSKSDGRRLLTSVRLHLDFVRARKRACPTDWAQVVRLVKWWVHAQKDRDADFRFKSFMVELLCAHLLDTDKIVFSDYVTALDGFFDLVVRTELNERIAFTDYYPAYALPRQRTDVIEIFDPVNPENNAARLYTMKDQQRIXTAAERALXAITEARHATTRAQAIECWQVVLGDRFRG

SEQ ID NO: 3594 - protein, 321 aa, Frankia sp.
  MOD_RES (170)..(170): Any amino acid
MKITHDDLAVFAGRVVNLPKATADEDRKQVNHLRERLHAHIAKHPNFSLVKMLHAGSVAKGTALRNVLDYDVAVYVRLAEAPQDGAELVDWLAERLREAYGGLIDPSQIEATTHCVNIHFKSSGIDVDVVPVLYEGDPDDRGYLVSKSDGRRLLTSVRLHLDFVRARKRXCPTDWAQVVRLVKWWVHAQKDRDADFRFKSFMVELLCAHLLDTDKIVFSDYVTALDGFFDLVVRTELNERIAFTDYYPAYALPRQRTDVIEIFDPVNPENNAARLYTMKDQQRIVTAAERALDAITEARHATTRAQAIECWQVVLGDRFRG

SEQ ID NO: 3595 - protein, 329 aa, Amycolatopsis pretoriensis
MSPKVTHADVAEFAGRAVNLPREVAIAKRQQVNTLRSRLKTHIADNPGFSLVKMLHAGSVAKGTALRSVNDFDVAIYVERDDAPVEEAKLVEWTADRLREAYRGLLDPSQITPGTHCVNVHFKSTGTEVDVVPVLYEGDPDDRGYLIAKDAADRTEWLLTSVRLHLDFIQARKNVCKDDWAQVVRLVKWWVREQRMTSGPGDEFRFKSFMVELLCAHLLDSSRVDFTDYVTALDGVFDYIVRTELRERIAFDTYYPASDLPAERVGEIEIFDPVNPKNNTARLYEERDRVRIVEAAEAALDAITEARYATTKEQAVKCWQVVLGSRFRG

SEQ ID NO: 3596 - protein, 318 aa, Unknown
  Description of Unknown: Rhodococcus sequence
MAIIATTDLAAFAVKAVNLPHDEAQAGRDRVNVLRTRMEKHIADNPGFSLVKMLHAGSVAKGTALATVNDLDVAVYVRANDAPETGLVSWMAQRLRDAYGKTIKPDQIEEGVHCPTITFASGLSVDVVPVLYEGDDNDVGYLIAKDTGDRLKTSVTQHLAFVRARKNASPNHFAQMVRFVKWWVRTQKKLDSNFKFKSFMAELIVAKLADEGVDMADYPEALARVFSFIVDSGLQERIAFTDYYPASDLPGTTGAVVEIFDPVNPDNNVSFRYTDPDRLRIVNAAERALDAITEADFATTKGEAVACWQVVLGTRFKG

SEQ ID NO: 3597 - protein, 329 aa, Nocardiopsis lucentensis
MGEEGWFMPQIGHRDLVKFAEGKVNLKKFEVDDQRAQVNRLRDRIEAKVVASPEYGFIKALHAGSVAKGTALRSVNDRDLAVYVKAEQAPDSTLELVVWVRDRVAEAYPALSDDQIVANTHCVTVKFAASGLEVDVVPVLYEGEPNDVGYLVNKHTGERLRTSVRQHLDFIRGRKKDHPDHLAQLIRFTKWWARQQKKRDGEFKCKSFMLELLWVHLADGGMVLNDYAESLEQFFAFIVNGGLDSQIAFTDFHPASDLPGRGSAPIQILDPVNFDNNVAEHYENHHRDRLVAAAQEAFDAISTAYYEPAKGQAVELWQDVLGTSFQAAA

SEQ ID NO: 3598 - protein, 332 aa, Candidatus Peregrinibacteria bacterium
MDTEPPFVRHSQILSFAKEKVNLDSEKRKTYRAQANNLRESLEKYINDHADYDHLRMYHSGSVEKGTALSTINDMDVAVYLKAAKEDVEEGDLLTWLRDRLIEAKPQNMDASQILPIEAGAHCVTITYKGTGLDVDMVPVIYDGEPDGKGYLIPWGMDDRVLTSIPLHLAFIRKRKEEHPDHFAQVVRLVKWWAKLQKGANQSFRFKSFMLELICAHLVDTGKMDVTDYPTALAQFFGYILNSGLKERVIFADNYDADDVPDKTDVEIIGIFDPVNPDNNVASRYTEENRMLIVDEAQKAFDAITQAKYSITKGEAAELWKRVFGHSFFIAI

SEQ ID NO: 3599 - protein, 315 aa, Bacillus cereus
MLFTNKDLKGFIEEKVNVEKDKVDEYRGQVNRLRDNLKDYIKKNPDFGFVKMLHSGSVRKGTAISTLNDMDVALYVTPDKVENYSEEEVLEYVRDGLVKIYTRYNMKEEQFSIGHHCVKVSFKSSGLDVDVVPVIPNGEPNDLGHLITKDTGERVLTSIPLHLEFIRSRKKDNPNYATMVRVIKWWRNQREFKMKSFLIELIWAHIADTEGISDDIVTALRQFFRFIVNTELKKDIVFEDNYSSSDVTLESDGCNIFDPVNPENNVGDSLDDKKRELIIDEADEALGYLSHAVQASTKGVAESSLKQIFGSSFSF

SEQ ID NO: 3600 - protein, 321 aa, Vibrio tasmaniensis
MSLEHVNHKTLCEFAKEKVNLPKERADKFRKQARNLRDKLETYLKEHPDFALKRMQLSGSLAKGTGLRTLNDIDVAVYIGGIDSSIALSDLLDYLEEKIRKAYPQFSDDQITRQTYSICVSFKGSGLDVDLVPIIYEGEPDWRGYLVSQIDGSYLETSIPLHLEFAKKRKAQQPEHYTQVVRLIKYWARKQKREVEDFRFKSFMIEMILAKLCDEGIDFSDYVEALQAFFTYIVKSNLEQKIIFEDYYKSSEVGAFSHPVQIIDPVNANNNVSNLYTRTQADLIVNAAMAAGDAIDAAEFAPTKALTLQYWQSVFGPSFTG

SEQ ID NO: 3601 - protein, 321 aa, Alteromonas stellipolaris
MSLEYVNHKTLCDFAKDKVNLPKDRADKFRKQARNLREKLQDYLKEHPDFALKRMRLSGSLAKGTALRSLNDIDVAVYIGGVDSNIALNDLLDYLEEKIRKAYPNFSYDQIKRQTYSICVSFKGSGLDVDLVPIIYEGKADWRGYLVSQMDGSYLETSIPLHLEFAKKRKDRQPEHYAQIVRLVKFWAKKQKNEIDGFRFKSFMIEMILAKLSDNGVDFSDYVEALQEFFTYIVKSNLDQKIIFEDYYKASEVKDFSDPIQIIDPVNTENNVSSLYTRHQADLIVNAAMDAGDAIDAAEFAPTKTLTVQYWQSVFGPSFTG

SEQ ID NO: 3602 - protein, 175 aa, Escherichia coli
MSTEHVDHKTIARFAEDKVNLPKVKADDFREQAKRLQNKLEGYLSDHPDFSLKRMIPSGSLAKGTALRSLNDIDVAVYISGSDAPQDLRGLLDYLADRLRKAFPNFSPDQVKPQTYSVTVSFRGSGLDVDIVPVLYSGLPDWRGHLISQEDGSFLETSIPLHLDFIKARKRAAPK

SEQ ID NO: 3603 - protein, 321 aa, Unknown
  Description of Unknown: Pseudomonas sequence
MSTEHVDHKVIARFAEERVNLPKEKAKEYREQAGRLQDKLEGYLSDHPDFSLKRMIVSGSLAKGTALRSLNDIDVAVYISGSDAPHDTRALLDYLADRLRKAFPNFSPDQVKPQTYSVTVSFRGSGLDVDLVPVLYSGLPQWRGNLVSQEDGSFLATSIPLHLEFIKVRKRASPTHFAQVVRLAKHWARLMKQERQDFRFKSFMIELILAKLSDKGVNFSNYPEALQAFFTYLVTSELRERIVFEDNYAASKVGPLTDLVQIIDPVNPDNNVARLYTQRNVDSIIDAAMDAGDAIDAALYAPTKQLTVGYWQKVLGSSFQG

SEQ ID NO: 3604 - protein, 321 aa, Pseudomonas aeruginosa
MSREHVDHRDIARFAEENVNLPKEKAIAYREQAGRLQEKLERYLSDHPDFSLRRMLVSGSLAKGTSLRSLSDIDVAVYISGSDAPHDTKALIDYLAEKLRKAFPNFSPDQVVPQTYSVTVSFRGSGLDVDIVPVLYSGLPQWRGNLISQEDGSFLETSIPLHLEFAKARKRAQPTHYAQVVRLVKYWAALMKRERDGFRFKSFMIEMIMSKLCDDGVDFSDYPEALQSFFTYIARSELREKIFFTDNYSASQVGKFTDPLQIIDPVNPTNNVARLYTKQNVDAIIEAALDAGDAIDAALFAPNKQLTVGYWQKVFGSTFQV

SEQ ID NO: 3605 - protein, 321 aa, Pseudomonas aeruginosa
MSREHVDHRDIARFAEEKVNLPKEKAIAYREQAGRLQEKLERYLSDHPDFSLRRMLVSGSLAKGTSLRSLSDIDVAVYISGSDAPHDTKALIDYLAEKLRKAFPNFSPEQVVPQTYSVTVSFRGSGLDVDIVPVLYSGLPQWRGNLISQEDGSFLETSIPLHLEFAKARKRAQPTHYAQVVRLVKYWAALMKLERDGFRFKSFMIEMIMSKLCDDGVDFSDYPEALQSFFTYIARSELREKIFFTDNYSASQVGKFTDPLQIIDPVNPTNNVARLYKKQNIDAIIEAALDAGDAIDAALFAPNKQLTVGYWQKVFGSTFQV

SEQ ID NO: 3606 - protein, 321 aa, Pseudomonas fluorescens
MSREHVDHRDLVRFAEEKVNLPKDKASAYREQAGRLQDKLEGYLSDHPDFSLKRMMVSGSLAKGTALRSLNDIDVAVYVSGSDAPHDTKALLDYLAEKLRKAFPNFTPDQVVPQTYSVTVSFRGSGLDVDIVPVLYSGLPEWRGNLISQDDGSFLETSIPLHLAFAKKRKQAQPTHYAQIVRLVKFWARLMKQERDGFRFKSFMIEMILAKLSDQGVDFSDYPEALQAFFTYIARSELREKIFFEDNYSASKVGVFTDPVQIIDPVNPDNNVACLYTKQNVDAIIDAALDAGDAIDAALYAPTKQLTVGYWQQVFGSSFQV

SEQ ID NO: 3607 - protein, 321 aa, Pseudomonas sp.
MSREHVNHRDIARFAEEKVNLPKEKATAYREQAGRLQEKLERYLSDHPDFSLRRMLVSGSLAKGTSLRSLSDIDVAVYISGSEAPHDTKALIDYLAEKLRKAFPNFSPEQVVPQTYSVTVSFRGSGLDVDIVPVLYSGLPEWRGNLISQEDGSFLETSIPLHLEFAKARKRAQPTHYAQVVRLVKYWAALMKRERDGFRFKSFMIEMIMSKLCDDGVDFSDYPEALQSFFTYIARSELREKIFFTDNYSASQVGKFTDPLQIIDPVNPTNNVARLYTKQNVDAIIEAALDAGDAIDAALFAPNKQLTVGYWQQVFGSTFQV

SEQ ID NO: 3608 - protein, 321 aa, Pseudomonas ficuserectae
MSTEHVDHKVIARFAEERVNLPKEKAKEYREQAGRLQDKLEGYLSDHPDFSLKRMIVSGSLAKGTALRSLNDIDVAVYISGSDAPHDTRALLDYLADRLRKAFPNFSPDQVKPQTYSVTVSFRGSGLDVDLVPVLYSGLPQWRGNLVSQEDGSFLATSIPLHLEFIKVRKRASPTHFAQVVRLAKHWARLMKQERQDFRFKSFMIELILAKLSDKGVNFSNYPEALQAFFTYLVTSELRERIVFEDNYAAYKVGPLTDLVQIIDPVNPNNNVARLYTQRNVDSIIDAAMDAGDAIDAALYAPTKQLTVGYWQKVLGSSFQG

SEQ ID NO: 3609 - protein, 198 aa, Escherichia coli
MSTEHVDHKTIARFAEDKVNLPKVKADDFREQAKRLQNKLEGYLSDHPDFSLKRMIPSGSLAKGTALRSLNDIDVAVYISGSDAPQDLRGLLDYLADRLRKAFPNFSPDQVKPQTYSVTVSFRGSGLDVDIVPVLYSGLPDWRGHLISQEDGSFLETSIPLHLDFIKARKRAAPKHFAQVVRLAKYWARLMKQERPNF

SEQ ID NO: 3610 - protein, 224 aa, Escherichia coli
MSTEHVDHKTIARFAEDKVNLPKVKADDFREQAKRLQNKLEGYLSDHPDFSLKRMIPSGSLAKGTALRSLNDIDVAVYISGSDAPQDLRGLLDYLADRLRKAFPNFSPDQVKPQTYSVTVSFRGSGLDVDIVPVLYSGLPDWRGHLISQEDGSFLETSIPLHLDFIKARKRAAPKHFAQVVRLAKYWARLMKQERPNFGNDSNLLIVFYVQIMPDDFVMQLHRF

SEQ ID NO: 3611 - protein, 321 aa, Unknown
  Description of Unknown: Enterobacteriaceae sequence
MSTEHVDHKTIARFAEDKVNLPKVKADDFREQAKRLQNKLEGYLSDHPDFSLKRMIPSGSLAKGTALRSLNDIDVAVYISGSDAPQDLRGLLDYLADRLRKAFPNFSPDQVKPQTYSVTVSFRGSGLDVDIVPVLYSGLPDWRGHLISQEDGSFLETSIPLHLDFIKARKRAAPKHFAQVVRLAKYWARLMKQERPNFRFKSFMIELILAKLLDNGVDFSNYPEALQAFFSYLVSTELRERIVFEDNYPASKIGTLSDLVQIIDPVNPVNNVARLYTQSNVDAIIDAAMDAGDAIDAAFYAPTKQLTVTYWQKVFGSSFQG

SEQ ID NO: 3612 - protein, 321 aa, Unknown
  Description of Unknown: Enterobacteriaceae sequence
MSTEHVDHKTIARFAEDKVNLPKVKADEFREQAKRLQNKLEGYLSDHPDFSLKRMIPSGSLAKGTALRSLNDIDVAVYISGSDAPQDLRELLDYLADRLRKAFPNFSPDQVKPQTYSVTVSFRGSGLDVDIVPVLYSGLPDWRGHLISQEDGSFLETSIPLHLDFIKARKRAAPKHFAQVVRLAKYWARLMKQERPNFRFKSFMIELILAKLLDNGVDFSNYPEALQAFFTYLVSTELRERIVFEDNYPASKIGKLSDLVQIIDPVNPVNNVARLYTQSNVDAIIDAAMDAGDAIDAAFYAPTKQLTVTYWQKVFGSSFQG

SEQ ID NO: 3613 - protein, 321 aa, Cronobacter sakazakii
MSTEHVDHKTIARFAEDKVNLPKAKADEFREQAKRLQNKLEGYLSDHPDFSLKRMIPSGSLAKGTALRSLNDIDVAVYISGSDAPQDLRELLDYLADRLRKAFPNFSPDQVKPQTYSVTVSFRGSGLDVDIVPVLYSGLPDWRGHLISQEDGSFLETSIPLHLDFIKARKRAAPKHFAQVVRLAKYWARLMKQERPNFRFKSFMIELILAKLLDNGVDFSNYPEALQAFFTYLVSTELRERIVFEDNYPASKIGKLSDLVQIIDPVNPVNNVARLYTQSNVDAIIDAAMDAGDAIDAAFYAPTKQLTVTYWQKVFGSSFQG

SEQ ID NO: 3614 - protein, 321 aa, Serratia marcescens
MSTEHVDHKTIARFAEDKVNLPKVKADEFREQAKRLQNKLEGYLYDHPDFSLKRMIPSGSLAKGTALRSLNDIDVAVYISGSDAPQDLRELLDYLADRLRKAFPNFSPDQVKPQTYSVTVSFRGSGLDVDIVPVLYSGLPDWRGHLISQEDGSFLETSIPLHLDFIKARKRAAPKHFAQVVRLAKYWARLMKQERPNFRFKSFMIELILAKLLDNGVDFSNYPEALQAFFTYLVSTELRERIVFEDNYPASKIGKLSDLVQIIDPVNPVNNVARLYTQSNVDAIIDAAMDAGDAIDAAFYAPTKQLTVTYWQKVFGSSFQG

SEQ ID NO: 3615 - protein, 321 aa, Serratia sp.
MSTEHVDHKTIARFAEDKVNLPKVKADEFREQAKRLQNKLEGYLYDHPDFSLKRMIPSGSLAKGTALRSLNDIDVAVYISGSDAPQDLRELLDYLADRLRKAFPNFSPDQVKPQTYSVTVSFRGSGLDVDIVPVLYSGLPDWRGHLISQEDGSFLETSIPLHLDFIKARKRAAPKHFAQVVRLAKYWARLMKQERPNFRFKSFMIELILAKLLDNGVDFSNYPEALQAFFTYLVSTELRERIVFEDNYPASKIGKLSDLVQIIDPVNPANNVARLYTQSNVDAIIDAAMDAGDAIDAAFYAPTKQLTVTYWQKVFGSSFQG

SEQ ID NO: 3616 - protein, 321 aa, Unknown
  Description of Unknown: Enterobacteriaceae sequence
MSTEHVDHKTIARFAEDKVNLPKVKADEFREQAKRLQNKLEGYLSDHPDFSLKRMIPSGSLAKGTALRSLNDIDVAVYISGSDAPQDLRELLDYLADRLRKAFPNFSPDQVKPQTYSVTVSFRGSGLDVDIVPVLYSGLPDWRGHLISQEDGSLLETSIPLHLDFIKARKRAAPKHFAQVVRLAKYWARLMKQERPNFRFKSFMIELILAKLLDNGVDFSNYPEALQTFFTYLVSTELRERIVFEDNYPASKIGKLSDLVQIIDPVNPVNNVARLYTQSNVDAIIDAAMDAGDAIDAAFYAPTKQLTITYWQKVFGSSFQG

SEQ ID NO: 3617 - protein, 321 aa, Pluralibacter gergoviae
MSTEHVDHKTIARFAEDKVNLPKVKADEFREQAKRLQNKLEGYLSDHPDFSLKRMIPSGSLAKGTALRSLNDIDVAVYISGSDAPQDLRELLDYLADRLRKAFPNFSPDQVKPQTYSVTVSFRGSGLDVDIVPVLYSGLPDWRGHMISQEDGSLLETSIPLHLDFIKARKRAAPKHFAQVVRLAKYWARLMKQERPNFRFKSFMIELILAKLLDNGVDFSNYPEALQTFFTYLVSTELRERIVFEDNYPASKIGKLSDLVQIIDPVNPVNNVARLYTQSNVDAIIDAAMDAGDAIDAAFYAPTKQLTITYWQKVFGSSFQG

SEQ ID NO: 3618 - protein, 321 aa, Klebsiella pneumoniae
MSTEHVDHKTIARFAEDKVNLPKAKADEFREQAKRLQNKLEGYLSDHPDFSLKRMIPSGSLAKGTALRSLNDIDVAVYISGSDAPQNLRELLDYLADRLRKAFPNFSPDQVKPQTYSVTVSFRGSGLDVDIVPVLYSGLPDWRGHLISQEDGSFLETSIPLHLDFIKARKRAAPKHFAQVVRLAKYWARLMKQERPNFRFKSFMIELILAKLLDNGVDFSNYPEALQAFFTYLVSTELRERIVFEDNYPASKIGKLSDLVQIIDPVNPVNNVARLYTQSNVDAIIDAAMDAGDAIDAAFYAPTKQLTVTYWQKVFGSSFQG

SEQ ID NO: 3619 - protein, 321 aa, Serratia sp.
MSIEHVDHKTIARFAEDKVNLPKVKADEFREQAKRLQNKLEGYLSDHPDFSLKRMIPSGSLAKGTALRSLNDIDVAVYISGSDAPQDLRELLDYLADRLRKAFPNFSPDQVKPQTYSVTVSFRGSGLDVDIVPVLYSGLPDWRGHLISQEDGSFLETSIPLHLDFIKARKRAAPKHFAQVVRLAKYWARLMKQERPNFRFKSFMIELILAKLLDNDVDFSNYPEALQAFFTYLVSTELRERIVFEDNYPASRIGKLSDLVQIIDPVNPDNNVARLYTQSNVDAIIDAAMDAGDAIDAAFYAPTKQLTVTYWQKVFGSSFQG

SEQ ID NO: 3620 - protein, 321 aa, Enterobacter cloacae
MSTEHVDHKTIARFAEDKVNLPKVKADDFREQAKRLQNKLEGYLSDHPDFSLKRMIPSGSLAKGTALRSLNDIDVAVYISGSDAPQDLRELLDYLADRLRKAFPNFSPDQVKPQTYSVTVSFRGSGLDVDIVPVLYSGLPDWRGHLISQEDGSFLETSIPLHLDFIKARKRAAPKHFAQVVRLAKYWARLMKQERPNFRFKSFMIELILAKLLDNGVDFSNYPEALQAFFTYLVSTELLERIVFEDNYPASKIGKLSDLVQIIDPVNPVNNVARLYTQSNVDAIIDAAMDAGDAIDAAFYAPTKQLTVAYWQKVFGSSFQG

SEQ ID NO: 3621 - protein, 321 aa, Providencia rettgeri
MSTEHVDHKTIARFAEDKVNLPKVKADDFREQAKRLQNKLEGYLSDHPDFSLKRMIPSGSLAKGTALRSLNDIDVAVYISGSDAPQDLRGLLEYLADRLRKAFPNFSPDQVKPQTYSVTVSFRGSGLDVDIVPVLYSGLPDLRGNLISQEDGSFLETSIPLHLDFIKARKRAAPKHFAQVVRLAKYWARLMKQERPNFRFKSFMIELILAKLLDNGVDFSNYPEALQAFFTYLASTELRERIVFEDNYPASKIGTLSDLVQIIDPVNPLNNVARLYTQSNVDAIIDAAMDAGDAIDAAFYAPTKQLTVTYWQKVFGSSFQG

SEQ ID NO: 3622 - protein, 321 aa, Photorhabdus asymbiotica
MSTEHVDHKTIARFAEDKVNLPKVKADEFREQAKRLQNKLEGYLFDHPDFSLKRMIPSGSLAKGTALRSLNDIDVAVYISGSDAPQDLRELLDYLADRLRKAFPNFSPDQVKPQTYSVTVSFRGSGLDVDIVPVLYSGLPDWRGHLISQEDGSFLETNIPLHLDFIKARKRAAPKHFAQVVRLAKYWARLMKQERPNFRFKSFMIELILAKLLDNGVDLSNYPEALQAFFTYLVSTELRERIVFEDNYPASKIGKLSDLVKIIDPVNPDNNVARLYTQSNVDAIIEAAMDAGDAIDAALYAPTKQLTITYWQKVFGSSFQG

SEQ ID NO: 3623 - protein, 321 aa, Brenneria goodwinii
MSTEHVDHKTIALFAEEKVNLPKEKADEFRDQAKRLQNRLEGYLSEHPDFSLKRMVPSGSLAKGTALRSLNDIDVAVYISGSDTPQDLRSLLDYLSERLCKAFPNFSPDQVKPQTYSVTVSFRGSGLDVDIVPVLYAGLPDWRGNLISQEDGSFLETSIPLHLEFIKARKRVAPKHFAQVVRLAKYWARLMKQERPNFRFKSFMIELIMAKLLDSGVDFSNYPEALQSFFTYLISTELRERIVFEDNYAASKVGNLSDLVQIIDPVNPDNNVACLYTQSNVDAIINAAMDAGDAIDAAFYAPTKQLTVNYWQKVFGSSFQG

SEQ ID NO: 3624 - protein, 321 aa, Pseudomonas stutzeri
MAREHIDHKDIARFAEEKVNLPKEKAQQYREQAQRLQDKLEGYLADHDDFSLKRMMLSGSLAKGTALRSLNDIDVAVYISGSEAPHDIRDLLDYLAERLRKAFPNFTPDQVKPQTYSVTVSFKGSGLDVDVVPVLYSGLPNWRGNLVSQEDGSFLETSIPLHLEFAKARKRAAPTHFAQVVRLAKYWARLMKQERQDFRFKSFMIELIMAKLCDDGVDFSDYPEAMQAFFTYLAISGLRQRIVFEDNYAASKVGALSDLVQIIDPVNPSNNVARLYTQRNVDAIVDAAMEAGDAIEAATYAPTKQLTVGYWQKVFGSSFQG

SEQ ID NO: 3625 - protein, 321 aa, Pseudomonas toyotomiensis
MAREHIDHKDIARFAEEKVNLPKEKAQQYREQAQRLQDKLEGYLADHDDFSLKRMMLSGSLAKGTALRSLNDIDVAVYISGSEAPHDIRDLLDYLAEKLRKAFPNFMPDQVKPQTYSVTVSFKGSGLDVDVVPVLYSGLPNWRGNLVSQEDGSFLETSIPLHLEFAKARKRAAPTHFAQVVRLAKYWARLMKQERQDFRFKSFMIELIMAKLCDDGVDFSDYPEALQAFFTYLATSGLRQRIVFEDNYAASKVGALSDLVQIIDPVNPSNNVARLYTQRNVDAIVDAAMEAGDAIEAATYAPTKQLTVGYWQKVFGSSFQG

SEQ ID NO: 3626 - protein, 321 aa, Pseudomonas sp.
MSREHVDHRDIARFAEEKVNLPKGKATEYRAQAQRLQDKLEGYLSEHPDFSLKRMMLSGSLAKGTALRSLNDIDVAVYISGSDAPHDIRELISYLTERLRKAFPNFTSDQVTPQTYSVQVNFKGSGLNVDLVPVLYNGKPQWRGNLVSQDDGSFLETSIPLHLEFAKQRKRIAPTHFAQVVRLIKHWARLMKAERHGFRFKSFMIEMILAKLIDEGVDFSDYPEAMQSFFTYIVRSELAERIVFEDNYRASAVGACTDVLQIFDPVNPDNNVSRLYTQSNVDLIISAASDAGDAIDGALYATTKQATVSYWQKVLGTTFQG

SEQ ID NO: 3627 - protein, 321 aa, Comamonadaceae bacterium
MSRTHIDHRDLVRFAEDKVNLPKDKADEYRAQARRLREKLEGYISEHPDFSLKRIQLSGSLAKGTALRSLNDIDMAVYISGSDAPHDTRALLDYLAERLRKAYPNFSPDQVKPQTYSVTVSFRGTGLDVDVVPVLYAGLPDWRGDLISQDDGSFLETSIPLHLEFAKKRKQAQPNHFAQVVRLVKFWARRMKQERDGFRFKSFMIEMILAKLCDDGVDLADYPEALQSFFTYVAKSNLRERIVFEDHYKASSVAKLDDPVQIIDPINASNNVARLYTAENADAIVDAALDAGDAIDAALTAPTKELTLHYWQKVFGPSFQG

SEQ ID NO: 3628 - protein, 321 aa, Burkholderia sp.
MSRTHIDHRDLVRFAEDKVNLPKDKADEYRAQARRLREKLEGYLSEHPDFSLKRIQLSGSLAKGTALRSLNDIDMAVYVSGSDAPHDIRTLLDYLAERLRKAFPNFNPDQVKPQTYSVTVSFRGTGLDVDVVPVLYAGLPDWRGDLISQDDGSFLETSIPLHLEFARKRKQAQPTHFAQMVRLVKFWARRMKQERDGFRFKSFMIEMILAKLCDDGVDLSDYPEALQSFFTYIAKSNLRERIVFEDHYKSSSVARLDDPVQIIDPINASNNVARLYTNENADAIVEAALDAGDAIDAALAAPNKELTLRYWQKVFGPSFQD

SEQ ID NO: 3629 - protein, 321 aa, Burkholderia pseudomallei
MSRTHIDHRDLVRFAEDKVNLPKDKADEYRAQARRLREKLEGYLSEHPDFSLKRIQLSGSLAKGTALRSLNDIDMAVYVSGSDAPHDIQALLDYLAERLRKAFPNFRPDQVKPQTYSVTVSFQGSGLDVDVVPILYAGLPDWRGDLISQDDGSFLETSIPLHLEFARKRKQAQQTHFAQVVRLVKFWARRMKQERDGFRFKSFMIEMILAKLCDDGVDFSDYPEALQSFFTYVAKSNLRERIVFEDHYKASSVAKLDDPVQIIDPINASNNVARLYTVENADAIVDAALDAGDAIDAALAAPNKELTLRYWQKVFGPSFQG

SEQ ID NO: 3630 - protein, 321 aa, Burkholderia cepacia
MSRTHIDHRDLVRFAEDKVNLPKDKADEYRAQARRLREKLEGYISEHPDFSLKRIQLSGSLAKGTALRSLNDIDMAVYVSGSDAPHDIQALLDYLAERLRKAFPNFRPDQVKPQTYSVTVSFQGSGLDVDVVPILYAGLPDWRGDLISQDDGSFLETSIPLHLEFARKRKQAQQTHFAQVVRLVKFWARRMKQERDGFRFKSFMIEMILAKLCDDGVDFSDYPEALQSFFTYIAKSNLRERIVFEDHYKASSVAKLDDPVQIIDPINASNNVARLYTVENADAIVDAALDAGDAIDAALAAPNKELTLRYWQKVFGPSFQG

SEQ ID NO: 3631 - protein, 321 aa, Achromobacter sp.
MSRTHIDHRDLVRFAEDKVNLPKDKADEYRAQARRLREKLEGYISEHPDFSLKRIQLSGSLAKGTALRSLNDIDMAVYVSGSDAPHDIQALLDYLAERLRKAFPNFRPDQVKPQTYSVTVSFQGSGLDVDVVPILYAGLPDWRGDLISQDDGSFLETSIPLHLEFARKRKQAQQTHFAQVVRLVKFWARRMKQERDGFRFKSFMIEMILAKLCDDGVDFSDYPEALQSFFTYVVKSNLRERIVFEDHYKASSVAKLDEPVQIIDPINASNNVARLYSVENADAIVDAALDAGDAIDAALAAPNKELTLHYWQKVFGPSFQG

SEQ ID NO: 3632 - protein, 321 aa, Burkholderia cenocepacia
MSRSYIDHRDLVRFAEDKVNLPKDKADEYRAQARRLREKLEGYISEHPDFSLKRIQLSGSLAKGTALRSLNDIDMAVYVSGSDAPDDIQALLEYLAERMRKAFPNFRPDQVKPQTYSVTVSFQGSGLDVDVVPILYAGLPDWRGDLISQDDGSFLETSIPLHLEFARKRKQAQQPHFAQVVRLVKFWARRMKQERDGFRFKSFMIEMILAKLCDDGVDFSDYPEALQSFFTYVAKSSLRERIVFEDHYKASSVAKLDDPVQIIDPINASNNVARLYTVANADAIVDAALDAGDAIDAALAAPNKELTLHYWQKVFGPSFQG

SEQ ID NO: 3633 - protein, 321 aa, Candidatus Accumulibacter phosphatis
MSRTHIDHRDLVRFAEDRVNLPKDKADEYRAQARRLREKLEGYISEHPDFSLKRIQLSGSLAKGTALRSLNDIDMALYVSGSDVPHDIRALLNYLAERLRKAFPNFRPEQVKPQTYSVTVSFQGSGLDVDVVPILYAGLPDWRGDLISQDDGSFLETSIPLHLEFATKRKRAQPIRFAQVVRLVKFWARRMKLERDDFRFKSFMIEMILAKLCDDGVDFSDYPEALQSFFTYVAQSNLRERIVFEDHYKASSVAKIDDPVQIIDPINAINNVSRLYTTETADAIVDAALDAGDAIDSALSAPNKELTLHYWQKVFGPSFQG

SEQ ID NO: 3634 - protein, 321 aa, Acidithiobacillus thiooxidans
MSRTHIDHRDLVRFAEEKVNLPKDKANEYRAQARRLREKLEGYLTEHPDFSLKRIQLSGSLAKGTALRSLNDIDMAVYVSGPDAPHDIRALLDYLAERLRKAFPNFRPEQVKPQTYSVTVSFQGSGLDVDVVPILYAGLPDWHGDLISQDDGSFLETSIPLHLEFTKKRKQAQPNRFAQVVRLVKFWARRMKQERDGFRFKSFMIEMILAKLCDDSVDFSDYPEALQSFFTYVAKSNLRERIVFEDHYRASSVGKLDDLVQIIDPINASNNVARLYTAENADAIVDAALDAGDAIDAALTAPTKELTLHYWQKVFGPSFQG

SEQ ID NO: 3635 - protein, 321 aa, Methylibium petroleiphilum
MSRAHVDHRDLVRFAEERVNLPKEKADEFRAQARRLREKLEGYLAEHPDFALKKMLLSGSLAKGTALRSLNDIDVAVYISGSDAPHDLQALLNYLAEKLRKAFPNFSPEQVQPQTYSVTVNFRGTGLNVDVVPVLYAGLPDWRGNLISQDDGSFLETSIPLHLECARKRKQAQPTHFAQVVRLIKYWARRMKQEHDGFRFKSFMIEMILAKLTDNGTDLSDYPEALQSFFTYVAESNLSERIVFEDYYQASTVAPSADRVQIIDPINASNNVARLYTAQNAAAIVDAALDAGDAIDAALKAPTKELTVHYWQKVFGSSFQG

SEQ ID NO: 3636 - protein, 321 aa, Pseudomonas aeruginosa
MSRAHVDHRDLVRFAEERVNLPKEKADEFRAQARRLREKLEGYLAEHPDFALKKMLLSGSLAKGTALRSLNDIDVAVYISGSDAPHDLQALLNYLAEKLRKAFPNFSPEQVQPQTYSVTVNFRGTGLNVDVVPVLYAGLPDWRGNLISQDDGSFLETSIPLHLEFARKRKQAQPTHFAQVVRLIKYWARRMKQEHDGFRFKSFMIEMILAELTDNGTDLSDYPEALQSFFTYVAESNLSERIVFEDYYQASTVAPSADRVQIIDPINASNNVARLYTAQNAAAIVDAALDAGDAIDAALKAPTKELTVHYWQKVFGSSFQG

SEQ ID NO: 3637 - protein, 321 aa, Thauera sp.
MSRTHVDHRDLVRFAEERVNLPKEKADEFRAQARRLREKLETYLTDHPDFALKKMQLSGSLAKGTALRSLNDIDMAVYVSGSDAPHDVKALLDYLAERLRKAFPNFSPEQVQPQTYSITVNFRGTGLNVDIVPVLYAGLPDWRGNLVSQDDGSFLETSIPLHLEFARKRKQAQPTHFAQIVRLVKFWARRMKQEHDGFRFKSFMIEMILAKLADDGTDLSDYPEALQAFFTYVANSNLSERIVFEDHYKASEVAPCADRVQIIDPINVTNNVARLYTDQNAGAIVEAALDAGDAIDAALRAPTKELTVRYWQKVFGSAFQG

SEQ ID NO: 3638 - protein, 264 aa, Kaistia sp.
SGSLAKGTALRSLNDIDVACYISGANVPEKVSELLEYLAERLRKAFPNFAADQVTPQTYSVTVSFRGTGLDVDVVPILYDNDPKWYGNLVSQEDGSFLKTSIPLHLDFASKRKKAQETHFAQVVRLVKFWARRMKQERDGFRFKSFMIEMILAKLCDDGLDFSDYPEALQHFFTYIATSNLAQKVVFSDYYAPSTVPAYLDRVQIIDPVNAQNNVARLYTGNNADMIVDAALEAGDAIDAALAAPTKQLTVAYWQKVFGSSFQA

SEQ ID NO: 3639 - protein, 321 aa, Bradyrhizobiaceae bacterium
MGRQHVGHDEIAAFAQDKVNLPKETADEYRAQARRLREKLEGYLSEHPDFTLKKMLLSGSLAKGTALRSLNDIDIACYISGADAPKDVQALLDYLAQRLRKAFPNFSPDQVQPQTYSVTVSFRGTGLDVDVVPILYDGDPKWYGNLVSQDDGSFLKTSIPLHLEFASRRKRAQEKHFAQVVRLVKFWARRMKQERDGFRFKSFMIEMILAKVCDDGLDFADYPEALQHFFTYVARTDLRSKIVFGDYYAVSSVANFTDTVQIIDPVNASNNVARLYTAANADAIVDAALDAGDAIDAALAAPNKQLTVAYWQRVFGSSFQA

SEQ ID NO: 3640 - protein, 321 aa, Unknown
  Description of Unknown: Bradyrhizobium sequence
MGRQHVGHDEIAAFAQDKVNLPKETADEYRAQARRLREKLEGYLSEHPDFTLKKMLLSGSLAKGTALRSLNDIDVACYISGADAPKDVRALLDYLAERLRKAFPNFNPDQVKPQTYSVTVSFRGTGLDVDVVPILYDGDPKWYGNLVSQDDGSFLKTSIPLHLDFAAKRKRAQEKHFAQVVRLVKFWARRAKQERDGFRFKSFMIEMILAKLCDDGLDFADYPDALQHFFTYVARTDMRSKIVFGDYYPASSVGTFTDTVQIIDPVNATNNVARLYTTANADAIVDAALDAGDAIDAALAAPNRQLTVAYWQKVFGSSFQA

SEQ ID NO: 3641 - protein, 321 aa, Unknown
  Description of Unknown: Bradyrhizobium sequence
MGRQHVGHDEIATFAQDKVNLPKDTADEYRAQARRLREKLEGYLSEHPDFTLKKMLLSGSLAKGTALRSLNDIDIACYISGADAPKDVQALLDYLAERLRKAFPNFSPDQVKPQTYSVTVSFRGTGLDVDVVPILYDGDPKWYGNLVSQDDGSFLKTSIPLHLEFAAKRKRAQEKHFAQVVRLVKFWARRMKQERDGFRFKSFMIEMILAKLCDDGLDLSDYPEALQHFFTYLARTDFRQQIVFSDYYPASSVGTFSDTVQIIDPVNATNNVARLYTTTNADAIVDAALDAGDAIDAALAAPNKQLTVAYWQKVFGSSFQA

SEQ ID NO: 3642 - protein, 320 aa, Bradyrhizobium valentinum
MGRQHVGHDEIATFAQDKVNLPKDTADEYRAQARRLREKLEGYLSEHPDFTLKKMLLSGSLAKGTALRSLNDIDIACYISGADAPKDVQALLDYLAERLRKAFPNFSPDQVKPQTYSVTVSFRGTGLDVDVVPILYDGDPKWYGNLVSQDDGSFLKTSIPLHLEFAAKRKRAQEKHFAQVVRLVKFWARRMKQERDGFRFKSFMIEMILAKLCDDGLDLSDYPEALQHFFTYLARTDFRQQIVFSDYYPASSVGTFSDTVQIIDPVNATNNVARLYTTTNADAIVDAALDAGDAIDAALAAPNKQLTVAYWQKVFSSFQA

SEQ ID NO: 3643 - protein, 321 aa, Chelativorans sp.
MGRQHVGHDEIAAFAQDKVNLPKDKADEYRAQARRLREKLEGYLSEHPDFTLKKMLLSGSLAKGTALRSLNDIDVACYISGADAPKDVQALLDYLAERLRKAFPNFSPDQVQPQTYSVTVSFRGTGLDVDVVPILYDGDAQWYGNLVSQDDGSFLKTSIPLHLDFAAKRKRTQEKHFAQVVRLAKFWARRMKQERDGFRFKSFMIEMVLAKLCDDGLDFSDYPEALQHFFTYIARTDFRQRIVFSDYYPASSVSTFSDTVQIIDPVNAANNVARLYTAANADAIVEAALDAGDAIDAALAAPNKQLTVAYWQKVFGSSFQV

SEQ ID NO: 3644 - protein, 321 aa, Afipia sp.
MGRQHVGQSEIAAFAQDKVNLPKDKADEYRAQARRLREKLEGYLGEHPDFTLKKMMLSGSLAKGTALRSLNDIDVACYVSGADAPKDVRVLLDYLAERLRKAFPNFSPDQVQPQTYSVTVSFRGTGLDVDVVPILYDGDAQWYGNLVSQDDGSFLKTSIPLHLEFAGKRKRAQEKHFAQVVRLAKFWARRMKQERDGFRFKSFMIEMVLAKLCDDGLDFSDYPEALQHFFTYIARTDFRQRIVFTDYYPASSVPACTETVQIIDPVNAANNVARLYTAANADAIVDAALEAGDAIDAALAAPNKQLTVAYWQKVFGSSFQA

SEQ ID NO: 3645 - protein, 321 aa, Nitrobacter hamburgensis
MGRQHVGHSEIATFAQDKVNLPKVKADEYRAQARRLREKLEGYLGEHPDFTLKKMMLSGSLAKGTALRSLNDIDVACYVSGADAPKDVRALLDYLAERLRNAFPNFSPDQVQPQTYSVTVSFRGTGLDVDVVPILYDGDPQWYGNLISQDDGSFLKTSIPLHLDFAAKRKRAQEKHFAQVVRLAKFWARRMKQERDGFRFKSFMIEMILAKLCDDGLDFSDYPEALQHFFTYIARTDFRQRIVFGDYYAVSSVGTFSDTVQIIDPVNAVNNVARLYTMANADAIVDAAIDAGDAVDAALAAPNKQLTVAYWQKVFGSSFQA

SEQ ID NO: 3646 - protein, 321 aa, Ensifer aridi
MTRAHIGHAEIASFAQDKVNLPKEKADEYRAQARRLREKLEGYLGEHPEFTLKKMLLSGSLAKGTALRSLNDIDVACYVSGADAPKDIRALLDYLAERLRKAFPNFSPDQVQPQTYSVTVSFRGTGLDVDVVPILYDGDPQWYGNLVSQDDGSFLKTSIPLHLDFAAKRKRAQEKHFAQVVRLAKFWARRMKQERDGFRFKSFMIEMILAKLCDDGLDFSDYPEALQHFFTYIGRTDFRQRIVFGDYYPVSSVGTFSDTVQIIDPVNAANNVARLYTSTNADAIVDAALEAGDAIDAALAAPTKQLTVAYWQKVFGSSFQA

SEQ ID NO: 3647 - protein, 321 aa, Methylocystis bryophila
MGRQHVGHSEIAAFAQEKVNLPKDKADEYRAQARRLREKLEGYLREHPDFTLKKMLLSGSLAKGTALRSLNDIDVACYVSGADAPEDVRALLDYLAERLRKAFPNFSPDQVQPQTYSVTVSFRGTGLDVDVVPILYDGDPEWYGNLVSQDDGSFLKTSIALHLDFAAKRKRTQEKHFAQVVRLAKFWARRMKQERDGFRFKSFMIEMVLAKLCDDGLDFSDYPETLQQFFTYIARTDFRERIVFADYYPASSVGAFSEAVQIIDPVNASNNVAKLYTAANADAIVDAALDGGDAIDAALAAPTKQLTVAYWQKVFGSSFQA

SEQ ID NO: 3648 - protein, 321 aa, Pararhizobium sp.
MGRQHVGHNDIVTFAQERVNLPKDKADEYRAQARRLREKLEGYLDEHPDFTLRKMMLSGSLAKGTALRSLNDIDVACYISGADAPKDIKTLLDYLAERLRKAFPNFSPDQVQPQTYSVTVSFRGSGLDVDVVPILYEGDVQWYGNLVSQDDGSFLKTSIPLHLDFAAKRKRAQEKHFAQVVRLAKFWARRMKQERDGFRFKSFMIEMILAKLCDDGLEFSDYPEALQYFFTYIARTDFRQRIVFGDYYPLSSVGTFTDTVQIIDPVNAVNNVARLYTASNADAIVEAALDAGDAIDAALAAPNKQLTVAYWQKVFGSSFQV

SEQ ID NO: 3649 - protein, 321 aa, Roseomonas rhizosphaerae
MGRQHVGHSEIAAFAQERVNLPKDKADEYRAQARRLREKLEGYLDEHPTFTLKKMMLSGSLAKGTALRSLNDIDVACYVSGADAPADIRALLDYVAERLRKAFPNFSPDQVQPQTYSVTVSFRGSGLDVDVVPILYDGDQNWYGNLVSQDDGSFLKTSIPLHLEFASKRKRCQEKHFAQVVRLAKFWARRMKQERDGFRFKSFMIEMVLAKLCDDGLDFSDYPEALQHFFTYIARSDFRERIVFTDYYAASTVPSLSDMVQIIDPVNAANNVARLYTAANADGIVDAALDAGDAIDSALAAPTKQLTVAYWQKVFGSSFQP

SEQ ID NO: 3650 - protein, 316 aa, Methylobacterium sp.
MTRQHVGHGEIAAFAEDRVNLPREKANEYRAQARRLRERLEGYLSEHPDFTLRKMMLSGSLAKGTALRSLNDIDVACYISGADAPHDVQALLEFLAARLRKAFPNFSPEQVTPQTYSVTVSFRGSGLDVDVVPILYDGDPDWYGNLVGQDDGSFLRTSIPRHLEFAKTRKRRQEKHFAQVVRLVKFWSRRMKQERDGFRFKSFMIEMVLAKLCDDGLDLSDYPEALQHVFTYIARSDLRQQIVFGDYYPASSVGACVDVVRIFDPVNARNNVARLYTDANADMIVEAALDAGDAIDAALGAPTKQLTVAYWQKVLT

SEQ ID NO: 3651 - protein, 321 aa, Bosea vaviloviae
MGRQHVDHGEIAAFAQDRVNLPKSIADEYRAQARRLREKLEGYLEEHPDFTLRKMMLSGSLAKGTALRSLNDIDVACYISGANAPKDVAALLAYLAERLRKAFPNFSPEQVQPQTYSVTVSFRGSGLDVDVVPILYDGDPSWYGNLVSQDDGSFLKTSIPLHLEFASKRKRAQERHFAQVVRLVKFWARRMKQEREGFRFKSFMIEMILAKLCDDGVDLSDYPEALQSFFTYLADGDLRQRIVFGDYYAPSTVPASSDRAQIIDPVNAANNVARLYTDANADAIVEAALDAGDAIDAALSAPTKQLTVGYWQKVFGSTFSA

SEQ ID NO: 3652 - protein, 321 aa, Rhizobiales bacterium
MGRQHVGHNEIAAFAQDKVNLPRDKADEHRAQARRLREKLDGYLNEHPDFTLRKMLLSGSLAKGTALRSLNDIDVACYISGADAPKDVQALLDYLAERLRKAFPNFSTDQVKPQTYSVTVSFRGTGLDVDVVPILYDGDPQWYGNLVSQDDGSFLKTSIPLHLEFAAKRKRCQETHFAQVVRLAKFWARRAKQEREGFRFKSFMIEMVLAKLCDQGLDLSDYPEALQHFFTYIARSDFRERIVFSDYYKPATVGSLSDEVQIIDPVNATNNVARLYTAENADTIVDLALDAGDAIDAALAAPTKQEAVYYWQKVFGSSFQA

SEQ ID NO: 3653 - protein, 321 aa, Henriciella sp.
MSRDHVGHREIEQFATDRVNLPKEKANEYRAQARRLREKLEGYLDEHPNFTLRKMLLSGSLAKGTALRSLNDIDVACYVSGADAPRDIEELLNYIAERLRKAFPNFSPDQVQPQTYSVTVSFKGTGLDVDIVPILYSGDPQWYGDLVSQEDGSFLKTSIPLHLEFATKRKKAQETHFAQVVRLVKFWARRLKNENPDFRFKSFMIEMIMAKLCDNGLNLSDYPEALQQFFTYIARNNLRERIVFADYYPPSSVGPLGHPVQIIDPVNAENNVARLYTPSNVDMIVEAALDAGDAIDAALAAPTKQLTVAYWQKVFGSTFQV

SEQ ID NO: 3654 - protein, 321 aa, Salipiger mucosus
MSRDHVGHREIEQFATDRVNLPKEKANEYRAQARRLREKLEGYLDEHPDFTLRKMLLSGSLAKGTALRSLNDIDVACYVSGADAPRDVDELLNYIAERLRKAFPNFSPDQVQPQTYSVTVSFKGTGLDVDIVPILYSGDPRWYGDLVSQEDGSYLKTSIPLHLEFARKRKKAQETHFAQVVRLVKFWARRLKNEDPDFRFKSFMIEMIMARLCDDGLDLSDYPEALQHFFTYIARSSLRERIVFADYYPPSSVGSLGDPVQIIDPVNAENNVARLYTPSNANMIVEAALEAGDAIDSALAAPTKQETVAYWQKVFGLTFQV

SEQ ID NO: 3655 - protein, 321 aa, Rhodospirillales bacterium
MSRLHVDHADLVCFAEDKVNLPRDKAQEYRAQARRLREKLEGYLAEHPDFTLKKMMLSGSLAKGTALRSLNDIDVACYISGASAPSDIAALLEYLAERLRKAFPNFSHDQVQPQTYSVTVSFRGSGLDVDVVPILYDGDPQWYGNLVSQEDGSFLKTSIPLHLEFAGKRKTAQPTHFAQVVRLAKYWTRIMKRERDGFRFKSFMVEMVLAHLADGGADFSDYPEALQHFFTYIARSDFRERIVFSDYYAPHTVGSFTEPVQIIDPVNAKNNVSRLYTAQQADMIVEAALDAGDALDAALAAPTKQETVYYWQKIFGSSFQV

SEQ ID NO: 3656 - protein, 321 aa, Rhizobium sp.
MSRLHVDHADLVGFAEDKVNLPRDKAQEYRAQARRLREKLEGYLAEHPDFTLKKMMLSGSLAKGTALRSLNDIDVACYISGASAPSDVAALLEYLAERLRKAFPNFSPDQVQPQTYSVTVSFRGSGLDVDVVPILYDGDPQWYGNLVSQEDGSFLKTSIPLHLEFAGKRKTAQPTHFAQVVRLAKYWTRIMKRERDGFRFKSFMVEMVLAHLADGGADFSDYPEALQHFFTYIARSDFRERIVFSDYYASRTVGNFTEPVQIIDPVNVRNNVSRLYTAQQADMIVAAALDAGDALDAALAAPTKQETVYYWQKIFGSSFQV

SEQ ID NO: 3657 - protein, 321 aa, Ochrobactrum intermedium
MSRIHVDHAALVRFAEEKVNLPREKAEEYRAQARRLREKLDGYLAEHPDFTLRKMMLSGSLAKGTALRSLNDIDVACYISGGSAPRDVAALLEYLAERLRKAFPNFSPDQVKPQTYSVTVSFRGTGLDVDVVPILYDNDPQWYGNLISQEDGSFLKTSIPLHLDFAARRKAAQKPHFAQVVRLAKYWTRIMKREREGFRFKSFMVEMILAHLQDAGADFSDYPEALQHFFTYVVRSDFRECIVFSDYYPASRVGTFTDRVQIIDPVNAENNVSRLYTPREADMIVDAALDAGDAIDAALAAPTKQETVYYWQKVFGSSFQV

SEQ ID NO: 3658 - protein, 321 aa, Sinorhizobium sp.
MSRLHVDHADIVRFAEDRVNLPADKALEYRAQARRLRERLESYLSEHPDFSLRKMLLSGSLAKGTALRSLNDIDVACYVSGANAPHQVSELLEYLAERLRRAFPNFSPDQVKPQTYSVTVSFKGTGLDVDVVPILYDGDPNWYGNLVSQDDGSFLRTSIPRHLEFAAKRKAAQKVHFAQVVRLAKFWTRIMKRERDGFRFKSFMVEMVLAHLQDKGADFSDYPNALQEFFTYIATSNFRERIAFGDYYSLSSIGKLSDPVQIIDPVNAENNVSRLYTSQQADMIVEAALDAGDAIDAALAAPTKQLTIYYWQKVFGSTFQV

SEQ ID NO: 3659 - protein, 321 aa, Xanthomonas fuscans
MGRHHVGHKELAAFAEDKVNLPHDKALELRAQARRLREKLQEYVGEHPDFTLKKMQLSGSLAKGTALRSLNDIDVACYISGAEAPQDVSALLEYLAARLRKAFPNFRPEQVKPQTYSVTVSFLGSGLDVDVVPILYSGDPQWFGNLVSQDDGSFLRTSIPLHLDFAKTRKQRQEKHFAQVVRLVKFWARRMKAENEGFRFKSFMIEMVLAKLCDEGRDFSDYPEALQHFFTYLARSNFRERIAFSDYYPASSIPSFSEPVRIIDPVNADNNVARLYTSAHADAIVDAALDAGDAIDAALAAPTKQETVRYWQKVFGSAFQG

SEQ ID NO: 3660 - protein, 321 aa, Rhizobiales bacterium
MSREHVGHRDIVTFAEERVNLPQDKAQEYRAQARRLREKLEAYVGEHPDFTLRKMMLSGSLAKGTALRTLNDIDVACYISGADAPHSVTELLTYLAERLRKAFPNFAPDQVKPQTYSVTVSFRGSGLDVDVVPILYDDDPQWYGNLVSQDDGSFLETSIPLHLDFAGRRKKVQPKHFAQVVRLVKFWARRQKAERDGFRFKSFMIELILAKLCDDGLDLSDYPEALQHFFTYVATSGLTERIAFSDYYPVSTIGAFSDPMRIIDPVNAANNVSRLYTAANMDGIVDAALDAGDAIDAALAAPTKQLTVGYWQKVFGSTFQV

SEQ ID NO: 3661 - protein, 321 aa, Novosphingobium naphthalenivorans
MSRDHVGHRDILRFAEERVNLPRDKAQEYRAQARRLREKLEAYVGEHPDFTLRKMMLSGSLAKGTALRSLNDIDVACYISGAEAPHSVSELLAYLAERLRKAFPNFSPDQVQPQTYSVTVSFRGSGLDVDVVPILYGGDTQWYGNLVSQEDGSFLKTSIPLHLEFAGRRKKAQEKHFAQVVRLVKYWAKRQKQERDGFRFKSFMIEMIMAKLCDDGLDLSDYPEALQHFFTYIATSGLKDRIAFSDYYPLSSIGSFSDPMRIIDPVNAENNVSRLYTTANMDDIVDAALDAGDAIDAALAAPTKQLTVAYWQKVFGSTFQV

SEQ ID NO: 3662 - protein, 321 aa, Acetobacter pasteurianus
MSRDYVGHCDIMRFAEERVNLPQDKAQEYRAQAWRLRDKLEGYVDEHPDFTLRKMILSGSLAKGTALRSLNDIDVACYISGADAPHSVSALLTYLAERLRKAFPNFSPDQVKPQTYSVTVSFRGSGLDVDVVPILYNGDAQWYGNLVSQEDGSFLKTSIPLHLEFARKRKKAQEKHFAQVVRLVKFWAKRQKQERDGFRFKSFMIEMIMAKLCDDGLDLSDYPEALQHFFTYIATSGLKDRIAFTDYYPLSSIGSFYDPIQIIDPVNAQNNVSRLYTTANRNDIVDAALDAGDAIDAALAAPSKQLTVGYWQKVFGSTFQV

SEQ ID NO: 3663 - protein, 321 aa, Rhizobium leguminosarum
MSREHVGHREILSFAEDRVNLPRDKAHEYRAQARRLREKLESYLDEHPDFTLRKMMLSGSLAKGTALRSLNDIDVACYISGADAPQSVSTLLTYLAERLRKAFPNFTADQVTPQTYSVTVSFRGSGLDVDVVPILYDGDAQWFGNLVSQDDGSFLKTSIPLHLEFAGKRKKAQEKHFAQVVRLVKFWARRQKQERDGFRFKSFMIELILAKLCDDGLDLSDYPEALQHFFTYIATSGLKDRIAFSDYYPLSTIGSFSEPMRIIDPVNALNNVSRLYTSGNMEDIVDAALDAGDAIDAALAAPNKQLTVGYWQKVFGSTFQF

SEQ ID NO: 3664 - protein, 321 aa, Agrobacterium vitis
MSREHVGHQEILSFAEERVNLPQDKAQEYRAQARRLREKLESYLDEHPDFTLRKMMLSGSLAKGTSLRSLNDIDVACYISGADAPHSVSALLAYLAERLRKAFPNFAADQVTPQTYSVTVSFRGSGLDVDVVPILYDGDPQWYGNLVSQDDGSFLKTSIPLHLEFAGKRKKAQEKHFAQVVRLVKFWARRQKQERDGFRFKSFMIELIMAKLCDDGLDLSDYPEALQHFFTYIATSGLKERIAFSDYYPLSSIGSFSEPMRIIDPVNAVNNVSRLYTGANMDDIVDAALDAGDAIDAALAAPNKQLTVGYWQKVFGSTFQV

SEQ ID NO: 3665 - protein, 321 aa, Agrobacterium tumefaciens
MSREHVGHREILSFAEERVNLPKDKAQEYRAQARRLRERLESYLDEHPDFTLRKMMLSGSLAKGTALRALNDIDVACYISGADAPQSVSALLTYLAERLRKAFPNFAADQVTPQTYSVTVSFRGSGLDVDVVPILYSGDPQWYGNLVSQDDGSFLKTSIPLHLEFAGKRKKSQEKHFAQVVRLVKFWARRQKQERDGFRFKSFMIELIMAKLCDEGLNLSDYPEALQHFFTYIATSGLKDRIAFSDYYPLSSIGAFSEPMKIIDPVNALNNVSRLYTVANMDDIVEAALDAGDAIDAALAAPSKQLTVGYWQKVFGSTFQV

SEQ ID NO: 3666 - protein, 321 aa, Rhizobium phaseoli
MSREHVGQREILSFAEERVNLPQEKAQEYRAQARRLREKLESYLDEHPDFTLRKMMLSGSLAKGTALRSLNDIDVACYISGADAPHSVNALLAYLAERLRKAFPNFAADQVTPQTYSVTVSFRGSGLDVDVVPILYDGDPQWYGNLVSQDDGSFLRTSIPLHLEFAGKRKKAQEKHFAQVVRLVKFWARRQKQERDGFRFKSFMIELIMAKLCDDGLDLSDYPEALQHFFTYIAMSGLKDQIAFSDYYPLSSIGSFSEPMRIIDPVNAVNNVSRLYTGANMDNIVDAALDAGDAIDAALAAPNKQLTVGYWQKVFGSTFQV

SEQ ID NO: 3667 - protein, 321 aa, Unknown
  Description of Unknown: Methylomonas sequence
MSRDHVSHKEIASFAEDKVNLPQDKATKYREQVWRLREKLESYINEHPDFTLKKMLLSGSLAKGTALRSLNDIDVACYISGADAPHDIAKLLDYLAERLRKAFPNFSPDQVQPQTYSVTVSFRGTGLDVDVVPILYDGDPNWYGNLVSQEDGSFLKTSIPLHLEFAAKRKRCQQKHFAQVVRLAKFWAQRMKQEHEGFRFKSFMIEMILAKLCDQGANFSDYPEALQQFFTYIAQSNFRELIAFDDYYRLSTIPKCSDVVRIIDPVNAENNVSRLYTNKNADQIVDLALEASEAIDAALYAPTKQETVYYWQKVFGPSFQV

SEQ ID NO: 3668 - protein, 321 aa, Unknown
  Description of Unknown: Rhodanobacter sequence
MGKQHVGHREIASFADDRVNLPRDKANELRAQARGLRERLETYLAEHPDFTLRKMLLSGSLAKGTALRSINDIDVACYINGADAPQDVGRLLDYLAARLRKAYPNFKPEQVKPQTYSVTVSFQGSGLDVDVVPILYDGDPNWYGNLVSQDDGSFLSTSIPRHLEFAKKRKQAQEIHFAQVVRLVKFWARRMKAENSNFRFKSFMIEMILAKLCDDGLSFSDYPEALQHFFTYAARSGLREQIAFKDYYPLSSIGTFSEPVQIIDPVNVANNVSKLYTRAQADAIVDAALDAGDAIDAALKAPTKQETVRYWQKVFGSSFQV

SEQ ID NO: 3669 - protein, 321 aa, Sphingomonas asaccharolytica
MSRQHVDHREIAAFAQDKVNLPKDWADSYRAQARGLRERLERYLDEHPDFTLKRMQLSGSLAKGTALKTLNDIDVACYVSGANAPHEISALLEYIAERLRKAYPNFSPDQVKPQTYSVTVSFKGSGLDVDVVPILYDGDPQWYGNLVSQDDGSFLKTSIPLHLDFCKKRKQAQEKHFAQVVRLVKFWARRMKAEDSNFRFKSFMVELILAKLCDEGLDFSDYPDALQHFFTYVARTGMREKIVFTDCYAASKVGTFTDPVEIIDPVNEVNNVSRLYTSANADLIVNAALEAGDAIDSALYAPTKQETVRYWQKVFGPSFQV

SEQ ID NO: 3670 - protein, 321 aa, Nitrospira sp.
MAREHVNHSDLVRFAQEKVNLPKDRADAYRTQARGLRDKLENYLNEHPDFTLKKMMLSGSLAKGTALRTLNDIDVACYISGADAPNDVAALLQYLAERLRKAYPNFSPDQVKAQTYSVTVSFRGTGLDVDVVPILYTGDPQWRGNLVSQDDGSFLETSIPLHLDFTRKRKDAQETHFAQTVRLIKFWAQKMKRENQDFRLKSFMIEMILAHLSDKGLKFSDYPEALQHFFTYVAKTNLHERIVFEDYYKSSQVGSFKEPVQIIDPVNAKNNVSRLYTTTQVTAIVDAALDAGDAVEAALRAPTKQETVYYWQKVFGSTFQI

SEQ ID NO: 3671 - protein, 321 aa, Methylobacterium variabile
MGRQHVGHGEIAAFAQDRVNLPKEKADEYRAQANRLREKLEGYLREHPDFTLKKMLLSGSLAKGTALRSLNDIDVACYISGADAPSDVQELLDYLAARLRKAFPNFSPDQVKPQTYSVTVSFRGSGLDVDVVPILYSGNPNWYGNLVSQDDGSFLKTSIPLHIAFAAKRKKAQEKHFAQVVRLVKFWARRMKAEHDGFRFKSFMIEMVLAKLCDDGLNFADYPEALQNFFTYLAKSEVRERIVFSDYYNPLTVGTLFDEVQIIDPVNSANNVARLYTAANADAITEAAYDAGDAIDAALAAPTKQLTVAYWQKVFGSSFQA

SEQ ID NO: 3672 - protein, 321 aa, Stenotrophomonas maltophilia
MGTQHVGHRELVNFADDRVNLPRDKANELRAQARGLRERLETYLGQHPDFTLRKMILSGSLAKGTALRSLNDIDVACYISGADAPKDIGRLLEYLAERLRKAYPNFKPEQVKPQTYSVTVSFQGSGLDVDVVPILYDGDPDWYGNLVSQDDGSFLRTSIPRHLEFAKRRKQLQPSDFVQVVRLVKFWARRMKTEVPGFRFKSFMIEMILAKLCDEGRDFSNYPEALQHFFTYVAQSGLREQIAFQDYYPTAIIAAFSEPMQIIDPVNEKNNVAKLYGHAQVDAIVEAALDAGDAIDAALAAPTKQETVRYWQKVFGSSFQA

SEQ ID NO: 3673 - protein, 320 aa, Xanthomonas campestris
MARQHIDHPDLVAFAEARVNLPHEDAKVLRAQARGLREKLEGYLRDHPDFSLKKMLLSGSLAKRTALRSLNDIDVACYISGADAPADRARLLEYLAERLRKAYPNFNPDQVQPQTYSVTVSFRGSGLDVDVVPILYNDDPQWFGNLVSQEDGSFLKTSIPLHLDFAKARRNASPHFAQVVRLIKFWARLQKQANPDFRFKSFMIELIVTKLADDGADLSDYPEALQAFFTYLVRSGLRDRIAFSDFYALSTIPASGDRVQIIDPVNASNNVARLYTPANADLITDAALDAGEAIDAALASPTKGETVRYWQKVFGPAFQG

SEQ ID NO: 3674 - protein, 321 aa, Burkholderia ambifaria
MSQEHVSHADIVRFAQDRVNLPKDKADVFRAQAKRLRERLETYLTEHPDFTLKKMLLAGSLAKGTALRSLNDIDVACYISGAEAPHDVSALLEYLADRLRRAFPNFSADQVKPQTYSVTVSFKGTGLDVDVVPILYDGDPNWYGNLISQDDGSFLKTNIPLHLEFIRKRKRAQPEHFSQVVRLVKFWAARMKAADDNFRFKSFMIELLLAKLADDGLSFSDYPEALQHFFTYLARTDLQEKVLFTDNYPASAIGTFSQRVQIIDPVNALNNVSRLYTDANASAIYEAAIDAGDAIDSALSAPTKQETVYYWQKVFGSAFQG

SEQ ID NO: 3675 - protein, 321 aa, Burkholderia vietnamiensis
MSQEHVSHAEIVRFAQDRVNLPKDKADVFRAQARRLRERLETYLTEHPDFTLKKMLLAGSLAKGTALRSLNDIDVACYISGAEAPHEVSALLEYLAERLRRAFPNFTADQVKPQTYSVTVSFKGTGLDVDVVPILYDGDPNWYGNLISQDDGSFLKTNIPLHLEFIRKRKRVQPEHFSQVVRLVKFWAARMKAADENFRFKSFMIELLLAKLADDGLSFSDYPEALQHFFTYLARTDLKEEVFFTDNYPASAIGTFSQRVQIIDPVNGLNNVSRLYTDANASAIYEAAIDAGDAIDSALSAPTKQETVYYWQKVFGSAFQG

SEQ ID NO: 3676 - protein, 321 aa, Comamonas badia
MSRTHIDHRDLMRFAADRVNLPKDKADEYRAQARRLREKLEGYLSEHPDFTLKKMLLAGSLAKGTALRSLNDIDVACYISGAQAPREVSALLEYLAERLRKAFPNFSADQVKPQTYSVTVSFKGSGLDVDVVPILYDGDPNWYGNLISQDDGTFLKTNIPQHLEFIRKRKRAQPDHFSQVVRLVKFWAARMKAADDNFRFKSFMIELLLAKLADDGLSFSDYPEALQHFFTYLARTDLREKVFFTDNYPASAVGTFSQRVQIIDPVNAVNNVSRLYTDANASAIYEAALDAGDAIDSALSAPTKQETVYYWQKVFGSAFQG

SEQ ID NO: 3677 - protein, 320 aa, Methylibium sp.
MSREHVNHTEIARFAQDRVNLPKVKADEFRAQAKRLRDRLETYLGEHPDFTLKKMLLAGSLAKGTALRSLNDIDVACYISGAAAPHEVSALLEYLAERLRKAFPNFSPDQVKPQTYSVTVSFRGTGLDVDVVPILYDGDPNWFGNLVSQDDGSFLKTNISQHLEFIRKRKRAQPDHFSQVVRLVKFWAARLKADEAFRFKSFMIELILAKLADQGQSFADYPESLQHFFTYLARTDLRERIFFTDNYPASSVSNFSQRVQIIDPVNAVNNVSSLYTDANASAIYEAAIDAGDAIDAALSAPTKQETVYYWQKVFGPSFQG

SEQ ID NO: 3678 - protein, 321 aa, Cupriavidus taiwanensis
MSREHVSHAEVARFAQDRVNLPKEKADEYRAQAKRLRDRLETYLSEHPDFTLKRMMLAGSLAKGTALRSLNDIDVACYISGAEAPRDIAALLEYLAVRLRKAFPNFSPDQVQPQTYSVTVSFRGTGLNVDVVPILYDGDANWYGNLVSQDDGSFLKTNIPLHLEFIRKRKRAQPDHFSQVVRLIKFWAARMKAADEGFRFKSFMIELILARLCDQGLSFDDYPEALQHFFTYLARTDLRETIVFTDNYPASSVETFNHRVKIIDPVNGANNVSRLYTDANASAIREAALDAGDAIDSALAAPTKQETVYYWQKVFGPSFQG

SEQ ID NO: 3679 - protein, 321 aa, Steroidobacter denitrificans
MSRGHVSHTEIARFAQNRVNLPKEKADEFRAQAKRLRDRLETYLSEHPDFTLKKMMLAGSLAKGTALRSLNDIDVACYISGTDAPRDVVALLEYLAVRLRKAFPNFSPDQVQPQTYSVTVSFRGTGLDVDVVPILYDGDPNWYGNLVSQDDGSFLNTNIPLHLEFIRKRKRAQPDHFSQVVRLIKFWAARMKAADEGFRFKSFMIELILAHLCDQGLSFADYPEALQHFFTYLARTDLREKIVFTDNYPASSVEAFNHRIQIIDPVNAANNVSQLYTDANASAIYEAALDAGDAIDSALAAPTKQETVYYWQKVFGTSFQG

SEQ ID NO: 3680 - protein, 321 aa, Unknown
  Description of Unknown: Acinetobacter sequence
MTREHVSHQDIARFAQERVNLPKEKANEFRAQAKRLRDRLENYLSEHPDFTLKKMMLAGSLAKGTALRSLNDIDVACYISGADAPRDVNTLMEYLAERLRKAFPNFSPDQVQPKTFCVTVSFRGSGLDVDVVPILYDGNPNWYGNLVSQDNGSFLMTNIPYHLEFIRKRKQAQPEHFSQVVRLIKFWAARMKAANEGFRFKSFMIELILAHLCDRGLSLADYPEALQHFFTYLAKTDLKEKVLFTDYYPASTVENFNTRVQIIDPVNASNNVSQLYTDSNASAIYEAALDAGDAIDAALSAPTKQETVYYWQKVFGASFQG

SEQ ID NO: 3681 - protein, 321 aa, Acinetobacter baumannii
MTREHVSHKDIARFAQERVNLPKVKADEFRAQAKRLRDKLETYLGEHPDFTLKKMLLSGSLAKGTALRSLNDIDVACYISGADAPHDVKLLLEYLATRLRKAFPNFSPDQVKPQTYSVTVSFRGSGLDVDVVPILYDGNSSWYGNLVSQDDGSLLKTNIPLHLEFMRKRKQAQPEHFSQVVRLIKFWAARLKATNENFRFKSFMIELILARLSDQGLSFNDYPEALQHFFTYLAQTDLQELILFTDNYPASSIGNFNDRIQIIDPVNALNNVSRLYTEVNANAIYEAALDAGDAIDSALAAPTKRETVYYWQKVFGSSFQG

SEQ ID NO: 3682 - protein, 320 aa, Bosea sp.
MARDHVNHGEIVRFCQEKVNLPKDKADTYRAQADRLRDRLDTYIAEHPDFTLKKMRLSGSLAKGTALRSLNDIDVACYISVKDAPSDTRTLGTYLAERLRRLPNISPDQIKPQTYSVTVSYSGSGLDVDVVPILYDGDPNWYGDLVSQKDGSLLRTSITRHVQFAQKRKSASPTHFAQVVRLAKFWAKRKKDESEDFRFKSFMIELIMAHLADRGLDMSDYPTALRGFFDYIAQTGLTEKIVFADYYQSGTVGAFPHPMQIIDPVNAANNVSSLYTQRNVDLIVDAALEAGDAIEAALGAPTKGETVRYWQNVFGSSFNP

SEQ ID NO: 3683 - protein, 286 aa, Acinetobacter sp.
MREKLEGYISEHQDFSLKRLQLSGSLAKGTALRTLNDIDMAVYISGANAPHQINELLDYLAEKLRKAFPNFTPEQVQPQTYSVTVSFRGSGLDVDVVPILYNGKPDWRGNLVSQDDGSFLETSIPLHLDFARKRKNVHPTHFAQVVRLVKFWARRMKQEQEGFRFKSFMIELILAKLCDRGVDFSDYPEALQSFFTYIATSNLSELIFFEDNYKKSDISDFNDPMKIIDPVNPSNNVSNLYDRNNINKIVEAAMDAGDAIDAALTAPTKHETVYYWQKVFGPSFQG

SEQ ID NO: 3684 - protein, 321 aa, Unknown
  Description of Unknown: Acinetobacter sequence
MSKEHVSHSTLVRFAEEKVNLPKDKANEYRAQARRLREKLEGYISEHQDFSLKRLQLSGSLAKGTALRTLNDIDMAVYISGANAPHQINELLDYLAEKLRKAFPNFTPEQVQPQTYSVTVSFRGSGLDVDVVPILYNGKPDWRGNLVSQDDGSFLETSIPLHLDFARKRKNVHPTHFAQVVRLVKFWARRMKQEQEGFRFKSFMIELILAKLCDRGVDFSDYPEALQSFFTYIATSNLSELIFFEDNYKKSDISDFNDPMKIIDPVNPSNNVSNLYDRNNINKIVEAAMDAGDAIDAALTAPTKHETVYYWQKVFGPSFQG

SEQ ID NO: 3685 - protein, 321 aa, Methylophaga sp.
MSRTHVSHKEIAAFAQNKVNLPQDIANKYRAQARQLREKLENYLNDHPDFTLRKMLLSGSLAKGTALRTLNDIDVACYVSGADAPSDISKLLDYIAEKLRKAFPNFSPDQVKPQTYCITVSFKGTGLDVDIVPILYYGDDKWYGNLISQDDGSFLKTSIPLHLDFIKKRKQANQHDFSQVIRLIKFWARKEKREKEGFRFKSFMIELILAKLSDNGTDFSDYPEALQSFFTYIASTDMRELIVFSDYYAPNKVGSITTPVKIIDPVNELNNVSELYTAAQANMIVDAALEAGDAIDAALSATTKQDTVYYWQKVFGPSFQM

SEQ ID NO: 3686 - protein, 321 aa, Spongiibacter sp.
MSRTHVDHRDIASFAQNKVNLPQDKANKYRAQARQLREKLENYLNDHPDFTLKKMMVSGSLAKGTALRTLNDIDVACYVSGADAPSDIPKLLDYIAEKLRKAFPNFTPDQVKPQTYCITVSFKGTGLDVDIVPILYYGDDNWYGNLVSQDDGSLLKTSIPLHLDFIKKRKQKHDQHYSQVVRLIKFWARKEKRERDGFRFKSFMIELILAKLSDNGTNFSDYPEALQSFFTYIATTDMRELIVFDDYYSKDKVGPVTTPVKIIDPVNEVNNVSELYTAAQADMIVDAALEAGDAIDSALSATTKQDTVYYWQKIFGPSFQA

SEQ ID NO: 3687 - protein, 321 aa, Mucilaginibacter sp.
MAREHVGHNEIAQFAKDRVNLPKDKADEYRAQAGRVREKVTGYLNDHPDFSLKKILLSGSLAKGTALRTINDIDMACYISGSEAPKDISALITYLAEKLRNAFPNLSPDQVQPKTYSVTISFRGSGLDVDVVPILYFGDKDWYGCVVSQDDGSLLETCIPRHLDFIRSRKQKQETHFAQVIRLAKYWVRLMKTERSGFRFKSFMVELVMSKLLDKGVDFSDYPEALQSFFTYLATSNLDELIVFYDYYKASDVPVFTNPIKVIDPVNPKNNAAKLYPRAQADEIVDAAIDAGDAIDSALSATTKEKTVYYWQKVFGTTFNV

SEQ ID NO: 3688 - protein, 321 aa, Mucilaginibacter sp.
MGRIHVSHDDIAQFAKDRVNLPKDKADTYRAQAARVREKVTEYVDDHPDFKLRKILLSGSLAKGTALRTLNDIDMACYISGSDAPHDIKALLEYLADKLRKAFPNMAPEQVQPKTYSVTISFRGSGLDVDVVPILYYGDVNWYGCVVSQDDGSLLETCIPRHLEFIRTRKAKQKDHFSQVIRLAKYWVRNIKAENSDFKFKSFMVELIMSKLLDDGLNFSDYPEAMQSFFTYLAKSDLKEIISFSDYYRASEIPSFGERVRIIDPVNPKNNASKLYTTNQANAIIDAALDAGDAIDAALSATTKEKTVYYWQKIFGPSFQV

SEQ ID NO: 3689 - protein, 320 aa, Gilliamella bombi
MSRLHVDHKYIKKFAEEKVNLKADFVKKYRDQAGRLKEKLENYLKEHEDFSLKKILMSGSLAKGTSLKIINDIDLACYISGADVPRDVDALLKYLEDKLKVAFPNFSPDQVKRQNYSICVSFRRTGLDVDIVPILYDGDPNWYGCLVSKANGEFLETCIPRHLEFVRTRKANDPHFAQVVRLIKFWARKQKNEDPDFRFKSFMIELILAYLSDKGQNLSDYPEALQSFFTYIARTNLEEQISFTDYYDESKLSKFSDIVQIIDPVNSKNNAAKLYSRKNVDKIVDAALDAGDAIDAALAAPTEEKKLYYWQKVFGSTFTV

SEQ ID NO: 3690 - protein, 321 aa, Roseobacter sp.
MSRDHIGHAEIAKFGTDKINLPKDKADKFRMQARNLRDKLEGYLKDHPDFALRKMLLSGSLAKGTGLRTLNDIDVGCYISGSDVPSDIDALMEYLAERLRKAFPNFKPEQVQPKTYCVTVSFLGSGLDVDIVPILYDGDPDWYGNLVNQEDGSFLRTCVPRHLEFIRKRKTLADKDFAQVIRLVKYWVRKEKREKDGFRFKSFMAEMVLSKMLDEGQDFSDYPEALQAFFSYIANSGLNERIIFDDYYPKSTAKVFGTPVEIIDPVNAENNVSQLYTQAQADDIVDAALDAGDAIETALRCPTKQDTIRHWQRVFGSAFQG

SEQ ID NO: 3691 - protein, 321 aa, Aquimarina megaterium
MGREHVSQKDMANWAVNTVNLPSDKAKEYRAQANRLREKLKNYLNDHPDFVLKRMIISGSLAKSTALRSINDIDVGCYIKVDSAPSSIKELLDYLAEKLRKAFPNFSPDQVVPQTYSVQVSFKGTGLDVDIVPILYYDDPDWYGDLVSQEDGSFLKTNIPFHIEFIKARKSKNNPHFAQVIRLAKYWARNLKNENPKFKFKSFMIELIFAKLADNGRDFSDYPEALQSFFTYVAKTDIREQISFNDYYPYSSIGSFSEPVQIIDPVNEENNAAKLYTKAQADLIVDAAIDAGDAIDAALAATTKEKTVYYWKKVFGPTFHI

SEQ ID NO: 3692 - protein, 321 aa, Terriglobus roseus
MSREHVTHRDIVQFAEERVNLKRDDALELRRQANLLRDRLQTYLADHPDFELRKMLLSGSLAKGTALKSVSDIDVACYVSSDTAPHKVSDLIAWLASRLEKAFPNFKPEQIQRKTYSVAVNFITTGNEVDIVPILYKGDPQWKGSLISQDTGEELMTSVPMHLEFLRKRKDANKTHFAQVVRLIKFWAKLQKQADENFRFKSFMTELIVAHLADNGMALNDYPTALSRFFNFLACDGLKSTITFSDYYKTSDCEVTSDPIRIWDPVNCQNNVAKLYKESNRDLLIEAALDAGDAVEAALRATTKGETVRYWQKVFGPTFSA

SEQ ID NO: 3693 - protein, 321 aa, Unknown
  Description of Unknown: Phenylobacterium sequence
MTKEHVGHGDILRFADERVNLKREDATDLRAQANRLRERLETYLAEHPDFELRKMMLSGSLAKGTALKSISDIDVACYVSSASAPHKVSELVDWLATRLEKAFPNLKPEQIKRKTYSVSVNFITTGNEVDIVPILYAGDPQWRGDLVSQDDGSTLMTSVPLHLEFIRKRKAANDKHFAQMVRLVKFWAGRLKAEDPDFRFKSFMIELILAHLADQGVALNDYPEALSSFFTFIATDAFRTTIAFADYYDPKTCVTTPAPMRVWDPVNCENNVSRLYTAVNRDKLVDAALLAGDAIDAALYATTKSETVRLWQKVLGPSFNP

SEQ ID NO: 3694 - protein, 323 aa, Mesorhizobium ciceri
MSREHVGHRDIVLFADSRVNLKREDASELRAQANRLRDKLEGYLVDHPDFGLKKMLLSGSLAKGTALKSISDIDVACYVATESAPHSIRDLIEWLAKRLETAFPNFKPSQITRKTYSVSVQFIATGNEVDIVPILYSGDPQWRGDLISQETGERLMTSVPMHLDFIRKRKAASPQHFAQVVRLIKFWSGLRKREDTSGNFRFKSFMIEMIVAHLADRGVVLDDYPEALQSFFTFLATDQLRSMISFTDYYPAGTCSPTSDPVSIWDPVNCENNVAKLYNTTNQALIVDAAIDAGDAIDAALRAISKGETIRYWQKVFGPSFDV

SEQ ID NO: 3695 - protein, 323 aa, Sphingobium sp.
MSREYVSHGEIARFADSRVNLKRDDATELRAQANRLRDKLEGYLVNHPDFGLKKMLLSGSLAKGTALKSISDIDVACYVASDSAPHSIRDLIDWLAKRLETAFPNFKPSQITRKTYSVSVQFIATGNEVDIVPILYSGDPQWRGALVSQDTGEQLMTSVPMHLDFIRKRKAACPQHFAQVVRLIKFWAGLRKREDITGNFRFKSFMIELIVAQLADRGVSLNDYPEALQSFFTYLATDQLRSVIAFTDYYPAGTCRSTSDPVQIWDPVNCENNVAKLYTTTNQALIVDAAIDAGDAIDAALRAISKSETIRYWQKVFGPSFDA

SEQ ID NO: 3696 - protein, 321 aa, Devosia sp.
MSREHVTHSDIVRFADERVNLKREDAKELRRQANMLRDKLTTYLNDHPTFVLRKMLLSGSLAKGTALKSISDIDVGCYIDADSAPGRIAELIPWLAEKLRTAFPNFRPDQVTPKTYSVGVKFITTGNEVDLVPIFYRGDPQWRGDLVSQDTGETLMTSIPMHLDFIRNRKNENDVHFAQMVRLIKYWAKLRKQEDEGFRFKSFMVEMIVAHLADLGAVLSDYPEALQTVFTFLASDEFRTTIAFNDYYDPKVCAKTTDPIRIWDPVNCENNVAVLYTPSNRDKIIDAAMDAGDAIDSALHSPTKGETVRYWQKVFGPSFTA

SEQ ID NO: 3697 - protein, 321 aa, Unknown
  Description of Unknown: Mesorhizobium sequence
MSRDHVSHADLVRFADERVNLKRDDAADLRAQANRLRDRLETYLADHPDFALRKMMLSGSLAKGTALKSISDIDVGCYVSSDSAPDKISDLIDWLAKKLETAFPNFRPEQIKRKTYSVGVHFITTGNEVDIVPILYAGDPQWRGDLVSQDTGEKLMTSVPMHLEFIRKRKSANDKHFAQVVRFVKFWSQLIKQQDENFRFKSFMIELIVAYLADRGLALNDYPSALGKVFAFIANGDFETAIAFSDYYNPAICAATGAPVRIWDPVNNKNNVSALYTQQNKEKIVEAALDAGDAIDSALRAITKGETVRYWQKIFGPTFNV

SEQ ID NO: 3698 - protein, 321 aa, Mesorhizobium sp.
MSRDHVSHAELVRFADERVNLKRDDAADLRAQANRLRDRLETYLADHPDFALRKMMLSGSLAKGTALKSISDIDVGCYVSSDSAPDRISDLIDWLAKKLETAFPNFKPEQIKRKTYSVGVNFISTGNEVDIVPILYAGDPQWRGDLVSQDTGEKLMTSVPMHLEFIRKRKTANDKHFAQIVRFVKFWSQLIKQQDENFRFKSFMIELIVAYLADRGLALNDYLSALGEIFAFIANDDFETAIAFADYYNPATCAATGAPVRIWDPVNNKNNVSALYTQQNKEKIVEAALDAGDAIDSALRAISKGETVRYWQKIFGPTFNV

SEQ ID NO: 3699 - protein, 321 aa, Mesorhizobium sp.
MSRDHVSHADLVRFADERVNLKRDDAADLRAQANRLRDRLETYLADHPDFALRKMMLSGSLAKGTALKSISDIDVGCYVSSDTAPEKISDLIDWLAKKLEKAFPNFKPEQIKRKTYSVGVTFIATGNEVDIVPILYAGDPQWRGDLVSQDTGEKLMTSVPMHLEFIRKRKSANDKHFAQVVRFMKFWSQLRKQQDENFRFKSFMIELVVAYLADHGLALNDYPSALSKVFASIANDDFETAIAFADYYNPATCVATGAPVRIWDPVNHKNNVSALYTQQNKEKIVEAALDAGDAIDSALRAITKGETVRYWQKIFGPTFNM

SEQ ID NO: 3700 - protein, 210 aa, Armatimonadetes bacterium
MSITIAPRIAHSDIRQFAEDRVNLPAEIAKERRQKVNELRERLAKWMKDHPDCGIAKSYLSGSLAKGTALKTSSDVDVALYINYDGEKKADRRLADWIAERLRKAYPQMRPEQIEPQEYSVKIKYKEAGVDVDIVPVFYEGNPQDKGWLVSKKSGRLMLTSIPMHLAFTRKRKDAQPQHFAQVVRLVKWWAAEQKGADASFRLKSFMGGN

SEQ ID NO: 3701 - protein, 330 aa, Leptolyngbya valderiana
MPNTPQSLIDPAVTHTTVRQFAEDKVNLPSETAKKRREKVNDLRERLANYLKEHPDCGIVKSYQSGSLRKGTALKTGSDVDVAVYIKSNGDMRVNRELLEWIAERLRKAYPTMKPEQIQPKTYSVGIEYRDAGIEIDVVPVFCDKAEDTSGYLVSQDDGSLLMTDIPRHMEFIRTRKDRQPTHFAQAVRLVKWWVREQKLLRGEAFRFKSFMVELIFAHLADSGQDLSDYPVSMQAFFNYIVDTGLRERIAFTDYYAASKLPTNCTDPVQIFDPVNPDNNVAALYTEQNRRLIVEAAQDALDALNEAHMSATKGEAVAMWQVVLGKSFRG

SEQ ID NO: 3702 - protein, 327 aa, Verrucomicrobia bacterium
METINFLEREISQGDITAFAQTKVNLSKERADKYREKVNILRDHLERYISEHEDVGLVKMLLSGSLKKGTALRTINDIDVALYVKGNSAPRELGPLLQWLVERLRTTYHQIPPANIRIDGPCIVITYSEIGIDVDVAPVYYEGDPQWRGYLWDRQTGERILTSIPQHLEFIKRRKDKHSLYFAQTVRLLKWWARQRERDSQPLILRSFLIELLASKISDIGRNFSDYHEALEHFFQYVQKTGLKDRIAFADFYSLDKLPKNRIGIVEIFDPVNPENNVASHVTEQTRALFVQRADEALDALSYAKTCQTKGEAIECWQDIMGTTFDA

SEQ ID NO: 3703 - protein, 346 aa, Fluviicola taffensis
MNISNQAVIHRRLKCFVVYIATEKDTLDEIKIKAGEIRDCIESRSQRDGYTILDSPYSGSFAVRTGLRRSLRGNDEVEGQDVDIAFVLRDEDSSGNALNCMIDTFKEYLKERWPASEIGKSKSAANIHFKGMKQQFDIVPLIETKTTNIQKLIRSTGEKRQSSVFKHKEFVKSRNVESDKIAGVVHFNQCIRLIKWWRYKQQSDSTILGKGEGKTEVSSFLLNLLCSYAYDHCSVKPTYAETLARWFSLLYDVIYRKENIVFTDFIKHPKVDQNQFWSVLDPVDDTNNVVKKWGALEINELTDWLEHARDKMTQAIRYDQEGEDQKSLECLIELFGNSISNQCKDA

SEQ ID NO: 3704 - protein, 361 aa, Fluviicola taffensis
MFGNYLKIIRHKSIIMNISNQAVIHRRLKCFVVYIATEKDTLDEIKIKAGEIRDCIESRSQRDGYTILDSPYSGSFAVRTGLRRSLRGNDEVEGQDVDIAFVLRDEDSSGNALNCMIDTFKEYLKERWPASEIGKSKSAANIHFKGMKQQFDIVPLIETKTTNIQKLIRSTGEKRQSSVFKHKEFVKSRNVESDKIAGVVHFNQCIRLIKWWRYKQQSDSTILGKGEGKTEVSSFLLNLLCSYAYDHCSVKPTYAETLARWFSLLYDVIYRKENIVFTDFIKHPKVDQNQFWSVLDPVDDTNNVVKKWGALEINELTDWLEHARDKMTQAIRYDQEGEDQKSLECLIELFGNSISNQCKDA

SEQ ID NO: 3705 - protein, 343 aa, Sorangium cellulosum
MGKLSTHSASHRWLMAFVDWIKPEEATEEAICAQAGEIRDRIGAKASHDGLVVRSMPWSGSFAKKTGLRRHMRGDHEVEGQDVDLSFVISPQTSDGEDIESLLDRFERYARESYPNTCRNPTKSSVRLDFKRTKLSYDLVPMLAVEGDDEAQVLLRSDGERRRTSVQRHIDFVRRRTAKSNELEGRVKFNEGVRLVKWWRELRQSRSEILDDVPTMLIDLLCAKAFDAHGVDETYTETLSRWFGQIAHLVRTRKRVDFTDFRGPANHAGSGLWSVLDPVNSENNVVPPAWGNLHLQELEGWFEDARDGMARVIAADTAGDEGEAREELAALFGNALVDHGGAP

SEQ ID NO: 3706 - protein, 343 aa, Sorangium cellulosum
MGKLSTQSASHRWLTAFVDWIKPEEATREAICKQAEEIRDRIGAKASRDGLVVRSMPWSGSFAKKTGLRRHMRGDHEVEGQDVDLAFVISPQTSEGEDIESLLDRFERYARASYPNTRRNPTKSSVRLDFKGTKLSYDLVPMLAVEGDDEAQVLLRRDGERRRTSVQRHIDFVKRRTDRSNELKGRVKFNEGVRLVKWLREIRQSRSQILDDVPTMLIDLLCAKAFDLHGVDETYTETLSRWFGRIAHLVGTRKRVDFSDFGDPAGHADGGLWSVLDPVNPANNVVPPAWGNLQLQELAGWFEDARDGMARVIAADTAGDEGEDREELAALFGNALVDHGGAP

SEQ ID NO: 3707 - protein, 329 aa, Archangium gephyra
MSSFVDWIRGGDKDELIIKQSGEIRERIRNQAEKDGLTVRFIPNSGSFAKKTGLRRHLVGDSSVEGQDVDLPFVISPEDEGGARIDELLGRFDRYAATCYPQTKRKPTRSSIQLDFSASKLRYDLVPMLAVPGDDEAQILLRGDGKRRRTSVQKHIEFVTRRNRMSNELPGRVRFNECVRLMKWWREFRQDHARVIEDVPSILLDLLCAHAYDRCTVEETYAGTLARWFDLLAGTVRRRELVAFADFGPKPRASPDALWTVLDPVNADNNIVSQWSSFQIEELGDWLEEGFDAINRAIAADHRDDDGESLESLVELFGNPFKHYCEENS

SEQ ID NO: 3708 - protein, 350 aa, Unknown
  Description of Unknown: marine bacterium sequence
MSNLNTKSKIHVRMRNFVDWIAPDPDKRDAVEQHRKGVKEKVSAKAEEDRLIIKSMPKAGSFAKKTGLRRYKRGDAEQEGQDIDQPFVVEPTDSEGNKVEGSKLLDKFDNYVGSAYPDSEKERTKRSIKLKFSSAIYFDIVPMLATKNDEEQVIIQSNGDEVTSSVQKHNSFTRDRTDDSNQVKGRVKFNECVRILKWWNSHHTSQSAVFSLTDNTKKEVPSFVINLLAAKAYDEIDVCETYPETLFKWFGKLASLVRNSRPIFFNDYTKNLKEKDLDDTILWSVIDPVTSDNVVTRKWDGAEIDELAQWLEESRDAMARAIRYDGDGEDAKSLEWLVKIFGNSFKNHCD

SEQ ID NO: 3709 - protein, 351 aa, Microscilla marina
MGELSNRSTIHVRIRNFVDWIAPDPNKRGSIKQHRESVKKKVSAKAEDDGLIIHSMPKAGSFAKKTGLRRYKRGSAEQEGQDIDQPFVVEREDSDGNKVEGSKLLDRFDGYVAKAYPNTDRERTKRSIKLKFSSDIYFDIVPVLATNNDEKQAIIQSNGDEVVTSVQKHNSFTRDRTDKSNQVKGRVKFNECVRLLKWWNSHHTSQSAVFSLTDNTKKEVPSFVINLLAAKAYDQRGVVETYPETLFRWFGVLAHLVSKHKAIFFNDFTKSLKEKDLDDSVLWSVVDPVAKDNIVTKKWDNLEISELAGWLEQSRDEMARAIRYDKDGEHAKSLDCLVEIFGNSFKNNCDK

SEQ ID NO: 3710 - protein, 342 aa, Fibrisoma limi
MNQFSYHRNTLHRRLTCFVNWIRPEDETIDQIAAQADFIRSRIKAKAIEDSLLVTATPHSGSFAKRTGLRRHMRGHAEVEGQDVDIPFVVAPKDAQGEKLTELLDRFARYADSTYPDTAKEPTKSSIKLKFSNRLFFDIVPMLSTGRADEQIIIRSNGDRLKTSIEKHVAFVRARTKSSDALAGRVQFNECVRLMKWWRESQSVDNYYFGNGNLPSSMLIDLLCAKAYDELSVCTTYAETLARWFSLLASLVKQRKPIFFSDVNTKQPADESAEWCVFDPVNPENNVVKKWGYGEVNELADWLAKGRDEWARAIRFNEDGEDSKSMDSMVRIFGNAFRNHCD

SEQ ID NO: 3711 - protein, 340 aa, Spongiibacterium flavum
MSELTTHSVLHKRITTFADWIRPEATKRDEIKERSNKVREKIKEKAESDEYNLIVVSTPNAGSFTTRTGLRRHFRGDAEVEGLDVDLPFVIKDNQDGFALHSLLDIFYKIVDDCYPDVEKERTKSSIKLKFSDKVNLDIVPMLEGDNVDEQILVRSTGEKIKTSVKRHVGFIKKRTKTSNDEVGRVKFNECLRLLKWWRDTQANGSYIFGGDDAPPSFVINLLAAKAFDQLSVKKTYAETLAMWFGYLAHIVRTREAILFNDYNSPSKDFTLWSVIDPVNTKNNIVKNWGALKVDELANWLEHGRDNWNRIIRFDLEGEDSKSMDQLVKLFGNSFKNHTT

SEQ ID NO: 3712 - protein, 337 aa, Pedobacter jeongneungensis
MNAYSNKSTLHGRIKNFVAWIAPPKESRAAIKDKSDEVRKNIKEKAEADGLTIIEMPHSGSFATRTGLRRHMRGLTTTEGQDIDLPFVVEKDKETEFEPLIQRFKKYAEDCYPNNEIEETKSSIKIIFEADKLTFDLVPMFQGSKKGEQILIRNTGEQITTCIENHREFIRSRTAETKKNDGIVTFNDMIRLLKWWRIVKENETNDKISLPSFLVNLLAAKAYEQCGDDTTYPQTLANWFSYLAHVVKNKETIWFNDYYQSITPHANQEWSVLDPVMAENNIVKKWSWYEIQDLADWLQEASEIINRAIVADIDGRDGDSLEHLQSLFGKIFSSHCN

SEQ ID NO: 3713 - protein, 335 aa, Bdellovibrio sp.
MENINERFEEFIKALRPTDAQIDLAKDELDFIEEKFESFEIEDHHDFSFKKALRSGSYAKKTILKRHETGDFDADIGIYFDVEDPEKLSPHDLMDHVEAVLRRAYKNRTGRTPQFERCKSAVRVKFDTHPKINIDAVPIVSLEHSSIDNYGYIPRRDLEKRKTSVTEHVKFVSDRNNLHNSTAYNQIFMLFKWWKNNAFDEALRSKVSSFFLELVIAKAFDETYKTFTTDWIGNLLKVGSWIARNRLRESIYFVDKRIPITNFPKDPVIVLDSVNPQNNVAANWTTQDRDNFANKIQNMCDVLNDALNEATAGDIDSAVEILDLVFPNFSTWSLE

SEQ ID NO: 3714 - protein, 295 aa, Unknown
  Description of Unknown: uncultured bacterium sequence
MDTEKYLSEVLKRDSLNDESPEIKSLREEKNRVEKIISDSFDWKPVIRYAGSYKKGTMIKASYDLDVVSYFKHDDDSAGETLEEIYNNVKKILEDDYYIEPKKSALRLTSKKGVDFHIDVVPGRFVDEDESDAFLYQFSSEKKRLKTNLDVHIDTIKKSQLVKVIKLVKIWKSIYYLNVKTFVLELLVVKVLKDYKDSDGLSVCLKKFFEELSTNIDNISVEDPANSGNDLSDLFNQTIKSELSNASSNALNLMNDEKIETLFGNVEEVSKDYIVDSIKQNYNKNNNSPKPWSIG

SEQ ID NO: 3715 - protein, 295 aa, Unknown
  Description of Unknown: Parcubacteria group bacterium sequence
METEKYLEQILGKEGLTKDSAEAKAMQTEKAKVEKAISDVFDGSPVIRYAGSYKKETMIRASYDLDIVCYFKHDDDSAGDNLEDIFNNVKDALAKQYTIIPKKSALRLQGENKFDFHIDVVPGRFVDDSEGDTFLYQLSGDKKRLKTNLDVHIGHIKNSGLTKTIKLVKIWKNIYSIDVKTFVLELLVVKVLDKSKDDSGLGKCLKKFFEELSTNIDNVSIEDPANSGNDLGLLFDSAVKGSLSAAATNAIGLINENKWEDLFGTVEDVDKSYVINSLKTSNTDQSKSPKPWLNQ

SEQ ID NO: 3716 - protein, 296 aa, Unknown
  Description of Unknown: candidate division BRC1 bacterium sequence
MNTNEYLSKVLAAQSLTDQDPEVNELQTHRQEIEDLIYSKYAPTIRYGGSRAKGTMIRAAYDLDLPCYFSHDDTSGGETLKDIFGNISAALQTQYTVVPKNSALRVYGASKEKPDLHIDVVPGRFIDDSEKDAFLYCSSADKERQKTNLDVHIKHVRGSGVREAIKLMKYWRFRNSILLKHFVLELLVIDLLKNKKTSVLADQLIHVWTKLRDEVEDIKVEDPANPTGNDLCDLWNDEIKKEVSAVAKTTLDLIDRYGWQDVFGPVEEKTESVSIIGNLNRAASAAAVKPKPWACE

SEQ ID NO: 3717 - protein, 301 aa, Acidobacterium ailaaui
MHMDTNEYLQSVLSGQSLGEDSAELKELQAERAKVEKLIRESFGSVPIIRYGGSKAKGSLIKESYDLDIVCYLPSESDAAGKTLQEIYENIRNCLNKSYYVEEKTSALRLKGNAADNYMRDFHIDVVPGRFTDESKSDCFIYQKSAEKCRLKTNLDTHIAHVKGSGVVDAIRLLKLWKTRKGLRVKQFVFELLIIDLLSGMKSKPLADQLLHVWNEIADHEEPIHVEDPANPNGNDLTDVMTTVWATLRVAATDTLNTIKWSGWEAVFGSVAAAKSFTVAERAQRATASVSTPNRPWCPRG

SEQ ID NO: 3718 - protein, 288 aa, Hyphomonas atlantica
MEAQHISPDSREMAELQNHRAGVEAAIRAAFHGASISIQYGGSKKKGTMIKESYDLDIIVYAYHDETRLGENLSDIYNNVATALSPDYFVHPKTSALRLYAKADGARGDRLHIDVVPGRYVDESRGDAYLHQNSGQKSRLKTNLQTHVDHIKTSGVIGTLKLGKLARVRYDLDIKQFALDLVLIELLKGKTAESLDQQFTHVLQIIADRSTPITIEDPANPAGNDLSGLLDTQVWSELRNVATTMLNQADSGGWGLAFGEAENLGPASAAIITRAAETVDAPTKPWAR

SEQ ID NO: 3719 - protein, 301 aa, Alphaproteobacteria bacterium
MTGSEFLTALLTSQRLADGAPELVALDKVRDEVERLIKSALPNSIIRFTHGGSRAKGTMVREDYDLDLVVYFENEDDAPGETLEEIYETIATLLETSFTVKRKRSALRLRAKKGGDLRVDVVPGRYIDATRTDTFIHQNEGSKERQKTNLEVHIRHVGQSGHTNEIALSKIWRTRHNVGIKTFPLELLVINVLSEDGSGDIEARFRRVLDAFADRVDELQIEDPANPYGNDLSHALTNAIRREVAKAASDTRDAVDKYGWAHAFGESGNKQAVPNVTVIRSAAAAVATPTRPWSMVDDELD

SEQ ID NO: 3720 - protein, 300 aa, Leptolyngbya sp.
MNPDQYLEKVLDQQTFKDDDSRLKDLREERNRIDKILRLYFWDSSPSIRWAGSMAKGTMIIASYDGDMTCYFPEDEEKAGKTLAEISTSVKEALQDDYSIEVKASALRVKSKESCDDLHIDVVPGRYVDESKSDVFLHRTKGDKSRLKTNLQKHIDHIKDSGFQSAIRLMKLWKVRNGIESAKTFVLELLVVKLLQGQESLSLSSQLEHIWTKFRDDANNLLVEDPANSNNDLKPILDECRNFLSSVASSTLWQIEHHGWEQVFGELEDEENQSSNGQNVSALNIAVASVITPTKPWGGN

SEQ ID NO: 3721 - protein, 312 aa, Candidatus Blackallbacteria
MAIQTPNDYLQAVLEQKTVSSSNQTNDYIKELVDEREKVKTILETKYPGASLALHFAGSYAKNTMTLPPSDLDLAAYVQRDETAVGDTLEDIYQNLHDTLAETYNVEKHRSCVRLLSRKDGEEMAASIDVVPGRYINEDSKQDSQCFIYQTEGEKCRLKTDLRAQVRHVRDSGFTNIIKLAKVWKKQNNVSVRTFVLELLIIKILSNAEDVKSSDYAACLRTVWNAFKEDIENISIEDPGNANNDLSGIFDASTKASLKSHASTALTCADIDMWSSILGTVEVKDKAEKRAILESIRVSTPQVAQSRPWARI

SEQ ID NO: 3722 - protein, 304 aa, Unknown
  Description of Unknown: Parcubacteria group bacterium sequence
MTSEEFLQELLETQELSAEQENTLQAHKKEVTDFLRLEFGSDPKIKYAGSREKGTMIADQYDLDVVCYFPNTDTRSLKEIREDVSAHLKKSYIIQSKASAERITNLRGSTVPNSYHIDVVPGRFIENTDDVFLHVAYGDKERMQTNLKVHINHIVNSGCVSVIRLAKLWAYRNNIVIKTFILELFVVRALTGSRDKLNLMKSFRQVLEALRDEFDTLQLVDPANSNNILSQLVQPSEKIMVAQAAKETLDVIGESNELADWQVVFREEDDKGYYAPLISPIPSPSTRHPNTGFTPHSPHCAVIC

SEQ ID NO: 3723 - protein, 297 aa, Candidatus Zambryskibacteria bacterium
MDTINNYLKNLLASQELKPEQEQTLQAHKAEVTNFLRAEFGEDPKIKYAGSHEKGTMIRENYDLDIVCYFPSTDTRSLKEIRDDVSSHLSKKYVLQDKASAERIMNLKDASVPQGYHIDVVPGRFIEGSDDVFIHVAYGEKERMQTNLKTHIKHIAESGCVPVIRLVKVWAHRKNVHIKTFILELFVVEALKGYQSKSDLKASFLKVMEAFKEKFGNLQLVDPANPTGNVVSRTISSSDKTMAASAGEEAFNQINGSDDLSDWKEVFGDQNSGGYESARMTPTGPTIISNPPGQWAQ

SEQ ID NO: 3724 - protein, 259 aa, Beggiatoa sp.
MTPHPYLVSVLEKQRMKDWNLDRLKSLRHQIRSDLEPINQYNPRFYNGGSYGKKTMIREAFDLDLVIYFPRTDSRSLKDMYSSVYESLESAGYKMTPRRVALTLQPPNNPFPNKDFHVDVVTGKAQDDEFYYANIYDIPRDSPRRTSLKMHIDNVHEVRDVIKLMKLWKLRQSLDWQTFAMEQTVVRALKNQNTTNLGQCMEKVLVYIKSSISNQLRLIDPANSNNSIEIPNQKRWKIEQAANRSFDALQKGDWESIVW

SEQ ID NO: 3725 - protein, 247 aa, Beggiatoa sp.
MTGHQYLVGVLEEQRLTDMDLKRLRNTRDQIERYLKPIRHESRIYYGGSYGKKTMIKESFDLDIVIYFPHTDRRPLRDIYESVCHSLNQAGYKMKEQRVALTLQLPKQLHVDVVTGRAKDEDFYYADLYNIAEDSRMLTSLKMHIDDARRVKDTIKLMKLWIRRHSLGMHKFAMEQVVIRALRDKDESDLEMSFQTVLQYLKSSILNIKLVDSANSNNPIKISETQRHKIKQAADYSFRAESWEDII

SEQ ID NO: 3726 - protein, 409 aa, Anaerolineaceae bacterium
MAKTLHAYFVNLLEEHKISDEDAKKLQDARDEIKKALQPIHQYNPHIYYGGSYAKKTMIKDSFDLDIVVYFPHTDPDTPKTCYGYIYRVLTKAKYKVKKLVVSLRIDYDGFHIDVVVGKAEDDTFYYANLYDNIKKRKRRSSLKLHIDHARQYNQIIKIMKIWRLTNKLTWHKLAMESLIVEALKGKDTHDYGDCMQIVLSHIKSCITSKKFVDPSNSNNPIHVSDKQRQRIKKIANRSCSAWSAVNGEGIITGMVKCPICNVKVGFENIKRHLTQVHEIKGEIKEVWQEHKVTDNDRKGFNIHVKFENENLKGVACRAVAYFSRANGKRLEDENDKFCTLNGQVCASTSFTPGYENSVYKDLSIFMPISELHLAKGEHDCKFDVQLYVKNTSVTFAYSDDDSFTCTMG

SEQ ID NO: 3727 - protein, 229 aa, Calothrix sp.
MMRELREQIEQDLRVVYGSYPRFYYAGSYGKRTMIKASFDLDIVIYFPPTERRSLREIYNSVHRTLLMTGYKVNPKTVSLQLPYEGGFHIDVVPGRAQDYSYRYATLYKNGEDSTMQTSLKVHIETIRDSGTRPIIKLLKLWKVRHLLDCKTFALEQIAIRALKGYRKDDYSVCLTQIFEFIRDNVLNIRIVDPANSNNIIEVPRETRFLLHQAAINSLNANYWSSVVW

SEQ ID NO: 3728 - protein, 228 aa, Calothrix sp.
MRELREQIEQDLRVVYGSYPRFYYAGSYGKRTMIKASFDLDIVIYFPPTERRSLREIYNSVHRTLLMTGYKVNPKTVSLQLPYEGGFHIDVVPGRAQDYSYRYATLYKNGEDSTMQTSLKVHIETIRDSGTRPIIKLLKLWKVRHLLDCKTFALEQIAIRALKGYRKDDYSVCLTQIFEFIRDNVLNIRIVDPANSNNIIEVPRETRFLLHQAAINSLNANYWSSVVW

SEQ ID NO: 3729 - protein, 251 aa, Parachlamydia sp.
MSRYLNDLLSSQDLTPAEIQALQNLRNQIQGQLSTLSGDPRFYYAGSYGKKTMIKARYDLDIVVYWPHTTSYTIKEIYDAAGNVLKKYWTSVNSKTVCWELPFKSGFHIDVVPGRALDDKYYEANLYRTDTKTTLKTSLKKHIKTVEASERISAIRLMKLWRERRKVPFQKSFLLELMTIEACKGIRTDDYHTQVMSSLKYIQDNIINCQLRDPANTNNFLADDLNMERRTKIKAAAGSALMATSWDHIFG

SEQ ID NO: 3730 - protein, 251 aa, Herpetosiphon geysericola
MTNDEYFQGLLKQQDLTTAEYNVLRGIRDKVEKLLAVLEGRPRFYYGGSYGKNTIIRQKYDLDIVVYWPKDTSYTIKGIYEGVGKQLKKEWGSVNSKTVAWEIPFQSGFHVDVVPGRALDDGYVEANLYRTDTGTTLKTSIKTHIGVVRNSNRRDAIRLMKLWRERKRVPFKKSFLLEIMTIEGSKGQNSLENQLIYAFRYIRDKIETTKIQDPANSNNSLSDDISYTDKVLIKLAAQAALDAKSWGEVFS

SEQ ID NO: 3731 - protein, 252 aa, Estrella lausannensis
MNEYLNAVLESQKITQNEIKNLNYLAQTIKKQISILEGHPQFFIGGSFGKQTMIRSRYDLDLLVYWPSSAKQYSIKDLYIAVGDILQQYYRPVNSKNVCWEIPFNGGFHIDVVPGRALDSNFNEANLHRNDTGTTLKTSLKAQVDFVANCGRVPIIKLLKLWRVKKQVPFKKSFLLEIMAINGCEGKGYNDYQDQFFTALRYIRDNILTCKIQDPANSNNFLTDDLTPEARIKIRDAAELAISARLWDHIFK

SEQ ID NO: 3732 - protein, 252 aa, Prosthecobacter debontii
MSNHAYLKQLLAEQDLRPEEVETLQRCGRAIQRAVARLDGNPRFYYAGSFGKQTIIRENFDLDIVAYWPDDCGYTLKGIFDAVGKVLQNEWKSARSKGVAWTISFKGGFHIDVVPGRALDKTFREANLYRNDKDSSMKTSIKVHIETVKKSGRRDAIRLMKLWRTRNNVPVKKSLILELLTIRALEGTTSPDLEHQLLTVFSHLRENIEVCRIVDPANSNNVVSDELTARDRSAIRTAASAAIAAGRWSEVF

SEQ ID NO: 3733 - protein, 195 aa, Neisseria macacae
MADYKSDYLNSVLESYRMKHIEELINTYRTKRNAIKLFLNKQYGSHIYEPFNSGSYKKHTAINTKFDLDLVVPFKRNAFSTLEDMFEDVFEKLTEKYQHETTIKKQGVSIGLTFNEEDEINIDVVPARETSQDSFPLEKNLNLHKTQSDGYLKTNIHAQIEHIKAKENERKVIRLLKIWKACHQYKYKSFLLNYW

SEQ ID NO: 3734 - protein, 310 aa, Gallibacterium anatis
MADYKSDYLNSVLESYRMKHIDDLVNSYRSKRGEIKQFLNEQYGSKIYEPFNSGSYKKCTAINTKFDLDLVVPFKHNAFATLEAMFEDVFEKLTEKYQNETSVKKQGVSIGLTFNEEDEINIDIVPARETSQDSFSATKNLNLHKTQGDGYLKTNIHAQIEHIKAKENERKVIRLLKIWKACHQYKYKSFFIELLVIKAYEKSSPQGNLWEQFKTVLNYIIDNIERENFTLKDPGNSNNDLALSLDSGEKSTLVYRLKSMLAQIELNEKQIEFYLPLNEKFSENNEEENKSYGLKSSALVSTPPVSQRFG

SEQ ID NO: 3735 - protein, 310 aa, Haemophilus influenzae
MADYKSDYLNSVLESYKMKHIEELINTYRTKRDEIKQFLNKQYGNNIYEPFNSGSYKKHTAINTKFDLDLVVPFKHNAFSTLEKMFEDVLEKLTEKYKDETTVKKQGVSIGLTFDEEDEINIDVVPARETSQDSFPEHEDLNLHKTQNEGYLKTNIHAQIEHIKAKDNERKVIRLLKIWKACHQYKYKSFFIELLVIKAYEKSSPKGNLWEQFKIVLKYIIDNIQSENFTLKDPGNCNNDLASSLDDTKKAVLVSQLKSMLEQIELNEKQIEFYLPLNEKFAEDNKDENKAYGLKSSVLVSTPPISQRFG

SEQ ID NO: 3736 - protein, 293 aa, Haemophilus influenzae
MKHIEELINTYRTKRDEIKQFLNKQYGNNIYEPFNSGSYKKHTAINTKFDLDLVVPFKHNAFSTLEKMFEDVLEKLTEKYKDETTVKKQGVSIGLTFDEEDEINIDVVPARETSQDSFPEHEDLNLHKTQNEGYLKTNIHAQIEHIKAKDNERKVIRLLKIWKACHQYKYKSFFIELLVIKAYEKSSPKGNLWEQFKIVLKYIIDNIQSENFTLKDPGNCNNDLASSLDDTKKAVLVSQLKSMLEQIELNEKQIEFYLPLNEKFAEDNKDENKAYGLKSSVLVSTPPISQRFG

SEQ ID NO: 3737 - protein, 293 aa, Moraxella catarrhalis
MKHIDGLVNKYREKRDEIKAFLNEQYGSKIYESFNSGSYKKHTAINTKFDLDLVVPFKHNAFSTLEKMFEDVLEKLTEKYKDETTVKKQGVSIGLTFDEEDEINIDVVPARETSQDSFPEHEDLNLHKTQNEGYLKTNIHAQIEHIKAKENERKVIRLLKIWKACHQYKYKSFFIELLVIKAYEKSSPKGNLWEQFKIVLKYIIDNIQSENFTLKDPGNCNNDLASSLDDTKKAVLVSQLKSMLEQIELNEKQIEFYLPLNEKFAEDNKDENKAYGLKSSVLVSTPPISQRFG

SEQ ID NO: 3738 - protein, 310 aa, Moraxella catarrhalis
MSDYKSNYLNSVLESYRMKHIDGLVNKYREKRDEIKAFLNEQYGSKIYESFNSGSYKKHTAINTKFDLDLVVPFKHNAFSTLEKMFEDVLEKLTEKYKDETTVKKQGVSIGLTFDEEDEINIDVVPARETSQDSFPEHEDLNLHKTQNEGYLKTNIHAQIEHIKAKENERKVIRLLKIWKACHQYKYKSFFIELLVIKAYEKSSPKGNLWEQFKIVLKYIIDNIQSENFTLKDPGNCNNDLASSLDDTKKAVLVSQLKSMLEQIELNEKQIEFYLPLNEKFAEDNKDENKAYGLKSSVLVSTPPISQRFG

SEQ ID NO: 3739 - protein, 310 aa, Haemophilus parainfluenzae
MADYKSDYLNSVLESYRMKHIEELINTYRTKREEIKQFLNEQYGSKIYEPFNSGSYKKHTAINTKFDLDLVVPFKRNAFSTLEDMFEDVLEKLTEKYKDETTVKKQGVSIGLTFDEEDEINIDVVPARETSLDSFSEHKDLNLHKTQNDGYLKTNIHAQIEHIKAKENERKVIRLLKIWKACHQYKYKSFFIELLVIKAYEKSSPQGNLWEQFKTVLNYIIDNIQSENFTLKDPGNSNNDLAQSLDSIEKRTLISRLESMLVQIELNEKQIEFYLPLNGKFAENNNDGNKAYGLKSSVLVSTPPISQRFG

SEQ ID NO: 3740 - protein, 310 aa, Unknown
  Description of Unknown: Bisgaard Taxon 7 sequence
MADYKSDYLNSVLESYRMKHIEKLIEAYRTKRDEIKQFLNEQYGSKIYEPFNSGSYKKHTAINTKFDLDLVVPFKRNAFSTLEEMFEDVLEKLTEKYKDETTVKKQGVSIGLTFDEADEINIDIVPARETSQDSFLEHKDLNLHKTQNDGYLKTNIHAQIEHIKAKENERKFVRLLKIWKAYHQYKYKSFFIELLVIKAYEKSSPQGNLWEQFKTVLNYIIDNIQRESFTLKDPGNSNNDLALSLDSGEKSILVCRLQSMLAQIESNEKQIEFYLPLNEKFSESHKDENKTYGLKSSALVSTPPVSQRFG

SEQ ID NO: 3741 - protein, 294 aa, Wohlfahrtiimonas sp.
MGHIKDLISDYRTKRDEIKSFLNEQYGNKIYDAFNSGSYKKYTAINTKFDLDVVVPFKYKSFTTLEEMFDDVYAKLNEKYEDECAIKKQGVSIGLSFEGDQVDIDIVPARETSIDSFSDKKDLNLHKSNGGYLKTNIHSQIDHIKAKQNERKVIRLLKIWKHQNNHKYKSFFIELLVIKAYEKEKPKGTLWEQLSSVLAYAIKNINTENFSLIDPGNTNNNLMNTLDDLQKASLVSLFKRLLYQVEQNEKNIMLYFEKNEEFAVEQEDEFNDKTYGLKKSAVVISTPPSSSRFG

SEQ ID NO: 3742 - protein, 312 aa, Psychrobacter sp.
MADYKSEYLQEVLESHRMSHINDLFNKYRDRRNEIKEFLKSEYKNNTYSPFDSGSYSKHTAINTKFDLDSVVPFKHDSFSTLEAMFNDVYEKLDAKFGEKTTVRKQTVSIGLKFEEDNIEIDIVPARETKTDTYLDTGNLNLHISDSNSESGYLKTNIQSQIDHIKGKETERKIIRLLKIWKFQNSKKYKSFFFELLVIKAYDKTSPTGSLWTQLETILQYVVDNIEDSTFKLPDPGNSNNDLMSTLDSSQRKKLAYDFNKLLTNVNNNEINIELYFKKNEEFAESSDKDDLSYGVASVTPVSIPSSTERFG

SEQ ID NO: 3743 - protein, 313 aa, Psychrobacter piscatorii
MADYKSNYLQEVLETHKMKHIKDVFDKYRDRRNEIKDFLNAEYGSRIYSPFDSGSYSKHTAVNTKFDLDAVVPFKYKSFNTLEDMFSDIYNKLNDKFNDRTTVRKQGVSIGLAFEEDGIDIDIVPARETRVDGYTETRNLNLHINSLDPSETGYLKTNIQSQINHISGKDNERKIIRLLKIWKFQKSKKYKSFFFELLVIKAYDSTLPTGNLWEQFKTVLQYIVDNIESSTFKLPDPGNSNNDLMSTLDSYQKTLLKSDFEWMLTNIENNEKQIEYYFEKNKEFSEGASNNGLSYGVAGATPVSTPSSKQRFG

SEQ ID NO: 3744 - protein, 321 aa, Lacinutrix sp.
MAINKKEYLQEVLETHKMSHVNSLLDKYRDKRKSIKEALEEHYTDKIYSPLNSGSYAKHTAINTKFDLDVVVPFKKKSFSTLEEMFDDVFDFLNETYGTEATVRKQKVSIGIIFYSDNDGDEISIDIVPGRELNEDQYNEDNKLNLYVHSQYGLLAGKTHLLTNIKAQIEHIKSRDNERKIIRLLKIWKSSNNEDYKSFLMELITIKAFDKDSISGDLCEMLESTMEYIRDNITKDGFTLSDPGNSGNNVADTLESWQKENLSSKMKNMLDRIEDNSDNLKIYFPINPDFKENEDTKSSEGYGVKTGASTFSIPTQNQRFG

SEQ ID NO: 3745 - protein, 315 aa, Tenacibaculum ovolyticum
MDITKSEYLAEVLESYRMAHVNDLLDKYREKRKEIKEAIESKYTTDMYSPLNSGSYAKSTAINNKFDLDVMIPFKRNSFDTLEVMFDDIFDFLYEKYKGEANVIKQKVSIGIEFYTDEDGDDISIDVVPGRELNKDQYEDDNKLNLYINSRYGSLEEQSYIQTNIKAQIDHIKSRDNERKIIRLLKIWKTTNSEKYKSFLLELITIKAFDKDTISGNLWEQLKAVMEYIKDHIAKDNFTLKDPGNSGNDVADTLETHEKKGMSNKMKNMLDRIEENEDNLKFYFPKNSDFEENNGYGVETGAGLNSRPPKNERFG

SEQ ID NO: 3746 - protein, 313 aa, Tenacibaculum ovolyticum
MTKSEYLAEVLESYRMAHVNDLLDKYREKRKEIKEAIESKYTTDMYSPLNSGSYAKSTAINNKFDLDVMIPFKRNSFDTLEVMFDDIFDFLYEKYKGEANVIKQKVSIGIEFYTDEDGDDISIDVVPGRELNKDQYEDDNKLNLYINSRYGSLEEQSYIQTNIKAQIDHIKSRDNERKIIRLLKIWKTTNSEKYKSFLLELITIKAFDKDTISGNLWEQLKAVMEYIKDHIAKDNFTLKDPGNSGNDVADTLETHEKKGMSNKMKNMLDRIEENEDNLKFYFPKNSDFEENNGYGVETGAGLNSRPPKNERFG

SEQ ID NO: 3747 - protein, 312 aa, Riemerella columbina
MNKEEYLQKVLKTHKMSHVNDLLKKYMEKRQKIKECLEQEYGKNIYNPMNSGSYAKHTAINTKFDLDIVIPFKRNSFATLEEMFENIYNFLSETYSDIATIRKQKVSIGIVFDKDKDGDVVNIDVVPGREFNDNQYIEDKKLNLYVNSEYGQIEKTKYIQTNIQAQIDHIKGKNNERSIIRLLKIWKNSNNEPYKSFFLELITIKAFNKKNITGNLWEKLRSVIEYIRDNVANDGFTLKDPGNSGNNVADTLKSWEKEALKNKMELMISNIEDNTEAIKIYFPINKDFEEDKYGLKDFKIAPSIPSKSQQFG

SEQ ID NO: 3748 - protein, 313 aa, Riemerella anatipestifer
MNKEEYLQKVLKTHKMSHVNELLKKYMKKRQEIKECLEQEYGKSIYNPMNSGSYAKHTAINIKFDLDIVIPFKRNSFATLEEMFENIYNFLSETYSDVATVRKQKVSIGIIFDEDKDGDVINIDVVPGREFNDNQYIEDKKLNLYVNSEYGQIQKSKYIQTNIQAQIDHIKGKNNERSIIRLLKIWKNSNNEPYKSFFLELITIRAFNKKNITGNLWEKLRSVIEYIRDNVANDGFTLKDPGNSSNNVADTLKSWEKEALKNKMELMISNIENNTEAIKVYFPINENFEEEDKYGLKDFKIAPSIPSKSQQFG

SEQ ID NO: 3749 - protein, 320 aa, Chryseobacterium indologenes
MAVDKSQHLNQVLETHRMAHINDLLDKYKEKRKEVKEALEENYKENIYSPINSGSYAKHTAINIKFDLDIVIPFKRNSFGTLEEMFDDIYEFLREKYKNDATVRKQKVSIGIEFYEDEDGHFINVDVVPGRELNDKQYSEDSNLNLFVNSKYGLLEEKTHVQTNIQAQIDHIKGKGDERSIIRLLKIWKATNNELYKSFFLELATIKAFEKEDISGNLWEKLKTVMEYIRDNVIKDNFTLKDPGNSNNDVANTLDSWAKTNLSNKISYIIDNIERNSDNIKTYFPINEDFEEESKSDNKYGLKDASIIAPSIPSKSQQFG

SEQ ID NO: 3750 - protein, 320 aa, Elizabethkingia genomosp. 4
MKETLHEHLSNVLTTHKMTHIDGLLSKYNAKREEIRSALNEKYSSSIYSSFNSGSYAKHTAINSKFDLDIVVPYKKGSFNTLEEMFNDLYNFLDEKYKDVAEVRKQKVSIGVLFHEDEDGDVVNIDVVPGREVAADDYLESKNLNLFFNEGMGLFAKNSYLKTNIQNQIDHIKGKENERKIIRLLKIWKNSNNEKYKSFFLELATIKAFDKTDVSGNLWDKLRAVMEYIKDNVTKDDFNLKDPGNSNNNVSDSLDAWDKTLLSSKMEIIIKNIEDNNENIKTYFPVNEEFEAEENSDKSTYGLKSTIITPSIPSNNQRFG

SEQ ID NO: 3751 - protein, 320 aa, Elizabethkingia sp.
MKETLHEHLSNVLTTHKMTHIDELLSKYNTKRDEIRSALNEKYSNSIYSSFNSGSYAKHTAINSKFDLDIVVPYKKGAFSTLEEMFNDLYNFLDEKYKDVAEVRKQKVSIGVLFHEDEDGDVVNIDVVPGRELAADNYLESKDLNLFFNEGMGLFAKNSYLKTNIQNQIDHIKGKENERKIIRLLKIWKNSNNEKYKSFFLELATIKAFDKTDVSGSLWDKLKAVMEYIKDNVTKDDFNLKDPGNSNNNVSDSLDTWDKASLSSKMEMIIMNIEDNNENIKTYFPVNEEFVVEENSEKNTYGLKSSIITPSIPSNNQRFG

SEQ ID NO: 3752 - protein, 320 aa, Mesonia mobilis
MEKSDYLLNVLETHKMKKIENLLSKYKDKREEIKNEIESEYQNKIYSPFNSGSYAKHTAINCKFDLDIVVPFKKDSFNTLKEMFDNLYDFLIDKYGNDAIVRKQKVSIGITFDSDEDGDEIDIDVVPGRELTKDDYPDSRGLNLFFNERMGLFSSNSYIKTNINSQIKHINKRENERKIIRLLKIWKYTNNENLKSFLIELITIKAFDNVNVSGNIWEQLKSVMEYIKDNIRTENFTLNDPGNSNNNVADTLDESDKEYFAERMINILNRVEDDSENLKFYFPLNKDFEEDEVENKYNVKQSSYKNSVPPTNQRFGRGIE

SEQ ID NO: 3753 - protein, 316 aa, Chryseobacterium greenlandense
MAVNRSEHLANVLETHRMSHIDKLVQKFRDKRDDIKEALEEHYTSDIYSPLNSGSFGKHTAINIKFDLDVVVPFKRNSFTTIEEMYNAVYDFLYEKYEDTGLATVRKQKVSIGVIFKADKDGDQISIDVVPGREISVDSYLDVRDLNIYFNKDTWGFSKGTYMKTNIQSQIDTIKSRDDERKIIRLLKIWKHSNSESYKSFLMELFTLKAFDKSTITGNLWDKTEGVLRYIKDNVTREDFTLKDPGNPSNDLMKNLSWFDRQNLSNKMKNIIDRITENSENIKTYFPANKDFDTTESYGLKGSSGLSIPKDDQRFG

SEQ ID NO: 3754 - protein, 316 aa, Chryseobacterium jejuense
MAVNRSEYLANVLETHRMSHIDKLVQKFRDKRGHIKEALEEHYTSDIYSPLNSGSFGKHTAINIKFDLDIVVPFKRNSFATIEEMYNAVYDFLYEKYENTGLAQVRKQKVSIGVIFKADKDGDQISIDVVPGREISVDSYLDVRDLNIYFNKDTWGFSKGTYMKTNIQSQIDTIKSRDDERKIIRLLKIWKHSNSESYKSFLMELFTLKAFDKSTITGNLWEKTEGVLSYIKDNVTREDFTLKDPGNPSNDLMKNLTWFDRQNLSNKMGNMIDRITENSENIKIYFPVNKDFDTAESYGLKGSTGLSIPKDDQRFG

SEQ ID NO: 3755 - protein, 322 aa, Chishuiella changwenlii
MAVNKNEHLNKVLETHRMFHINALVTKHKEKRDEIKEALETEFNSKIYSPFNSGSFGKHTAINTKFDLDIVAPFKKDSFSTIEDMFNEVYEFLYNKYHYTGKAEVRKQKVSIGVIFNIDQDGDQISIDVVPGRELTQDTYLKEKDLNIYFNEDKWGFSKGSYMKTNIQAQIDHIKGKDSERKIIRLFKIWKNSNSEEFKSFMLELISIKAFDKSTIEGDLWGKLKGVMTYIRDNVTNDSFTLKDPGNSNNDVIQTLSTSQRQHLSDRMRIIIDNIEANAENIKSYFPINEEFDIPEENNSSSYGVKESSTVFSIPSDNQRFG

SEQ ID NO: 3756 - protein, 185 aa, Bacteroides fragilis
MATDINQYLSESIETHKMKHIQKEVDAFQAKADEVKSKLETHYGCNLYYVFRSGSFAKNTAINIKFDIDLVAPFKYESFDTLEAIYNDVYDFLVNEYKDGTYIRKQKVSIGLTFPIDKNGVIVKLDVVPGRELNKDDYPNTKNLNLYFNEDHWGYKKGSRQKTNIHAQIDHISGKSEERKVIRLL

SEQ ID NO: 3757 - protein, 317 aa, Unknown
  Description of Unknown: Bacteroides sequence
MATDINQYLSESIETHKMKHIQKEVDAFQAKADEVKSKLETHYGCNLYYVFRSGSFAKNTAINIKFDIDLVAPFKYESFDTLEAMYNDVYDFLVNEYKDGTYIRKQKVSIGLTFPIDKNGVIVKLDVVPGRELNKDDYPNTKNLNLYFNEDHWGYKKGSRQKTNIHAQIDHISGKSEERKVIRLLKIWKNTNHQDYKSFMLELFTIKAMASYSGDNNLWDKLKYVMTYIADNVTDESFRLIDPGNSNNNVLSSIDMNKRSMLSTTMRTIINAIDNDSNSVAIYFPINAKYQKQENRYGYKSGSSGPSYPPTSQRFGE

SEQ ID NO: 3758 - protein, 317 aa, Bacteroides fragilis
MATDINQYLSESIETHKMKHIQKEVDAFQAKADEVKSKLETHYGCNLYYVFRSGSFAKNTAINIKFDIDLVAPFKYESFDTLEAIYNDVYDFLVNEYKDGTYIRKQKVSIGLTFPIDKNGVIVKLDVVPGRELNKDDYPNTKNLNLYFNEDHWGYKKGSRQKTNIHAQIDHISGKSEERKVIRLLKIWKNTNHQDYKSFMLELFTIKAMASYSGDNNLWDKLKYVMTYIADNVTDESFRLIDPGNSNNNVLSSIDMNKRSMLSTTMRTIINAIDNDSNSVAIYFPINAKYQKQENRYGYKSGSSGPSYPPTSQRFGE

SEQ ID NO: 3759 - protein, 315 aa, Flavobacterium oncorhynchi
MGFDKSDYLFNVLETHKMKHIDSLFDKFKERRKEIKEKLEEKFGDDIYTTFNSGSYAKHTAVNAKFDLDIVAPCKRNSFSTITGMFDDFFDFLQTEYKEIAYVRKQKVSIGIEFFADEDNEVVQIDVVPGRELKQGDYPNDNYLNININVDGSNYTQTNIHAQIENIKGKSDARQIIRLLKIWKYQNYKDYKSFFIELIVIKAFENKIVSGSLWSKFKTVLEYIIDEIEEDNFSLKDPGNSSNDIAKTMDSYKKTLLKNDLKFLLDQVELNDENLKNHFKENEKFKFVEQSSESKGSYRVNDSSRAIIPPSNQFG

SEQ ID NO: 3760 - protein, 323 aa, Prevotella oris
MSIDKNAHLAEVLKTHKMSHVQDFANRVKSKADEIKEKLSNHYGTEKYTSYNSGSMAKHTATNIKFDMDFVEPFKHSAFDTLQNMFDDVFNFLHKEYKEDNDLAEEVRKQKVSIGIKFYQEEGDDKPIEIDVTPGRELSDDDYLNTHDLNLCFNKDAWGFQKGTTRKTNIKKQIDHISGKSEEHKIIRLLKIWKKHNAKKYKSFMLELISIDALKDYTGENALWDKLKFTMEYIKDHVNEDSYHLYDPGNSNNDVVGSMDKMTRLNLKIDMETMLLNIERNDEYLKIYFPVNEQFKEEEKEDSFGNKSGREGYSTPSTSRRFG

SEQ ID NO: 3761 - protein, 313 aa, Bacteroides caecimuris
MSFDKNKHLREVLDTHKMCHVQNFVNKVKNRREEIKAKMHDHYGCDKYSSFGSGSFAKHTATNVKFDLDLVEPFKRNAFGTLQEMFDSVHDFLAEEYKNTGVTIRRQKVSIGVSFPIEEGDEKPVELDVVPGRELSDDNYLDSHDLNLCFNEDHWGFKKGSSQKTNIQKQISHIEGKSSERQIIRLLKIWKKQKDKKYKSFVIELAVIRALDGYNGDMGLWPRLKYTMEYLRDHIAESSFHLFDPGNTNNDVVGTMQDYDRQSFKSDMESMLNNIDSNPDLYLPYYFKVNEKYCGYKEKDTGATYPTSTKRFG

SEQ ID NO: 3762 - protein, 313 aa, Bacteroides clarus
MSFDNNKHLREVLDTHKMCHVQDFVNKVKKRREEIKAKMHNHYGSDKYPSFESGSFAKHTATNVKFDLDLVEPFKRNAFGTLQEMFDSVHDFLAEEYKNTGVTIRRQKVSIGVSFPIEEGDEKPVELDVVPGRELSDDNYLDSHDLNLCFNEDHWGFKKGSSQKTNIQKQISHIEGKSSERQIIRLLKIWKKQKDKKYKSFVIELAVIRALDGYNGDMGLWPRLKYTMEYLRDHIAESSFHLFDPGNTNNDVVGTMQDYDRQSFKSDMESMLNNIDSNPDLYLPYYFKVNEKYCGYKEKDAGAAYPTSTKRFG

SEQ ID NO: 3763 - protein, 313 aa, Unknown
  Description of Unknown: Bacteroidales sequence
MSFDKNKHLREVLDTHKMCHVQDFVNKVKKRREEIKAKMHNHYGSDKYPSFESGSFAKHTATNVKFDLDLVEPFKRNAFGTLQEMFDNVYDFLAEEYKNTGVTIRRQKVSIGVSFPIEEEDEKPVELDVVPGRELSHDNYLDSHDLNLCFNEDHWGFKKGSSQKTNIQKQISHIEGKSSERQIIRLLKIWKKQKDKKYKSFVIELAVIRALDGYNGDMGLWPRLKYTMEYLRDHIAESSFHLYDPGNTNNDVVGAMQDYDRQSFKSDMESMLNNIDSNPDLYLPYYFKVNEKYCGYKEKDTGAAYPTSTKRFG

SEQ ID NO: 3764 - protein, 313 aa, Bacteroides uniformis
MSFDKNKHLKEVLDTHKMCHVQDFVNKVINRREEIRAKMHNYYGSDKYPSFESGSFAKHTATNVKFDLDLVEPFKRNAFGTLQEMFDSVHDFLAEEYKNTGVTIRRQKVSIGVSFPIEEGDEKPVELDVVPGRELSDNNYLDSHDLNLCFNEDHWGFKKGSSQKTNIQKQISHIKGKSSERQIIRLLKIWKKQKDKKYKSFVIELAVIRALDGYNSDMGLWPRLKYTMEYLRDHIAESSFHLFDPGNTNNDVVGTMKDYDRQSFKSDMESMLNNIDSNPDLYLPYYFKVNEKYCGYKEKDTGAAYPSSTKRFG

SEQ ID NO: 3765 - protein, 313 aa, Bacteroides caccae
MSFDKNKHLGEVLDTHKMCHVQDFVNKVKKRREEIKAKMHDHYGCDKYSSFGSGSFAKHTATNVKFDLDLVEPFKYNAFGTLQEMFDSVHDFLADEYKNTGVTIRKQKVSIGVSFPIEEGDEKPVELDVVPGRELNNNDYSDSYNLNLCFNEDHWGFKKGSSQKTNIQKQISHIEGKSSERQIIRLLKIWKKQKDKKYKSFVIELAVIRALDGYNGDMGLWPRLKYTMEYLRDHIAESSFHLFDPGNTNNDVVGTMQDYDRQSFKSDMESMLNNIDSNPDLYLPYYFKVNEKYCGYKEKDTGAAYPTSTKRFG

SEQ ID NO: 3766 - protein, 313 aa, Bacteroides salanitronis
MSFDKNKHLREVLDTHKMCHVQDFVNKVKSRREEIKTKMHDHYGSDKYPSFGSGSFAKHTATNVKFDLDLVEPFKHNAFGTLQEMFDSVHDFLAEEYKNTGVIIRKQKVSIGVSFPIEKGDEKPVELDVVPGRELSNDDYLDSHDLNLCFNEDHWGFKKGTSQKTNIQKQISHIEGKSSERQIIRLLKIWKKQKGKKYKSFVIELAVIRALDGYDGDNGLWPRLKYTMEYLRDHIAENSFHLYDPGNTNNDVIAAMQDYDRKSFKSDMESMLNNIDSNPDLYLPYYFKVNEKYSGYKEKDTGAAYPTSAKRFG

SEQ ID NO: 3767 - protein, 313 aa, Mediterranea sp.
MSFDKNKHLREVLDTHKMCHVQDFVNKVKSRREEIKTKMHDHYGSDKYPSFGSGSFAKHTATNVKFDLDLVEPFKHNAFGTLQEMFDSVHDFLAEEYKNTGVIIRKQKVSIGVSFPIEKGDEKPVEVDVVPGRELSNDDYLDSHDLNLCFNEDHWGFKKGTSQKTNIQKQISHIEGKSNERQIIRLLKIWKKQKGKKYKSFVIELAVIRALDGYDGDNGLWPRLKYTMEYLRDHIAENSFHLYDPGNTNNDVIAAMQDYDRKSFKSDMESMLNNIDSNPDLYLPYYFKVNEKYSGYKEKDTGAAYPTSAKRFG

SEQ ID NO: 3768 - protein, 313 aa, Unknown
  Description of Unknown: Prevotella sequence
MNFDKNKHLREVLDTHKMCHIQDFVNKVKNRREEIKTKMHNHYGSDKYSSFGSGSFAKHTATNVKFDLDLVEPFKHNAFGTLQEMFDSIHDFLTEEYKNSNVTIRKQKVSIGVSFPIEEGDEKPVEIDVVPGRELSDDDYLDSHDLNLYFNEDHWGFKKGTSQKTNIQKQISHIEGKSNERKIIRLLKIWKKQKDKKYKSFVIELAVIKALDGYDGDNGLWPRLKFTMEYLRDHIAESSFHLYDPGNTNNDVIAAMQDYDRQSFKSDMESMLNNIDSNPNVYLPYYFKVNERYSGYKEKDAGTAYPTSTKRFG

SEQ ID NO: 3769 - protein, 313 aa, Porphyromonas circumdentaria
MSFDENKHLREVLDTHKMCHVQEFVNKVKKRREEIKAKMNNHYGSNKYSSFGSGSFAKHTATNVKFDLDLVEPFKHNAFGTLQEMFDSIHDFLAEEYKNSNVTIRKQKVSIGVSFPIEEGDEKPVELDVVPGRELSDGDYSNSHDLNLCFNEDHWGFKKGSSQKTNIQKQISHIEGKSSERQIIRLLKIWKKQKDKKYKSFVIELAVIRALDGYVGDMGLWPRLKYTMEYLRDHIAESSFHLSDPGNTNNDVMEAMLDYDRQSFKSDMESMLNNIDSNPNVYLPYYFKVNERYSGYKEKDAGTAYPTSTKRFG

SEQ ID NO: 3770 - protein, 313 aa, Prevotella baroniae
MSFDENKHLREVLDTHKMCHVQEFVNKVKKRREEIKAKMNNHYGSNKYSSFGSGSFAKHTATNVKFDLDLVEPFKHNAFGTLQEMFDSIYDFLAEEYRNSNVTIRKQKVSIGVSFPIEEGDEKPVEIDVVPGRELSDDDYLDSRDLNLYFNEDHWGFKKGTSQKTNIQKQISHIEGKSNERQIIRLLKIWKKQKDKKYKSFVIELAVIKALDGYYGDNGLWPRLKFTMEYLRDHIAESSFHLYDPGNTNNDVIAAMQDYDRQSFKSDMESMLNNIDSNPNVYLSYYFKVNERYSGYKEKDAGTAYPTSTKRFG

SEQ ID NO: 3771 - protein, 313 aa, Prevotella amnii
MSFDKNKHLREVLETHKMCHVQDFVDKVKKRREEVKTKMHDKYGSDKYPSFCSGSFAKHTATNVKFDLDLVEPFKHNAFKTLQKMFDSVYDFLAEEYKDTNVTIRKQKVSIGVSFPIEEGDDKPVELDVVPGRELSDDNYCDSQDLNLCFNADHWGFKKGTSQKTNIHKQISHIEGKSSERQIIRLLKIWKKQKDKKYKSFVIELAVIKALDGYDGDNCLWPKLKFTMEYLRDHIAESCFHLYDPGNTNNDVIAAMQDYDRQSFKSDMESMLNNIDSNPDVYLPYYFKVNEKYSGYKEKDAGTAYPTSTKRFG

SEQ ID NO: 3772 - protein, 320 aa, Porphyromonas gingivalis
MELNKNKHLNDVLESHKMRHVRDFSDKVLERKSEIIQKLANHYGTSQRYDAFTSGSMAKHTAINIKFDYDVVQPFKRKAFETLSEMFDDVFSFLEEEYGDVATVRRQKVSVGIKFPQEENDRNPICIDVVPGRELSEEDFLTTKALNLYYNEDVWGFKKGSYQKTNISAQIEHIKEKEQERQIIRLFKIWKNRLNKDYKSFLIELICIKAFDGYSGSTSLWDRLKFAMEYIRDHITDESFHLYDPGNSGNDLMASMDDYKKGELKAEMENMLNNIDNNASFFLPYYFPINDEFDPNKDEGYKVKDSRETVSYPRSPQRFG

SEQ ID NO: 3773 - protein, 341 aa, Capnocytophaga sp.
MSLFYKMEYILPLCRKNNNFAPMDKARYLESVIDSYKISKEEKLLEKYKTKRDEVKRALEEKYKGNIYSPFNSGSYAKNTAINTKFDFDMVTPFKRNAFGASGTLEQMYNEVYDFLCEKYKDEASIRKQKVSIGLEFNSDKDGDSIKIDVVPGREYNQERYNYDKNLNLYAYKQYENFEKGSDRIKTNIQAQIDNIRGRATNEKDSIRKIIRLLKVWKTSAKREYPKSFFLELITIRAFDDGKIEGNVWETLRIVLDFIKDNVTKENFALKDPGNSGNNLIDTLTNSEREQLSRDIKNMLERIDEDEDYLKYYFPENPKFKSKEDNNKTKMPLPPPNLNFG

SEQ ID NO: 3774 - protein, 341 aa, Capnocytophaga sp.; identical to SEQ ID NO: 3773

SEQ ID NO: 3775 - protein, 327 aa, Bacteroidetes bacterium
MDKSLHLETVIRTHQITKEKQLLEKHIQKKNEVKEALQENFGCNIYSPFNSGSYAKNTAINTKFDFDLVSPFKRNAFGSNGTLKEMYEAVYDFLFDKYKIEAEVKKQKVSIGLEFYADSVGDRIKIDVVPGREFNQDQYKDDENLNLYVYYKYGNFAADSERIKTNVQMQINNIKDRADKEKDSIRKIIRLLKVWKNTKYNYPTKSFFIELITIKAIDNSDITGKLWDKLKTVLEYIRDHVNNEGFTLKDPGNSSNDLADTLTDNDKQQLANDMKNMLERIEENDENIKTYFPENPKFKEEDKNKNKYGTNGGMPIPPPKLNFGLEK

SEQ ID NO: 3776 - protein, 324 aa, Sphingobacterium spiritivorum
MDKSKHLESVIKTHQITKEKALLDKHIQKKNEVKEALEEKYESNVYSPFNSGSYAKNTAINTKFDFDLVSPFKRNAFGSNGTLKEMYEDVYDFLYEKYKDVAEVKKQKVSIGLEFYVDSDGDVIKIDVVPGRELNQDQYKDDENLNLYVYYKYGNIDAGSERIKTNVKSQINNIKGRANAEKDSIRKIIRLLKVWKNNKGTYPTKSFFLELITIKAFDNTEISGNLWDKLKTVLEYIRDNVTKDGFTLKDPGNSSNDLADTLTSYEKQQLSDDMKNMLDRIEENNQNIKTYFTENPKFKEEESNKNKYGTNGGMPVPPPKLNFG

SEQ ID NO: 3777 - protein, 324 aa, Chryseobacterium cucumeris
MDKNKHLDSVISTHKITKEEVLFDKYVKKKNEVKEALEENYGSNIYSPFNSGSYAKNTAINTKFDFDLVSPFKRNAFGSNGTLKEMYEDVHDFLYEKYKNVAEVKKQKVSIGLEFYADSDGHVIKIDVVPGRELSQDQYKEDENLNLYVYYKYGNIDAGSERIKTNVKAQINNIKDRATAEKDSIRKIIRLLKVWKNTKYNYPTKSFFLELITIKAFDSKSITGSIWDKLETVLEYIRDNVTKDSFTLKDPGNSSNDLGDTLTSTEKQQLSDDIKNMLERIEDNDENLKTYFPENSKFKKEDTNNNQYGKNSGMPIPPPKLNFG

SEQ ID NO: 3778 - protein, 324 aa, Soonwooa buanensis
MDKNKHLDSVISTHQITKEETLFDKYVKKKNEVKEALEEIYGSNIYSPFNSGSYAKNTAINTKFDFDLVSPFKRNAFGSNGTLKEMYEDVYDFLYEKYKDVAEVKKQKVSIGLEFYADSDGDVIKIDVVPGRELSQDQYKEDENLNLYVYYKYGNIDAGSERIKTNVKAQINNIKDRATAEKDSIRKIIRLLKVWKNTKYNYPTKSFFLELITIKAFDNKTITGGIWDKLETVLEYIRDNVTKENFTLKDPGNSSNDLADTLTSTEKQQLSDDMKNMLDRIEDNDENLKTYFPENSKFKKEDTNNNQYGKNSGMPIPPPKLNFG

SEQ ID NO: 3779 - protein, 324 aa, Sphingobacterium sp.
MDKNKHLDSVISTHQITKEETLFDKYVKKKNEVKESLEENYGSNIYSPFNSGSYAKNTAINTKFDFDLVSPFKRNAFGSNGTLKEMYEDVYDFLYGKYKDVAEVKKQKVSIGLDFYADSDGDVIKIDVVPGRELSQDQYKEDENLNLYVYYKYGNIDAGSERIKTNVKAQINNIKDRATAEKDSIRKIIRLLKVWKNTKYNYPTKSFFLELITIKAFDSKSINGSIWDKLETVLEYIRDNVTKEKFTLKDPGNSSNDLADTLTSTEKQQLSDDMKNMLKRIEDNDENLKTYFPENPKFKKEDTNNNQYRKNSGMPIPPPKLNFG

SEQ ID NO: 3780 - protein, 324 aa, Belliella pelovolcani
MDKNKHLDSVISTHQITKEEILFDKYVKKKNEVKEALEEQYGSNIYTPFNSGSYAKNTAINTKFDFDLVTPFKRNAFGSNGTLKEMYEDVYDFLYEKYKDVAVVKKQKVSIGLEFYADSDGDVIKIDVVPGRELSQDQYKEDENLNLYVYYKYGNIDAGSERIKTNVKAQINNIKDRATTEKDSIRKIIRLLKVWKNSKYNYPTKSFFLELITIKSFDSKCITGSIWDKLETVLEYIRDNVTKEDFTLKDPGNSSNDLADTLTSTEKQQLSDDMKNMLDRIEDNDENLKTYFPENSKFKKEDTNNNQYGKNSGMPIPPPKLIFG

SEQ ID NO: 3781 - protein, 322 aa, Capnocytophaga canimorsus
MNKKDYLESVIDSHKMSKEEDLLNKHRSKKTQIKEALEKKYSSNIYSPFNSGSYAKNTAINIKFDFDLVSPFKRNAFGSNGTLKDMYDDVYNFLYEEYKNEAEVRKQKVSIGLDFYEDKEGDRIKIDVVPGREFNQGQYDEDKNLNLYVYHKYGNINAGSERIKTNIVAQINNIKDRATAEKDSIRKIIRLLKVWKNTKYNYPTKSFFLELITIKAFDNVEITGDLWNKLKSVMEYIRDNVTNDGFTLKDPGNSANNLVDTLTDNEKQQLSDDMKNMLNRIEENEENIKIYFPENSKFKEENKNRYGTNNGMPMPPPNLNFG

SEQ ID NO: 3782 - protein, 326 aa, Myroides odoratimimus
MDKNLHLDSVIKTHQITKEEQLLTKHKDKSKEVKEALEEKYESNIYSPFNSGSYAKNTAMNTKFDFDMVCPFKRNAFGSNGTLKQMYEDVFDFLYEKYKDEANVRKQKVSIGIEFFADEDGDIVKIDVVPGRELNQDQYKDDENLNLYVYYKYGNFDQGSERIKTNVQAQIKNIKDRATKEKDSIRKVIRLLKVWKNTKYNYPVKSFFLELITIKAFDNKDVSGNLWSKLETVLQYIRDEVTGESFTLKDPGNSSNDLIETLTTSERQTLSDDMKNILERIEDNDENIKTYFPENSKFVEEEESDNKYENKGNGFYSNPPKNERFG

SEQ ID NO: 3783 - protein, 326 aa, Flavobacterium sp.
MDKSLHLDSVIKTHQITKEEGLLNKHKDKNKEVKEALQQKYESNIYSPFNSGSYAKNTAMNTKFDFDMVCPFKRNAFGSNGTLKQMYEDVFDFLYEKYKDEANVRKQKVSIGIEFFADEDRDVVKIDVVPGRELNQDQYKDDESLNLYVYYKYGNFDQGSERIKTNVQAQIKNIKDRATKEKDSIRKIIRLLKVWKNTKYNNPAKSFFLELITIKAFDNKDVSGNLWSKLETVLQYIRDEVTGESFTLKDPGNGSNDLIDTLTTLERQTLSDDMKNMLERIEDNDENIKTYFPENSKFLEEEESDNKYENKGNGFYSNPPKNERFG

SEQ ID NO: 3784 - protein, 326 aa, Flavobacterium araucananum
MDKSLHLDSVIKTHQITKEEELLNKHKDKNKEVKEALEQKYESNIYSPFNSGSYAKNTAMNTKFDFDMVCPFKRNAFGSNGTLKQMYEDVFDFLYEKYKDEANVRKQKVSIGIEFFADEDGDVVKIDVVPGRELNRDQYKDDENLNLYVYYKYGNFDQGSERIKTNVQAQIKNIKDRATKEKDSIRKIIRLLKVWKNTKYNNPAKSFFLELITIKAFDNKDVSGNLWSKLETVLQYIRDEVTGESFTLKDPGNGSNDLIDTLTTTERQTLSDDMKNMLERIEDNDENIKTYFPENSKFLEEEGSDNKYENKGNGFYSNPPKNERFG

SEQ ID NO: 3785 - protein, 326 aa, Flavobacterium psychrophilum
MDKNLHLDSVIKTHQITKEEQLLNKHKEKNKEVKEALEKNYGDSIYSPFNSGSYAKNTAMNTKFDFDMVSPFKRNAFGSKGTLKEMFEDVYDFLYEKYNDVATVRKQKVSVGIEFHSDDDGDIVKIDVVPGRELNQDQYSDDENLNLYVYYKYGNYDAGSERIKTNVQAQIKNIKDRATTEKDSIRKIIRLLKVWKNTKYNYPTKSFFLELITIKAFDNKAITGNLWSKLETVLEYIRDEVTKDGFTLKDPGNSSNDLIDSLTESERETLSYDMRNMLERIEDNDENIKTYFPENAKFVEEEKADNKYENKGNGFYSAPPKNERFG

SEQ ID NO: 3786 - protein, 325 aa, Chryseobacterium oranimense
MDKSKHLESVIKTHQITKEENLLKKFKGKNSEVKESLERNYGIKIYSPFNSGSYAKNTAINTRFDFDLVCPFTRNAFGSNGTLKNMYEDVFDFLQKEYRDLATVKRQKVSIGIEFYADEDGDIIKIDVVPGREFNVDQYKDDQNLNLYVYKQYGLFAEGSDRLKTNIEAQKAHVIDRVASEKEKIRKIVRLLKIWKVESNKKYKSFFLELFVIKAVDKEDVSGSLWQKLETVLMYIRDNCTTEGFKLTDPGNSSNNLMDTLEDFEKVNLKNEMSNMLTQIEYKDENLKYYFPENQKFVETEEEKEQYNSKQSASPLYVPPKVNFG

SEQ ID NO: 3787 - protein, 318 aa, Mucilaginibacter sp.
MATDKNKHLNDVLTSHKVSKEQDLLDKHKRKRDEICDALVEKYGADIYSPFNSGSFAKNTAVNKKFDFDLMAPFKRNAFSTLENMFNDVYDFLLEKYSSSAHVRKQKVSIGIEFFADDKGDIVKIDVVPGRELNQDQYKEDDKLNLYVYSQFGKLQSGSDYIRSNIKAQVQNIKDNADRANLRQKVRLLKVWKLYNNKTPKSFFLELITIKAFDKLEISGGLWDRLKSVIEYIRDNVTTVSLPDPGNSNNEVADSMSDYEKSALSDDMRNMINRIEENSDYIKIYFPLNDKFPVEDTSNNKYDERKVAPSIPPPTRFG

SEQ ID NO: 3788 - protein, 280 aa, Pedobacter hartonius
MKDNYGADIYDPFNSGSYAKNTAVNKKFDFDLMAPFKRNAFATLKEMYDSVYDFLYEKYNGDATVRKQKVSIGIEFYADEDNDVVKVDVVPGRELNKDQYKDDKKLNLYVYYQFGKMEAGSDYIRSNVSAQVSNIKENANKGDLRKIIRLLKVWKIHNNKIPKSFFIELITIKAFEKKDVSGSLWDKLKIVMEFIKNNVKTISLPDPGNSGNEVADSLSDLDKSAMSTDMENMIDRIEENSDNIKIYFPLNEKFPVEEGSKNQYGSSNAGFSVPPATRFG

SEQ ID NO: 3789 - protein, 311 aa, Pedobacter hartonius
MASPVLITHRISKEEALLNKHKDKRDEIVSALKDNYGADIYDPFNSGSYAKNTAVNKKFDFDLMAPFKRNAFATLKEMYDSVYDFLYEKYNGDATVRKQKVSIGIEFYADEDNDVVKVDVVPGRELNKDQYKDDKKLNLYVYYQFGKMEAGSDYIRSNVSAQVSNIKENANKGDLRKIIRLLKVWKIHNNKIPKSFFIELITIKAFEKKDVSGSLWDKLKIVMEFIKNNVKTISLPDPGNSGNEVADSLSDLDKSAMSTDMENMIDRIEENSDNIKIYFPLNEKFPVEEGSKNQYGSSNAGFSVPPATRFG

SEQ ID NO: 3790 - protein, 319 aa, Bacteroidetes bacterium
MATDKTKHLKCVLDSHKIQKEQALLDKHITKKDEIKAALKEEYGSKMYEPFNSGSYAKHTAINTKFDFDLVAPYKRDAFDTLKEMYNAVHDFLHKKYSDEATVKKQKVSIGLEFFADEDGHVVKVDVVPGRELNQDQYKDDNNINLYVHSQLGTIPEGSERLKTNPKAQISNVKDHAEKESVRHDIKLLKIWKVQNGKKPKSFFLELITIKAFDKKDITGDLWDKLKAVLEFIRDEVKTISLPDPGNSNNDVADTLTDVEKSDLSDDMKYMLERIEENSDNIKLYFKVNPDHPCEDKMEENKYNVKREGVSAPPATRFG

SEQ ID NO: 3791 - protein, 283 aa, Spirochaetes bacterium
MKHVETLMNNYIKKRDDVKECIEQKFSGLIYNPINSGSYAKSTEINIKFDLDLCVPVKKNSYNTIKEMYDSFYDYFYYEYRKLDKELIEVRKQKTSIGLQFQIGRDKIDMDIVPGRELNVDSYPENNDLNICDSKNNSCIQTNIQEHINLIKGKNSEREIIRLLKIWKYKEQFDIKSFLIELLVIKAFENNQDVTGIWEQLKMTLEFIKDNIKTIKLVDPANSGNIVSKTLTDYEKINLEDKFNRILNSINAYEENIKIFFPENSNYKIKENSYSSLKTNIYG

SEQ ID NO: 3792 - protein, 319 aa, Fluviicola taffensis
MNKNNYLASALESHRMSHVDDLLAKYIEKREIVKDALQTKFKDQIVTRAINSGSYAKHDAINTKFDLDLCQPFKRNAFTTLEEMADAVYDFLNEEFEDDDLVKYKTRKQRVSTGITFVIDGDEIQMDVVPGRELLADDYAQTNRLNLHVRPKLLQPASTTQTNIQEHINLVKGKNAERSIVRLLKVWKTNKNQSRVKSFFVELITIRAFENCTEIPTGLWEQLKMVMEYIRDNVETIRLVDPANSNNVVSSTMTDSEKYNLHLDMKQILEMVELNDENLKIYFPVNDDFYNEEEEEAKRKQAALNLSRSGVISQPWCNR

SEQ ID NO: 3793 - protein, 331 aa, Chryseobacterium sp.
MATDKQKHLDEVLETHKIEKHKSIDKFVSKKNKVKNALNEKFSKEKASNSVDSGSYAKNTAINTKFDIDCCIPFLKKENNTNQQGFESLSEMFNAVYDYLKKEYKDDDLKEVRKQRVSIGLLFDIDGEDFNMDVVPGRERPNHGNYNTDGNTDLSLYINEKSLKEDEKGATKVKTNIKKHVGLLQGENRKHERKVARLLKVWKTERKKQKGGKLIKSFMMELYTKECFDKNSDNIPFGLWEKVKLVMNYIADNIEINDLKDPANSSNIISDAMSDSAKSTTKSDMRKTIKEIDEDSDKIKDYFPINENYKDEDKKTNSNNSASYLNTNKFG

SEQ ID NO: 3794 - protein, 339 aa, Polaribacter vadi
MAKNKDEHLKKVIDTHDINKVEHLSKFIAKKNKVKEALNNKYSDKKASNSIDSGSYAKNTAINTKFDIDCCIPFRKKSKDNNDEKGFETLSEMFDDVYKYLKNEYTKNDDDISKENVRKQKVSIGLKFDIDGVEFDMDVVPGRERPSNNDYNDNNTDLSLYINPSNKSKKEEENSKTRIKTNIKTHVGLLKGANRIHERKVTKLLKVWKTERKNQNGGKLIKSFMMELYTKEAFDNSVEIPIGLWEKVKLVMNYIIDNIETTNLVDPANSSNIISDSMSDTAKTQTKRDMKNTIKDVDDDSDKIKEYFPLNDEFDDDDDDDDDSKSVSTASILSTSKFG

SEQ ID NO: 3795 - protein, 306 aa, Hymenobacter sp.
MADLNKNDYLGCVHRSYGINLEEDLVEDNQSLADRYRKKRDKVQTALENKFGSNIRCIQHSGSYAKHTAINIKFDMDLCVNFKRSAFTTLRVMYDDVLEYLESDEFSDEVGDLTDVRAQKVSVGLFFLVDDEVLNFDITPGRRISDDDPSCFDLNLCLNDEDSSGRMKTNIAKQIDHIKGRKKERETVKLLKAWKFEHFTKLKSFLLELLTIKSFDDKGEANIPSGRWDRLKLTMEFIRDNIETINLLDPGNSGNNVTNSLTDRQKKKLAKEMKRALKQIEADSNKLKFYFPVNPKFPCEDKPKDR

SEQ ID NO: 3796 - protein, 338 aa, Hymenobacter sp.
MPIKTVMADLNKNDYLGCVHRSYGINLEEDLVEDNQSLADRYRKKRDKVQTALENKFGSNIRCIQHSGSYAKHTAINIKFDMDLCVNFKRSAFTTLRVMYDDVLEYLESDEFSDEVGDLTDVRAQKVSVGLFFLVDDEVLNFDITPGRRISDDDPSCFDLNLCLNDEDSSGRMKTNIAKQIDHIKGRKKERETVKLLKAWKFEHFTKLKSFLLELLTIKSFDDKGEANIPSGRWDRLKLTMEFIRDNIETINLLDPGNSGNNVTNSLTDRQKKKLAKEMKRALKQIEADSNKLKFYFPVNPKFPCEDKPKDREPAKASNRYEQNAAVKQTTYPATTYG

SEQ ID NO: 3797 - protein, 346 aa, Hymenobacter lapidarius
MRKEATPYMPIKTVMADLNKNDYLGCVHRSYGINLEEDLVQDNESLADRYRKKRDKVQTALETKFGSNIRCIQHSGSYAKHTAINIKFDMDLCVNFKRSAFSTLRLMYDEVLEYLESDEFSDEVGDLTEVRAQKVSVGLFFLVDDEVLNFDITPGRRISDDDPSCFDLNLCLNDEDSSGRMKTNIAKQIDHIKGRKKERETVKLLKAWKFEHFTKLKSFLLELLTIKSFDDKGEANVPSGRWDRLKLTMEFIRDNIEAINLLDPGNSGNNVTNSLTDRQKKKLAKEMKRALKQIEADSNKLKFYFPVNPKFPCEDKPKDKEPAKASSRYEQNAAVKQTTYPATTYG

SEQ ID NO: 3798 - protein, 319 aa, Pontibacter korlensis
MSTFKNNHLQFVLDTHNINREEEKDLLDKYKTKRDKVKDALCEEYGSDIVKIINSGSYSKFTAINTKFDLDLCVHFKREKFKTLKEMHDSVYEFLKKEYKKTDDDLVKVRKQKVSVGLKFNVDGDDVLFDVTPGRKLASDSNSDENDIKLYLNKEDDPTSKKTNIHKQLEKIRGRTNERETIKLIKVWKFNHDHDLKSFLVELLTMEAFDQAEDVPRGLWARLKMSLEFIRDNIKTISLKDPGNSNNNVADSLTSERKDELHEEIEEMLEKIEKDEKKIEYYFPANPKYPKEEEKKSSSNSQYERKSEATTKLPPTSYA

SEQ ID NO: 3799 - protein, 319 aa, Pontibacter ummariensis
MSTYKNNHLQFVLDTHNINREEEKDLLDKYKTKRDKVKDALCEEYGSDIVKIINSGSYSKFTAINTKFDLDLCVHFKREKFKTLKEMHDSVYEFLKKEYKKTDDDLVKVRKQKVSVGLKFNVDGDDVLFDVTPGRKLASDSNSDENDIKLYLNIEDDPTSKKTNIHKQLEKIRGRTNERETIKLIKVWKFNHDHDLKSFLVELLTMEAFDQAEDVPRGLWARLKMSLEFIRDNIKTISLKDPGNSNNNVADSLTSERKDELHEEIEEMLEKIEKDEKKIEYYFPANPKYPKEEEKKSSSNSQYERKSEATTKLPPTSYA

SEQ ID NO: 3800 - protein, 317 aa, Rufibacter sp.
MSTYKNEHLQLVLDTHNINRDEEKGLLDKYKTKRDKVKDALYEEYGSDIVKIINSGSYSKCTAINTKFDLDLCVHFKRDRFNTLKEMHDSVYNFLNSNYKKEDDDLVKVRKQKVSVGLKFSVDGEDVLFDVTPGRKLASESTSDENDIKLYLNLEDDPSSKKTNIHKQLDKITGRTNERDTIKLIKVWKFNHDFDLKSFLVELLTMEAFDKAEEVPRGLWARLKMALEFIRDNIKTISLKDPGNSSNNVSDSLTTEAKEELREELEEMLEKIEKDEKKIEYYFPANPKYPKEEVKKSNSQYERKSEATTKLPPTSYA

SEQ ID NO: 3801 - protein, 291 aa, Segetibacter koreensis
MTAYRNKRGKVREDLKKKFEGEIYQILHSGSYKKFTAVNIKFDMDLVVPFSKDEADALEKIYNDLYKYYDTEYRKKDTSLLEVKAQKVAIGLTFFVDGKLLDLDIVPGREINDYEKDGDLNLFVNDRRNGNSKATTLKTNIEKQIDNIRNNSVARETIKLFKIWKRRNNGQIKSFVIELIVIKALEGYAGASDRWSKLKHVLTYIRDNIKTVRLVDPGNTNNIVSDSLEDFQKNSISETSKWMLEDLEKNEKSIERYFPVNTEYPCKEENKSAYIIGASKKPDQLNDEDFG

SEQ ID NO: 3802 - protein, 312 aa, Chitinophaga sp.
MSKYKNEHLDCVLKSHKIENNETLMIAYRAKRDEVREQLKAKYAGRIYRVLHSGSYKKFTGINIKFDMDLVIPFRRNEAGTLEELYNELFTYFNEEYGKIDSSLRSVKRQKVAIGLEFYVDGEILDLDIVPGREIGDYEKDGDLNLYLNNINGEKGATLKTNIQKQIDNISGNSEARDVIKLLKVYKRQNNEAIKSFVIELMVVRALIGYKGDGNIWSKLKHTMTYFKDYMTTARLVDPGNQNNIVSDSLSAIQKEAIASRFSNVLQQIESDEALLKVYFAVNTKYPCEPKRSAYVVNDNTRADTLNNEDFG

SEQ ID NO: 3803 - protein, 298 aa, Clostridiales bacterium
MTAHQYLESVLEANKFDDESTGQTVAERRAEVEEKLRKEFGSKIQTIKYSGSIAKATAVKDSYDVDIAVHFKHDAFDKLKEMFDAVYDFLKKHYTVRKQRVSVGIKSLHVDVVPGRRINADDPQDNDVNLYRTDTDSRIKTNIVKQIDAVSASSVRDVIKLTKIWRDVWGLSFKSFALELLVMKALDGFDGSGLDNKMKTVLTFIQENVENVILSDPGNPSNNVADTIDSGDKEYFKKTATKCLGFLEDAEQDEDPDMENAWRKVFKDQTVNESGSSAGSRIIVMTQDKRVHVDRTHG

SEQ ID NO: 3804 - protein, 299 aa, Parageobacillus thermoglucosidasius
MTVKEYLESLLEQEKLSDEEIQEIREKRDEVEELIRKEYGSKIVSFKYSGSIAKKTAIKSSKDLDLAVHFKKDSFKTLKEMFNSVKEFLEKHYDGIREQRVSIGIPSLNVDVVPGRRIDEEDLTNNDVYLYRSDNDSWIKTNIEVHKTHITQSGCRDVIKLTKIWRNNWGLKFKSFAIELLVIQALKSSESTTLKDKFKEVLEYIEENIESVNLVDPANQNNNVADIIDNSRKTLMKLRASNCLRILNEAGESMDEQVSAWKQVFNDQNNIFNSVLSFGVIKRETSDWGHQPNRRHGNF

SEQ ID NO: 3805 - protein, 296 aa, Parageobacillus thermoglucosidasius
MTVNEYLEKLLEDHKLSDEEREEIQATSDEVREKLNNEFGSKIITIKYSGSIAKHTAITESKDIDLAIHFKKTAFETLEEMYNSVFDYLQKNYAVRKQKVSIGLVDLNVDVVPGRRIDEEDESNNDVFLYKTDDGGRIKTNIETHKKYISESGCREIIRLAKIWKIKHDLKFKSFALELLVIQALKNSDKTSLSDRFKEVLEYIRENVEQVRLVDPANSNNNVADAIQPIDKTLFKMKAEIGLGYIKDAEEGRESHLSAWKKVFNDFSGDSDGNSSNIIIKRETADYGRQPERRHG

SEQ ID NO: 3806 - protein, 295 aa, Massilibacterium senegalense
MTIAEYLESLLEEEKIDDKAKEEIKKKRDEVEIAIRDEFGDKVKTVKYSGSIAKHTAINSSKDLDLAFHFKKESFDTLKEMYNAVFDFLDDNYNVRKQKVSIGLIDFDVDVVPGRRIDEEDDSNNDVFLYRSDDDSRIKTNIEKHKSHITESGCRNVIKLMKIWKNKWNVKFKSFAMELLVIQALEDSVATGLKDRTKEVLEYIVDNVEDINLIDPANSNNNVADVIEYHKKLFMKTTASNCLSYLDDDNDSQLSAWKKVFNDFTGTTNNSYYTGSSVVKRNTSDWGRQPDRRHG

SEQ ID NO: 3807 - protein, 263 aa, Unknown
  Description of Unknown: uncultured bacterium sequence
MTGNQYLSQILYKYQVRNLSLYTNQISNLKTILKGWANSCFIETLESGSRAKWTAIHLASDVDYLVSLKSNCNESSWWLKSIYDSLYVKLKEVYWNSNVRKQNVSFRIIIGGDLEVDVTPARKHSGNTNYHWLYVSKKDTWQQTNIQIHKTDISQSWRTNEIKLLKIWRELNNLDFPSIYAEYLIIDNILHGKTTNIDYLADNFLYILRELSKDSGNPLFARIVDPANSNNTLSDLLTINEKNLIINKAKESSLKPYWENIIW

SEQ ID NO: 3808 - protein, 254 aa, Desulfosporosinus sp.
MSPDEYVRNIISKYKVVGDIGLYTQLLVLNPLIETIKEWAGDCLNEIKISGSRAKGTAINISSDIDLFISLKSKTDNTLKEIYDSLYDYVKSKGIDCRKQNVSIGINYKTHSIDLVPGKKHTGNTNDHSLYRSKKNTWTQTNINKHIKLVKDSGRLEEIVLMKVWRKLHNLDFPSIYLELIVIDALTNKNKNQPSKNFLTVLDFLVSSIVEKKVFDPANTNNEISDDLYKYEKEIIAKKAKESRNQKHWEDIIW

SEQ ID NO: 3809 - protein, 253 aa, Paenibacillus sp.
MPDKYVLTIKNKYHIQSVIDASTQKNVIDPLVQHISKWAGEFLNGIYLSGSRVKGTAIKLSSDLDLFISLKSTTDITLKEIYDSLYNYIDSAGYKARKQNVSIGVNISGMQIDLCPAKKRPGNTNDHSLYINKRDTWTQTNIIEHINKVQNSGRISEIVMLKIWRKLHKLEFPSIYLELTVIEALRGKNKNTPANNFLLLLEYLGDEFIGKKVIDPANTNNIISEDLYKYEKEAIQKKARESRSQKYWKYIIW

SEQ ID NO: 3810 - protein, 253 aa, Paenibacillus rubinfantis
MSDQFVMNIFNKYHVKKELDPLTKMFVITPLHNVVMEWAGSCLNSVELSGSRAKGTATTLSSDFDLFISLKHDTENTLKEIYESLFNYLDQKGYKARKQNVSIGVHLWNTAVDLVPAKKRPGNTNDHSLYISKRDTWTQTNVIRHINTVRDSGRIVEIVLLKVWRKLHGLDFPSIYLELTVLEALKGRSKSDPANNFLALLDYLRDEFVDKTIVDPANTNNTISDDLFKYEKEAIRKKAKESRSQQYWENIIW

SEQ ID NO: 3811 - protein, 254 aa, Paenibacillus sp.
MTPDQYVISIAKKYYVQKDVDFLTNLHVVEPLKNVIQQWAGSCLQDIYLSGSRAKGTAISLSSDLDLFISLRSDTENTLQEIYNFLDNFLTHKGYATRRQNVSIGVRVWGNAVDLVPAKKRPGNTNLHSLYINKRNTWTQTNVKIHIDKVLNSGRIVEIVLLKIWRKLHGLDFPSIYLELTVIEALKGKNKNTPASNLIALLEYLKTEFVGKTFYDPANTKNIISDDLYKYEKEAIRKKAAECLAMSRWEDVIW

SEQ ID NO: 3812 - protein, 253 aa, Devosia enhydra
MTADDYLRQILAREAVDDGPGAPLRLLEAEIVQILGDWIGSALQEVAPGGAFEKGTANASGVAIDFVAFITPDCPIPIEALYESLHLHLHALGLDPVRRPVSIGIRLDDMMVDIIPARLLPGRPSEVRLYNERRECGFDTNMLWHRHDVRSAGRAEEIRLIKLWRDQNRLELPSLYLEFAVIAALRGKPPGALAMNLWSVLAHFSSLFVARAAIDPANANNFVSDMLTTAEKQQVKSVAQATMAQRAWQHIVV

SEQ ID NO: 3813 - protein, 254 aa, Desulfosporosinus sp.; identical to SEQ ID NO: 3808

SEQ ID NO: 3814 - protein, 255 aa, Desulfosporosinus sp.
MLSPDEYVRNIISKYKVVGDIGLYTQLLVLNPLIETIKEWAGDCLNEIKISGSRAKGTAINISSDIDLFISLKSKTDNTLKEIYDSLYDYVKSKGIDCRKQNVSIGINYKTHSIDLVPGKKHTGNTNDHSLYRSKKNTWTQTNINKHIKLVKDSGRLEEIVLMKVWRKLHNLDFPSIYLELIVIDALTNKNKNQPSKNFLTVLDFLVSSIVEKKVFDPANTNNEISDDLYKYEKEIIAKKAKESRNQKHWEDIIW

SEQ ID NO: 3815 - protein, 254 aa, Paenibacillus sp.
MTQDDYVINIAKKYHIKSDIDIHTQNTIINPLKSLILQWAGVCLNDIQLSGSRAKGTAISLSSDLDLFVSLKSTTKNSLSEIYNSLYYHMNQAGYKVRKQNVSIGIKIVDKQVDLVPAKKRTGNTNYHSLYLNKQKTWTQTNIAEHINIVRNSNRITQILLLKIWSKLHRLNFPSIYLELIVIEALKGRNTNNHAENFLLILNYIIDKFTDKKIIDPSNTNNIISNDLNKAEKEIIKNQAISSRLQSSWEKIIW

SEQ ID NO: 3816 - protein, 169 aa, Tindallia magadiensis
MSDGYVLNIINKYNIKSSVDLGTQNNVINPLVQLISDWAGEYLNDVYLSGSRAKGTAIYLSADIDLFISLKSTTDKTLSEIYDSLYRYFNYKGYKVSKQNVSIGVNIAGKQVDLVPATKRPGNTNYHSFYISKQNTWTQTNVIEHINKVENYDRLFEIFLLKHGVIYTN

SEQ ID NO: 3817 - protein, 253 aa, Paenibacillus sp.
MSDEYVLKIANKYHIKSEIDGATERDVINPLKKLISKWAGECLNDVYLSGSRAKGTAINLSSDLDLFISIKSTTSNPLNEIYDSLFNHIEGAGYKTRKQNVSIGLNVAGKQVDLVPAKKRPGNTNDHSLYISKRDTWTQTNVIEHINKVKNSGRITEIVLLKIWRKLHNLDFPSIYLELSVIEALSGKRKNTPASNFLAVLDYLRDEFLSKKIIDPANTNNVISDDLFKYEKEAIQKKAKESRSQKYWKDIIW

SEQ ID NO: 3818 - protein, 253 aa, Bacillus sp.
MSNEYVISVANKYKVDEEVDYYTQCFIINPLTSLIREWAGDRLNNIYLSGSRSKNTAISLSSDLDLFISIKSDTDNTLRQIYESLNGFFKYKGYKTREQNVSIGIEIGGKKVDLVPAKKRPGNTNYHSLYLSKKGSWTQTNILEHIRIVKNSGRTTEIILLKIWRELHGLSFPSIYLELTVIEALKSKSKNNPSGNFLTVLQYLRDEFINKTFIDPANTNNVISDDLYKYEKEAIRKKANDSLSQQYWEDIIW

SEQ ID NO: 3819 - protein, 254 aa, Bacillaceae bacterium
MDSTEYLNNVITKYHVGEQIDVSTQYFVINPLREQILNWAGVCVNDIKISGSRSKGTALNISSDIDLFISLHSSYSGTLKSMYDSLYTYMMNRGYKSRKQNVSIGVNLNGHSIDLVPGKKHIGNTNYHSLYLNKRDSWTQTNIDQHINLVKNSGRVNEIILLKIWKNLHGLEFPSIYLELITIDALRYKQKGNLANNFLELLRYLASGFVDKRVVDPSNSNNIISDDLYKYEKEKIATTANSSLKEQYWSSIVW

SEQ ID NO: 3820 - protein, 254 aa, Unknown
  Description of Unknown: Clostridium sequence
MTADQYILSTIKKYMVEGDIDVLTQILVVNPLEEIVKSWAGNCLNGFYLSGSRAKGTAIKLSSDMDFFISLKSDTNGTLKEIYNSLYNKMNNEKIPARKQNVSIGITYGGHKIDLVPARKHTGNTNFHSLYRSKADTWTQTNVSNHINIVKNSGRITEIVALKIWSRLHKLEFPSIYLELTVLNALANMNKNQPAKNLWAVFQYLRDHFVDKTVIDPSNSNNIISQDLYKYEKEAIANKAKESLSKQYWKDIIW

SEQ ID NO: 3821 - protein, 256 aa, Candidatus Roizmanbacteria bacterium
MLPDLYIRQVVANKTQKRGLIIDPRITLAINTMRPIISVWAGNQLADFVISGSYAKNTTVMGSTDLDLFISLKSDTTNTLKEIHDLLNKRLMARGYITRPQNVSIGITLNNLKIDLVPGVKQSPLTGDHAIYKRKTDSWVKTNIVKHINLVKNSRRTEEIRALKIWRELNGLDFSSFYLEMTVIEALRGRIFLSGLANNIWAVFGYLATKFENARIVDPVNTNNIVSDDLTVTEKQAVAQIARLSLQQRYWENIIS

SEQ ID NO: 3822 - protein, 255 aa, Candidatus Magasanikbacteria bacterium
MNEIDNYIRQIVAQHTPNITYIVQNKINELLPHINVWANGHKYNLKLSGSLAKGTGITGTTDIDFFISLDPSVSTCNTLENVYNTLRNRFNGAGYVTREQNVSIGINHSGLKIDIVAGVKHHPLGFDHSIWKRKAQKWTKTNVDEHIKFVKQSGRIFDIRVIKIWRKLMGLDFPSFYLELSVIEALKGRSLLSLSPSENFVQVMNYLANDFVDKVIVDPANENNEVSEELTNIEKQAIKDAAKASLRSAWDHVIY

SEQ ID NO: 3823 - protein, 260 aa, Candidatus Atribacteria bacterium
MNANTYLLSIIKKYSILEEERTRILSRVKALWREIRKWNNQYIIEIIPSGSFSKGTAIKGSAVDIDLLISLKNQTPFTLKEAYESLYEYLCHSYCPRKQNVSIRIVFNGIKVDLVPAQRQPNVLYPHSIYVSKFDTWTKTNIHKHINMIKKSPHKNIIILLKIWCHLHKLDFPSFLLELTVLEALKRKPFFGIEKNFLIVLKYIIEQFSCVKIYDPANTNNIVSDTITDNQKLQIIQMARSSYESDCWEKIVWGLYEIRK

SEQ ID NO: 3824 - protein, 251 aa, Microscilla marina
MEADEYLYMIIGEYRAPNIHIRDSRLTDVKQLIREWAHKNLEGIYLFGSCAKKTALKGNSDCDLFISLYSDTTESLHDIHLLLFKQFKYAGYSVRKQNVSIRAKINGLEIDLVPGRIQRGESNNHSLYVSKEKSWVKTNIHQHLDLVERRGRQDEILATKIWRTCHKLKFPSIYIELVVMRVLKGKRKEHIEKNFNAVLEFLSSDFIYEKVVDPSNKNNVISDLITERQKKAIQKKAEQCLYKQNWNAVIW

SEQ ID NO: 3825 - protein, 251 aa, Ichthyobacterium seriolicida
MMSDKYIKGVIKKRKAASILILDIRLTQVKSIIRDWADTMLSSITLSGSTAKGTAIHGRADCDLFISLKSDTSETLKKIYDSLYNIFKQNGYFTRRQNVSIGIQDNGLHIDLVPAKNCVGNTNYHTLYVRKKDSWTKTNVKNHINLVTGSGRVEEILATKIWRECHELDFPSLYIELLVLRALKNKKKGDLANNFLAVLEFIRDSIETAAFTDPSNTANSISSMLTKAEKTTLKNAATNSLSKQYWSNIIW

SEQ ID NO: 3826 - protein, 253 aa, Hymenobacter gelipurpurascens
MTASDQYILEVIARRSVTPVHLGDARLYSILSIIRNWAGSALNDIKLSGSSAKNLVVQGQPDTDIFISIKSSSDATLKTIYESLNSTLRSNGIIASKRTVALNINYNGLDIDLVPGKVQPGYKIWHSLYNSESDSWLQTNIDEHIKIVKNSGRDQEIRAIKIWAKQNQLKFPSLYLESLVIDALYNRSKENLATNIFIVFKFLNENVELRRVVDPANTNNVLSSYMLTSREKQNIAKAAGKAYNENYWNNIIN

SEQ ID NO: 3827 - protein, 254 aa, Clostridium aminophilum
MTPNQYINSIVQKHRLPDSLDEYTSLNVVAPLKRIISSWAGTCLCEVKLSGSRAKGTAIDLSTDLDLFISLSSTTNNSLREIYESLYSRIQDEGIEARKQNVSIGIDYLGKKVDLVPAKRQGQYGNDHSLYKRKEDTWTKTNIDTHISQVRQSGRLTEIIALKVWRENHSVDFPSIYLETFVIDSLRGRSLNSPADNFIYLLKDIRDNIQYRRVIDPANSNNVLSDELTLMEKRKLQSMADSSISEQYWRDIVW

SEQ ID NO: 3828 - protein, 254 aa, Clostridium clostridioforme
MTANQYVESIVKKHKLPDTIDNYTDNIVVTPLKKIIRNWAGTCLCDIKLSGSRAKGTAIDIATDLDLFISLSSTTSNNLKEIYNSLYDYVVRQGITARKQNVSIGITYQNKDVDLVPAKRQGQYGNDHSLYRRKADSWTKTNIDTHIHKVKNSGRITEIVALKIWRENHNLDFPSIYLECFAMEVLWGRNLYSYADNFRFLLENIRDNIDSKRIIDPANSNNILSDELSYNEKKKLAMQATSSLNERYWESIIW

SEQ ID NO: 3829 - protein, 253 aa, Betaproteobacteria bacterium
MTPDEYVDAVLVKYAVPRGPYSPAEQLGSAVAGPLRSWANQYLSALQYSGSYAKETGVHGISDVDVFISLKSETPGTLKELYNQLHSLANNQGWSPRQQNVSIGITVNGTKGDLVPGKVQSSHQNYHSLYLRKRDSWTQTNIALHVDTVRGSNRQQEIRAVKIWRFLHGFDFPSLYLELFTIQALSGHSRTTLADNVLHALRTIGTTLASTRIVDPANTNNVLSDDLTKAEKEHIASRAAQSAREQYWKDIIS

SEQ ID NO: 3830 - protein, 253 aa, Deltaproteobacteria bacterium
MTGDEYILSILKKYEVPRGPESPAEQTAKHIAPKIQRWAGGWLSALSFSGAYARQTAVHGVTDVDLFISLKPGMPGTMQKIYDELFTLAALHGWNPTRRNVAIGISKNGITLDLIPGRAQAGDESYHELYWLKSDSLRQTNLSLHIEAAAKSHRLREIQAIKIWRHIHQLDWPSLYLECFVINALTGRNTDSLAHNVLHALDMTGEALATTCIVDPANPDNVLSLDATPEDKKNIAEQAKKSAAQQHWEDIIW

SEQ ID NO: 3831 - protein, 253 aa, Unknown
  Description of Unknown: candidate division WOR-3 bacterium sequence
MTPDDYVLLIVSRHSPPTGLQSPVHEVRAQLQRPIKSWAKRYLLDIRFSGSYAKCTRVIGCTDADLLISLGPRTPGTMKQIYKNFFAYLAVKNYGPRQQNISIGITYSGLKIDLIPAKKHWGSTNNLSLFEVERQREIQTNIDTHISLVRQSHRLDEIKATKIWHNLRHLRFPSFYLELTVLNALRSSEENQPAANILTVLEYLRDKFISSRVSDPANSNNIISDDLMLHERMAISRAATDSLKESDWGKIIW

SEQ ID NO: 3832 - protein, 245 aa, Motiliproteus sp.
MSGDTYLRSLLLKYSVDADGAETAGVKLNPTIARWSNGNLSRAYFSGSLAKGTWISLGTDADVFLSLSSVTPGTLSHMYESLFQSLTADGYVSRRQNVSIGVRIDGFSIDLVPGKRQSHYGNVHSLYRSKADSWTQTDVNSHISTVKGCGRIEEIRVLKIWKYRHGLSFSSFFLELAVIEALKHRPRENLANNVWAVLEHLRDRIQSARYVAPANTNNIVSDDCTVAEKATITRGWNKSQNATAF

SEQ ID NO: 3833 - protein, 247 aa, Motiliproteus sp.
MAMSGDTYLRSLLLKYSVDADGAETAGVKLNPTIARWSNGNLSRAYFSGSLAKGTWISLGTDADVFLSLSSVTPGTLSHMYESLFQSLTADGYVSRRQNVSIGVRIDGFSIDLVPGKRQSHYGNVHSLYRSKADSWTQTDVNSHISTVKGCGRIEEIRVLKIWKYRHGLSFSSFFLELAVIEALKHRPRENLANNVWAVLEHLRDRIQSARYVAPANTNNIVSDDCTVAEKATITRGWNKSQNATAF

SEQ ID NO: 3834 - protein, 250 aa, Polynucleobacter sp.
MTADEYLQSLLQKYAVNVSGANAAGSAIYPVLEKWGNQYLNNASYSGSLAKGTGISAATDADIFLSLSSTTPGSLADMYMSLYNAVTAVGYVARMQDVSIGVTVNGYSIDLVPGRRHSQYGNDHSLYRNKKATWTQTNVNTHISYVTGSNRIDEIRILKLWRLRHGLSISSFYLEMAVIDSLRYARAGNIAVNVWQALEHLRDKIETAQYIDPANTNNIVSDDCTKAEKAAIAAKARESLGKKTWEEIVW

SEQ ID NO: 3835 - protein, 250 aa, Marinobacter sp.
MSEDTYLRSILQKYDVNISGAEAAGNSIYPVIQRWGNSYLVKAEFSGSLAKGTGINIGTDADIFISVSSNTPGTLADLYGTLFDAVTQAGYTARKQNVSIGTTVNGYNIDLVPGRRQSQYGNDHSLYKSKSGSWTQTNINTHINHVKNSNRIEEIRLSKIWRQLHNLEFPSFYLELAVIDSLKYSTAGNLSANFLKVLEFFRDSLPSTRYVDPANTNNIISDDLTAAQKIAISSRARLSRNQQNWGGIVW

SEQ ID NO: 3836 - protein, 250 aa, Scytonema hofmanni
MSEDEYLQGVINKYTVDASSSEAAANSIYGVIYSWANGCLNDAKFSGSLAKGTAVSLGTDADVFLSLSSTTLGTLSQIYNSLYNAVTDAGYTARKQNVSIGVNIGKYKIDLVPGRRQSQYGNDHSLYKNKTNSWTKTNIDIHIYTVRNSNRIDEIKLTKIWRELHRLDFPSFYLELAVIDCLYGCRYGQLASNFFSVLSFLQDKLQNRRYVDPANSNNIISDDLSAYEKQLIAAQAQTSINKQYWREIVW

SEQ ID NO: 3837 - protein, 250 aa, Tolypothrix sp.
MSEDEYLQGVINKYTVDARSSEAAANSIYGVIYSWGNGCLNDAKFSGSLAKGTAVSLGTDADVFLSLSSTTLGTLSQIYNSLYNAVTDAGYTARKQNVSIGVNIGKYKIDLVPGCRQSQYGNDHSLYKNKTNSWTKTNIDIHIYTVINSNRIDEIKLTKIWRELHRLDFPSFYLELAVIDCLYGCRYGQLVSNFFSVLSFLQDKLQNRRYVDPGNSNNIISDDLSAYEKQLIAAQAQTSINKQYWREIVW

SEQ ID NO: 3838 - protein, 250 aa, Vibrio parahaemolyticus
MSADQQLRNVIAKYDVDSSIADKYKTFFEPYVQDWANGCLCDFKISGSVRKGTAVSNGTDVDLFISLKSNTKNSLSELYNSLFSYMKGKNFDVRKQNVSIGVNHNSYQIDLVPSKRQSQYGNDHSLYVSKKNTWTKTNIETHISKVANSGRLEEIKLAKIWRNNNGLDFPSFYLELMVIDALHNYPKGNLASNFWRVLNYISANVKTKVYMDPSNTNNCISDQIPLSTKDKIARQAADSVSKQYWNQIVS

SEQ ID NO: 3839 - protein, 250 aa, Marinobacter psychrophilus
MTGLEYVNGVLKKYAVDPNKAVQYHTLFLPYIMEWANGYLIDVKVSGSSAKGTAVSSGTDVDLFISLTSTTKNTLNEIYESLFSYMGGKGFTARRQNVSIGINHNLNKIDLVPGRRQNQYGNDHSLYVSKKNSWTKTNISTHIYQVSNSSRLNEIKLAKIWRNANNLDFPSFYLELIIMDALYNKTVGAIDTNFVAALSFIASNIESNSYFDPSNTNNCISDQISAVEKKRIATVAKNSASQKFWKYVVA

SEQ ID NO: 3840 - protein, 254 aa, Candidatus Blackallbacteria
MSVDDYLRGLLAKYSVSTDSASPLRTLATYTIYPVIQRWADEHLREVTFSGSFAKGTANNCSNDLDLFISLKSTTPGSLKDIFQSLINYSTHAGWSPRGQDVSVGVVVGGYHIDLVPGRVQDGYQNWHSLYRRSADSWTQTNVQSHIDLVANSGRIEEIRLIKLWRHLAGLDFPSFLLELAVIEALKNKLRGNVAANFSYALEWLAANIQTVRLIDPTNTNNIVSNDITAAQKRLIADSARMARAKPNYSDFVW

SEQ ID NO: 3841 - protein, 250 aa, Paraburkholderia phenoliruptrix
MADAYLAGLLNKYEVGQARVQAVASQIIYPRIAHWAGAYLVEATYSGSIAKGTANSCSTDMDIFISLSSQTPETLKEIFGKLYIAAQGWGWAPRQQNVSIGVTVDGLSVDLVPGRKQAGYQNWHSLYHRRGDSWRQTNVSMHIDTVRNSGRTGEIRLVKLWRHLAGLNFPSFYLELCVLEALSGRRYGELAANLSLTLEWLRANLETRRIMDPANTANCISDDLTQAEKRAVAQAAGIARARPYYSDFVW

SEQ ID NO: 3842 - protein, 253 aa, Unknown
  Description of Unknown: Sphingobium sequence
MVGIDEHIRMVLARHTVDTGLYSPVRGVQATIDPVLRRWGAQYIVDIRPSGSFAKGTAVHGGTDIDIFISLTSTLSDTLQSIYNTLFNALSQAGYAARRQNVSIGISFGGWKVDVTPGRRQDQYGNYHSLWSNKTSSWLQTNINEHIRVVSGSGRINEIRLMKIWRNRFGLDWPSFYLELFVIDALKGARVGAVKDNVVTAFRAIDQSIATRRLIDPSNTNNAVSAALTADAKAALAFAARSALNSSWETVFR

SEQ ID NO: 3843 - protein, 253 aa, Sphingomonas paucimobilis
MVGIDEHIRMVLARHTVDTGLYSPVRGVQAAIDPVLRRWGTQYIVDIRPSGSFAKGTAVHGGTDIDIFISLTSTLSDTLQSIYDTLFNALSQAGYVARRQNVSIGVAVGGWKVDVTPGRRQDQYGNYHSLWSNKTSSWLQTNINEHIRVVSGSGRINEIRLIKIWRNRFGLDWPSFYLELFVIDALKGARVGAVQDNVVTAFRAIDQSIATRRLIDPSNTNNAVSATLTVDAKASLAVAARSALNSSWETVFQ

SEQ ID NO: 3844 - protein, 253 aa, Tolypothrix campylonemoides
MTGIDEHLRAILARHRVDTGPYSPVRAVQTTIDPVIRNWGGQFIVDIRPSGSFPKGTAVHGGTDIDIFVSLTSTLSDTLQRISDTLFTAFSQAGYVPRRQNVSIGLTVNGWKVDVTPGRRQDQYGQYHSLWSTKTGSWLQTNINEHIRVVSNSGRLDEIRLMKIWRNRFGIDWQSFYLELFVLDALHGARTGNLQANIVTVFRAITTALSTRRFIDPANTNNIVSNVLTADGKARIVEMARSALNSPWNTVFQ

SEQ ID NO: 3845 - protein, 253 aa, Sphingobium czechense
MVGIDEHLREVLARHRVDTGLFSPVRGVQPLIEPVIQTWGGPFIVDIRTSGSFAKGTAVHGGTDIDLFVSLTSTLTDTLQRISDTLFNAFLQAGYAPRRQNVSTGLTVNGWKVDVTPARRQDQYGNYHSLWSTKTGSWLQTNISEHIRVVSNSGRLDEIRLIKIWRNHFGIDWQSFYLELFVLDALRGARVGNVQENIVTVFRAITTSLANKRLVDPANTNNVVSNVLTADAKGAVIKSAQVALESPWNVVFQ

SEQ ID NO: 3846 - protein, 253 aa, Devosia sp.
MAADDYLKGILLRESVDTRAESPVRAVQGQLMPALNHWAGEYLRSVSPSGSFAKGTANKSGTDIDLFISLHSHTPGTLNNIYDTLAQKMTAIGLAPRKQNVSISVRVGNVDVDLVPARRQDNVGEDHSLYKRRGDTWMKTNVATRVALVRNGGRTAETRILKLWRNQKGLDFLSFYLELTTIEALRGKGPGTLSANVWTVFSYLRDNILSARVVDPANTNNVISDDLAVDEKRAIKRAVEAALAAKDWGEIVR

SEQ ID NO: 3847 - protein, 252 aa, Mesorhizobium sp.
MTADEYLGGILLREAVDRSMGSPVRGVAQTLAPVIQAWSAGHLNSVSPSGSFAKGTANRSGTDIDLFLSLASNTPFSLAEIYNTLFNALTKAGYTPRRQNVSINVRVGGYDVDLVPAKRQDNNSSDHSLYRRKADSWTKTNVDRHIAVVTAAGWELESRIFKLWRNQKGLDFPSFYLELTVIEALRGAGGTLSTRVWRVFEYLGESFTGARVIDPANTNNIISEDLTAVEKLAIKRAADSALAAKMWGEIVR

SEQ ID NO: 3848 - protein, 252 aa, Bradyrhizobium sp.
MTADEYLRNILAREAVDTSATSPVRAVQTTLQPLLTEWAGKLLRGVHPSGSFAKGSANSSGTDIDLFVSLSSDLTDTLKDIYTKLFDTLKSKGYSPKQQNVSINIRVGGYDVDLVPAKHQGGQGEDHSLYRRRADTWTKTNVTTHIVKVQNGNRISEIRIIKLWRDQKKLDFPSFYLELVVIAALSGKGKELSHNVLSVFEYLRDTFPTARFVDPANTNNIISDDLSAADRAKIKAEAQKAIAATSWNQIVV

SEQ ID NO: 3849 - protein, 252 aa, Rhodoplanes sp.
MTPDQYLYGILSREAVDTSATSPALAVRQTLMPLLNEWAGAMLRGVYPSGSFAKQTSNRSGTDIDLFVSLSNQTTESLKEIYTKLFNRLGEKGYAPKKQNVSLNIRVNGFDVDLVPAKHQGGNGEYHSLYRRRADTWTQTNVNTHISKVSASGRTSEIRVIKLWRNQHQLDFPSFYLELAIIEALSGARGSLSDNVWKAFGYLAGNFANARFVDPANTNNVISDDLSATERAAIKAAAVRALATTNWNQIVV

SEQ ID NO: 3850 - protein, 252 aa, Gemmobacter aquatilis
MTADQYLQNILFRESVDVTATSPLRRIQGQITPLIQSWAGHHLRRISPSGSFAKGTANKNGTDIDFFISLADTATAPLGDIYNSLFETLKAAGASPKKQNVSINIRLNGYDVDLVPARQQNMLSEDHSLFRRRANTWTKTNVSTHIAYVMYGGCVPEIRILKLWRNQKGLDFPSFYLELAVISALRGSGGTLSQRVWKALTYIRDNLATARLVDPSNTNNVISDDLTAAEKAAIVAAARTALGAKDWSEIVR

SEQ ID NO: 3851 - protein, 253 aa, Variovorax paradoxus
MTADQYLYEILGREAVDMGPQSPILSVLGTLNPLLWRWAGNRLHSVTPSGSFAKGTPNRSGTDIDLFISLSQETTETLREVYENLFSFIRANGYAPKRQNVSINIRVSAAYDVDLVPAKRQNMMNFDHSLYRRRADTWTKTNVQTHINHVRAGGRQSETRILKLWRTQKGLELPSFYLELTTIDALRGYNGTLSQNVWRVFQYLSSSFVGARVVDPANTNNIISDDLTAAEKNQVKAAADRALLANSWEEIVR

SEQ ID NO: 3852 - protein, 254 aa, Burkholderia sp.
MSIDADAYLTAILNREAVDTSIFSPLWNVQAALQPLLNEWANRYLLDVRPSGSFSKGTANASGTDIDLFISLSDQTPETLKEVYEKLFAHLGEKGYAPKRQNVSINIKVNGFDVDLVPAKRQNYLTSDHSLYVRRKDTWKKTNIDTHIAHVTAAGRQQETRILKLWRNQKGLEFPSFYVELAVISALQLEWLAPLSGRVVKCLEYFRDYLPTAQIVDPANTNNIISDDLTAAEKRAISKAAAISLQGSWEHVVR

SEQ ID NO: 3853 - protein, 254 aa, Burkholderia territorii
MSIDADAYLTTILNREAVDTSIFSPLWNVQATIQPLLNEWANRYLLDVRPSGSFSKGTANASGTDIDLFISLSDQTPETLKEVYEKLYARLKEQGYAPKRQNVSINIRVNGFDVDLVPAKRQNYLTSDHSLYVRRKDTWRKTNIDTHIAHVTAAGRQQETRIIKLWRNQKGLDFPSFYVELAVIKALQFEFLAPLSRRVVKCMEYFRDYLPTAQIVDPANTNNSISDDLTADEKQAISKAASTSLQGSWESLVR

SEQ ID NO: 3854 - protein, 254 aa, Cupriavidus sp.
MSIDADAYLTTILNREAVDTSIFSPLWNVRATIQPLLNEWANRYLLDVRPSGSFSKGTANASGTDIDLFISLSDQTPETLKEVYEKLFARLKGQGYAPKRQNVSINIRVNGFDVDLVPAKRQNYLTSDHSLYVRRKDTWKKTNIDTHIAHVTAAGRQQETRVIKLWRNQKGLDFPSFYVELAVIKALQFEFLVPLSRRVVKCLEYFRDYLPTAQIVDPANTNNSISDDLTTAEKQAISKAAATSLQGSWENLVR

SEQ ID NO: 3855 - protein, 251 aa, Ochrobactrum sp.
MSDAYLQRILAREAVDTGPYSPVRSVQGILAPLVGEWANGNLISISPSGSFSKGTANHSGTDIDLFISLSENTPDTLREIYDKLFAKLAGAGYAPKRQNVSINIRVGGYDVDLVPAKRQNALSSDHSLYRRKASTWTKTNVQTHITTVWAGARQQESRLIKLWRDQKGLDFPSFYVELAVIVALSNTNYPTLSDRIVACLTYLRDTFANARFVDPANTNNVISDDLTAAEKQRISAAAGQALNGSWEQFIR

SEQ ID NO: 3856 - protein, 251 aa, Rhizobium sp.
MSDAYLQGILAREAVDIGPYSPVRGVQGILAPLVGEWANGNLISISPSGSFSKGTANHSGTDIDLFISLSENTPDTLQEIYDKLFAKLAGAGHAPKRQNVSINIRVGGYDVDLVPAKRQNALSNDHSLYRRKASTWTKTNVQTHITTVWAGARQQESRLIKLWRDQKGLDFPSFYVELAVIVALSNTNYPTLSDRIVACLTYLRDTFANARFVDPANTNNVISDDLTAAEKQRISAAAGQALNGSWEQFVR

SEQ ID NO: 3857 - protein, 251 aa, Rhizobium sp.
MSDAYLQGILAREAVDTGPYSPVRGVQGILAPLVGEWANGNLISISPSGSFSKGTANHSGTDIDLFISLSENTPDTLQEIYDKLFAKLAGAGHAPNRQNVSINIRVGGYDVDLVPAKRQNALSNDHSLYRRKASTWTKTNVQTHITTVWAGARQQESRLIKLWRDQKGLDFPSFYVELAVIVALSNTNYPTLSDRIVACLTYLRDAFANARFVDPANTNNVISDDLTAAEKQRISAAAGQALNGSWEQFVR

SEQ ID NO: 3858 - protein, 251 aa, Ensifer sp.
MSDAYLQGILAREAVDTGPYSPVRGVQGILAPLVGEWAKGNLISISASGSFSKGTANHSGTDIDLFISLSENTPDTLQEIYDKLFAKLAGVGYAPKRQDVSINIRVGGYDVDLVPAKRQNALSNDHSLYRRKASTWTKTNVQTHITTVWAGARQQESRLIKLWRDQKGLDFLSFYIELAVIVALSNTNYPTLSDRIVACLTYLRDTFSNARFVDPANTNNVISDDLTAAEKQRISAAAGQALSGSWEQFVT

SEQ ID NO: 3859 - protein, 251 aa, Sinorhizobium meliloti
MSDAYLQGILAREAVDTGPYSPVRGVQGILAPLLGEWANGNLISISPSGSFSKGTANHSGTDIDLFISLSENTPNTLQEIYDKLFAKLTGAGYAPKRQNVSINIRVGGYDVDLVPAKRQNALSNDHSLYRRKASTWTKTNVQTHITTVWAGGRQQESRLIKLWRDQKELDFPSFYVELAVIAALGNTNYPTLSHRIVACLTYLRDTFANARCVDPANTNNVISDDLTAAEKQRISAAAGQALNGSWEQFVR

SEQ ID NO: 3860 - protein, 251 aa, Ensifer aridi
MSDAYLQGILAREAVNTGPSSPVRSVQGILAPLLGEWANGNLISISPSGSFSKGTANHSGTDIDLFISLSENTPNTLQEIYDKLFAKLTGAGYAPKRQNVSINIRVGGYDVDLVPAKRQNALSNDHSLYRRKASTWTKTNVQTHITTVWAGGRQQESRLIKLWRDQKGLDFPSFYVELAVIAALSNTNYPTLSDRIVACLTYLRDTFPNARFVDPANTNNVISDDLTAAEKQRISAAAGQALNGSWEQFVR

SEQ ID NO: 3861 - protein, 251 aa, Sinorhizobium fredii
MSDAYLQGILAREAVNTGPSSPVRSVQGILAPLLGEWANGNLISIIPSGSFSKGTANHSGTDIDLFISLSENTPNTLQEIYDKLFAKLTGAGYAPKRQNVSINIRVGGYDVDLVPAKRQNALSNDHSLYHRKASTWIKTNVQTHITTVWAGGRQQESRLIKLWRDQKGLDFPSFYVELAVIAALRNTNYPTLSDRIVACLTYLRDTFPNARFVDPANTNNVISDDLTAAEKQRINAAAGQALNGSWEQFVT

SEQ ID NO: 3862 - protein, 251 aa, Ensifer adhaerens
MSDAYLQAILAREAVDTGPFSPVRGVQRILAPILTAWAGVYLISVSPSGSFAKGTANNSGTDIDLFISLSENTVETLQQIYEKLFARLTQAGYTPKRQNVSINIDVNGYDVDLVPAKRQNALSNDHSLYRRKANTWTKTNVQTHITTVWAGGRQQESRLIKMWRDQKGLDFPSFYVELAVIGALRNTYHATLSKRVVACLTYLRDSFPNARFVDPANTNNVISDDLTAAEKQKISAAAGRALNSSWEQFVR

SEQ ID NO: 3863 - protein, 251 aa, Rhizobium anhuiense
MSDAYLQGILAREAVDTGPHAPVRGVLTTLTPLIAGWAGNKLLSVSPSGSFAKGTANHSGTDIDLFISLSEETTETLQQIYEKLFDRLTALGYAPKRQNVSINIKVNGYDVDLVPAKRQNALSNDHSLYRRRAGTWTKTNVQTHIAHVRAAGHRQETRLIKLWRNQKNLDFPSFYLELAVIEALRNTNYATLSDRVAACFRYLRDTFSNARFVDPANTNNVISDDLTAAEKQRISTAAGQALNSTWDQVIR

SEQ ID NO: 3864 - protein, 251 aa, Unknown
  Description of Unknown: Ensifer sequence
MSDAYLQGILAREAVDTGINSAVRGVLTALTPAITHWAGDKFLSVNPSGSFAKGTANRSGTDIDLFISLSEETAETLQQIYEKLFVRLRALGYAPKRQNVSINIKVNGYDVDLVPAKRQNAYRGDHSLYRRRAGTWTKTNVQAHITHVRAAGRLQETRLIKLWRNQRNLDFPSFYLELAVIEALRNTNYPMLSDRVAACFRYLRDSFPNARFVDPANTNNVISDDLTAVEKQRISVAAAQTLNGRWDQAVR

SEQ ID NO: 3865 - protein, 219 aa, Blastomonas sp.
MLQQWANRFLLSISPSGSFAKGTANRSGTDIDLFISLHEDTPETLKDIYGSLFNAIAGAGYVPKRQNASINATIGGFDVDLVPGKRQSAWTTDHSLYRRTADTWTKTNVTTHINTVVMAGHQRESRLLKLWRNQKRLEFPSFYLELTVIAALSGRTSPDLAENVVTVLEYLRDKFTAARVIDPANGNNVISDDLTGTEKQAVRRLAEAALGGNWSGFVQ

SEQ ID NO: 3866 - protein, 251 aa, Sphingomonas sp.
MSTAYLTSILAREAVDTSAFSPVRQVQSIIHPVLTQWANRFLRSVTPSGSFAKGTANKSGTDIDLFISLSEDTPETLKAIYDLLFKAVSEAGYRPKRQNVSINATIAGYDVDLVPAKRQNAASSDHSLYRSRADTWTKTNVDTHISTVIRTGRQQQSRLLKLWRTQKGLEFPSFYLELTVIEALRGKPVQDLSQSVVTVLEYLRDKFVAARVLDPANGNNIISDDVTLAGKNAIRRAAEQALGGNWSGFVQ

SEQ ID NO: 3867 - protein, 254 aa, Alphaproteobacteria bacterium
MSADAYLQGILNRKAVDTGIFSPVRGVQAVLEPVIRAWANGFLISVSPSGSFAKGTANRSGTDIDLFISLSPDTRETLKEIYESLFAHMQRQGYSPKRQNVSINVRVGGYDVDLVPARRQEYFSDDHSLYRRRADTWTKTNVQTHINHVVAAGWLSETRIIKLWRDQKGLDFPSFYLELAVIRALAPGFYKSGLAADVWKVFQFLSTDFAAAHIQDPANTNNTVSDDLSAAERATIKMAAARALQARNWNEIVV

SEQ ID NO: 3868 - protein, 253 aa, Lysobacter enzymogenes
MAADAYLSKILTREAVDRSLGSPVWMARQALMPVLTKWAGQCLQSVSPSGSFAKGTANRSGTDIDLFISLVPTTPDTLEQIYETLFAALTVAGYTPRRQNVSIGVLVGAADVDLVPAKRQNLLSQDHSLFRRKANTWTKTNVQMHIAHVLAHRRMMESRIIKLWRTQWGLDFPSFYVELAVIEALRNSIGVSISENVWATFQYLAGNFAASRFVDPANTNNVISDDLTMAEKNAIKVAAQRSLQAKTWGEIVW

SEQ ID NO: 3869 - protein, 262 aa, Loktanella tamlensis
MQSVNLGPIKMSSDNYLRNVLTREQVDTGSFSPVRSIATTLTPMLNSWGNGYLLAIEPSGSFAKGTANKSSTDIDLFLTLSSSTPDTLAQIRSSLGNCLNHYGYQYRDQNVSLGVKVAGYQVDLVPGKRQSQYGSDHSLYRKKANTWTKTNIQTHIKLVRDSRRTEEIRVVKLWRDQWDLSFPSIYLELATLSALHGKPIGRLSENVADVLRFLSGRLTTTRIVDPANTNNVISDDLPISGKHAVATAARRALSGSWESLIR

SEQ ID NO: 3870 - protein, 252 aa, Loktanella tamlensis
MSSDNYLRNVLTREQVDTGSFSPVRSIATTLTPMLNSWGNGYLLAIEPSGSFAKGTANKSSTDIDLFLTLSSSTPDTLAQIRSSLGNCLNHYGYQYRDQNVSLGVKVAGYQVDLVPGKRQSQYGSDHSLYRKKANTWTKTNIQTHIKLVRDSRRTEEIRVVKLWRDQWDLSFPSIYLELATLSALHGKPIGRLSENVADVLRFLSGRLTTTRIVDPANTNNVISDDLPISGKHAVATAARRALSGSWESLIR

SEQ ID NO: 3871 - protein, 252 aa, Desulfovibrio magneticus
MTADEYLRSILAREAVDTSQTSPVIRAANALYPIINGWAGIYLNGIQPSGSFAKGTANHSGTDIDLFISLLSNTPDTLKEIYNTLFNALSQNGHSPRKQNVSINVKVNGYSVDLVPGRLQDPSGLDHSLYRRKADTWTKTNIHTHINYVASCGRTQETRVLKLWRNQNALDFPSFYLEMTVINALAGKNMGLSANVLHVLDYIKESFMSARVVDPANTNNIVSDDLTDTEKRIIKSKAEQALTASNWGQIVI

SEQ ID NO: 3872 - protein, 253 aa, Novosphingobium malaysiense
MTADQYLYGILARETVDASASSPLRQVAVTLMPRLRVWAGDLLVGVHPSGSFAKGTANASGTDIDLFLSLRSDTTATLKDIYDTLFNQLQQSGYAPRKQNVSIGLKVGSFKVDLVPGKQQQANSNDHSLWRNRAQTWTKTNIGTHIAAVQRSGRQNEIRVIKLWRNQRGLDFPSFYLELSVIAALSGNTQPGFSDRVWTALTYLSNCFENARAVDPANTNNIISDDLSESGKTAIARAASETLKAKTWGEVVK

SEQ ID NO: 3873 - protein, 253 aa, Microvirga flocculans
MTADQYLYQILSREAVDSGPHSPARGCQALLLPIIQQWAGNQLAGVAPSGSFAKGTANASGTDIDLFISLKSDTTNTLREIYDGLFEWMRNHQFSPRRQNVSIGVKVGGFDVDLVPGKRQDPLSGDHSLFRNRTGTWTKTNVATHIGLVSGSGRLDEIRILKLWRNQKRLDFPSFYLELTVIEALRTVYYGSLSANVWMVFEYLRDSFMTARVQDPANTNNILSDELTQEAKMTIKRTAIQALSAQHWEEIVT

SEQ ID NO: 3874 - protein, 253 aa, Fulvimarina manganoxydans
MTAYEYLRSILTRETVDTGLYSPANVVEGYIRPVITQWAQQYLVGFEPSGSLAKGTANRSGTDVDFFISLHPDTPGTLKQIYDKLFALMHGTEYGAREQNVSIGTKVVGYDVDLVPGRLRSLQRTDHSLYRRNAGTWTQTDIRVHVSQVSRSPYRDEIRLTKLWRNQNGIDFPSFYLELTVMNALQGKPAGNLPDNFLSVLEYLRNRLPNARVVDPANTNNIISDDLTAAGKQTIALLAEASREKRTWGEIVQ

SEQ ID NO: 3875 - protein, 253 aa, Ensifer adhaerens
MTADHYLWNILQREQVDNGLYSPVRNCQQTMLPLLQQWGGGFLVDVMASGSFAKGTANKSGTDIDLFVSLSETTPETLKDIYTKLARRMEELGFKPRLQNVSIGIKVGSFDVDLVPAKRQNAFSLDHSLYRRRADTWTKTNIAAHIALVSASGCTNEIRIIKLWRDQRGLDFPSFYLELTVIEALRGRSGPSLSANVWTVLQYLRDRFASARFVDPSNTNNILSDELSDTAQRNIATAAGTSLGAKTWGEIVR

SEQ ID NO: 3876 - protein, 261 aa, Rhizobiales bacterium
MTPDQYLQQILTREAVDVGPYSPVRGCQSILMPMLQLWANRFLLNVTPSGSFAKGTANLSGTDIDLFISLHPDTPETLKQIYNSLATRLREVGYQPRLQNVSVGIQVGAYRVDLVPGKIQNALMQDHSLYRRKADTWTKTNIGTHIAKVRASGRQSEIRVIKLWRDQNGLEFPSLYLELTVIAALKNIQSNAAAVLLGSSISGNVWKVFGYLASSFETTRVVDPSNTNNILSDDITAKDRTAIKSAATLALAKRTWGEIVI

SEQ ID NO: 3877 - protein, 250 aa, Hyphomicrobium denitrificans
MSDQYLAGILVRETVDVSSTSPALGAANTLLPTLRQWGGQYLTAVNPSGSYAKGTANRSGTDIDLFLSLAENTPDTLKQVYDTLFNAISQAGHSPRRQNVSIGVRVNGWDVDLVPGKRQNAWTTDHSLFRRKADTWTKTNIDTHIATVRASGRLAAIRVLKLWRNQWGLDFPSFYLELTTINALSGTNLTLSGQVVHTLTHLKDRFENARVVDPSNTNNVISDDLNATEKRAISNAAGRALASNWEQLVR

SEQ ID NO: 3878 - protein, 253 aa, Bosea sp.
MTANQYLQNILARERVDVSVNSPLRGCANVVLPHLRAWAGNSLVDVSPSGSFAKGTAVKSGTDIDLFISLSHELTATLESIYDTLFNRMSQQGFAPRKQNVSIGVKINGHDVDLVPARRQDARGQDHSLYKNRKGSWTQTNIATHIGLVANSKRTEEIRVLKLWRNQNGLDFPSFYLELLAIEAMKGKQVGDLATNVFSTFAYFRDYVGSSRIVDPANTNNVISDDLDASEKARIAKLAAQAAAAKTWGEIVR

SEQ ID NO: 3879 - protein, 252 aa, Unknown
  Description of Unknown: Xanthomonas sequence
MGDQYLNGILAREAVDVSLLSPAFSAKATLTPVINAWGGNLVQSVSPSGSFAKGTANASGTDVDLFISLHPSTTHGLREIYITLFNALRDVGYTVRKQDVSLGIRVGLIDVDLVPGKQQTPLTTDHSLYRSRADTWTKTNVQTHIDVVRAAGRQSETRIIKLWRDQNKLEFPSVYLEFVVIRALQLNFSGSLAERVWTVLRFLADNFAAVRVVDPANGSNVISDDLTLAEKLAIERAAKFSLTQQTWGSIVR

SEQ ID NO: 3880 - protein, 253 aa, Stenotrophomonas maltophilia
MTGDLYLKAILTREAVDTSLLSPAFLARATLTPVINAWGGRYVQSVTPSGSFAKGTANKSGTDVDLFISLRPSTPDSLKQIYLTLFNALTDAGYVVRKQDVSLGIRVAQIDVDLVPGKQQTALTTDYSLYRSRADTWTKTNVQTHIDVVRAAGMQPETRIIKLWRDQNRLDFPSVYLELVVIRALQLNFSVSLAERVLVVLRFLANSFVAARVTDPANANNAISDDLTFADKLAIERAAQVALAQETWGSIVQ

SEQ ID NO: 3881 - protein, 253 aa, Arenimonas metalli
MTPDEYLFAILARERVDASPTSPILAAAKKALMPVLVPWGGRYLRSVEPSGSFAKGTANRSGTDIDLFLSVSPEHPAPLKVLYESLYGALSWAGYEARRQDVSIGLRVDGTDIDLVPGKQQTVLTTDHSLYRRKADTWTKTNVLSHISHIRNGGRQAETRVMKLWRNQARLQFPSFYLELAVIEALRGSSAMSLSFRVGEVYRYLAGPFASARFVDPANTNNVISNDLTVVEKNAIRFAASRALQTPWGDLVR

SEQ ID NO: 3882 - protein, 254 aa, Bradyrhizobium japonicum
MMSEQDYLSAILMREQVGGGLASPALFVPGVIRPAIEQWAGRYLLDIAPSGSYAKGTANRSGTDLDLFISLSPDTAETLSDIHKTLAATLKATGYEPRPQNVSIGIKVNGYAVDLVPGKRQNWLFNEHSLYKRRGDTWTKTDISQHIAKVKGSGRQAEIRLIKLWRSQKGLEFPSFYLELAVIKALEPAWLSPLADNMRTVFAYLRDNIATARFVDPSNTNNIISDDLTVAEKQAIRKAATAALAAPYWRDIVV

SEQ ID NO: 3883 - protein, 252 aa, Pseudorhodobacter sp.
MSDAYLRQILARLRVDTGPNSPARGVQMALRPSLLRWAGQYLVSMEPSGSFAKGTAIRGGTDIDIFASLSSQVSESLSVIYNTLLNRLRDDGFGPRPQNVSIGIKIGGYSVDVVPARRHGPTGEFHSLFRRKEQTWTQTNIISHINTVRNSGRAEEIMIMKAWREQKRLTFPSFYLELVTIEACRGHKVGDLSQNVWTTLAYVRDNIKMGVFIDPANTNNRISDDLTAKEKQDLADAASIARQATNWNQIVE

SEQ ID NO: 3884 - protein, 252 aa, Rhizobium aegyptiacum
MSDAYLRQILVRLRADTGPSSPARSAQAILTAPLLRWAGQYLVSMEPSGSFAKGTAIRGGTDIDIFASLSSEVTHSLAVIYHTLFNRLRDEGFNPRQQNVSIGIKVGAYSVDVVPARRQAYTGEFHSLYRRKAETWTQTNVVTHINAVRNSGRAEEIMIMKAWREQKGLVFPSFYLELVTIEACRGRRIGDLAENVWAALAYVRDNIMGAVFIDPANTNNRISDDLTVAEKRALANAASTARQATNWSQIVI

SEQ ID NO: 3885 - protein, 247 aa, Unknown
  Description of Unknown: Calothrix sequence
MSGNKYLNKIIKKYSVKINEFIPATKKISELINQWADGNLNHANFCGSFTKGTAISLSSEIDILLSFNPTIGTVSEAYNLLYNYLINTGYNVYKHDVSIGIIIDNCKFNLIPGRRESGNNHSLYKTKTDSCIKTNLSRHTLHVEDSFRIPEIKLTKIWRDLHHINFPSIYLELVVIKCIKGCEYRQIESNFVKILSFLANKLESTKCIDLANCNNILSDILSPEEKIRLANQAQISYEADGWEYVVW

SEQ ID NO: 3886 - protein, 271 aa, Unknown
  Description of Unknown: uncultured bacterium sequence
MLFSQRNSPIQNMMTDIYLQNMLKKYRPVADLVVFMTVWSEVNTLAQSWAGNYLNECTASGSYSKGTAIKGGTDFDFFLSIKTECSNSLQEIYENLFIFLSNKNLNPRKQNVSVGMNLNGQKIDLVPGKKQPSIFSNDHSLYKFKQKTWTKTNVKIHIDHVRSSGRIDEIKLLKIWRYCQKIDAQSFYLELLVLEAFSNPFDFLITDLHSNFLKILDFISSEIQTRTIQDPSNSANLLSDDLSIQEKKTIAQKASISAAKIRSGKISEVIW

SEQ ID NO: 3887 - protein, 254 aa, Mycobacterium conspicuum
MDADTYLHSVLSKITAPTGVSGPGNIIRAGLLPYVSQWAGRQLVSLDVSGSYAKGTAILGGTDVDLFASLRPETSQTLKEIYDSLASYLGGQGFSVRRQNVSINVTYQSKSVDITPGRLRNAYSTDHSIWVSRQNTWQQTNVGRHIQSIGGSAHTDVIRLMKRWRKLHSLEFPSFAVELAVLRGLQQTSRYSGLASRFNLVLEFLRDRIGTAQLIDPANSNNDVADELTTAEKTSIATQARQSRNATYWEQVVW

SEQ ID NO: 3888 - protein, 261 aa, Candidatus Roizmanbacteria bacterium
MTKINMYLNQILKKYNGSDISGYSNVLSQLQTTLKTWASSCYKNLLYSGSRAKGTAISLASDVDYLVSLTSNCNENSGGLKSIYDSLYTELNNKYSSVSKQNVSVRINLNGLEVDITPARKQTGETNDHWLYVSKLDTRKQTNIQKHINDISQSGRTNEIKLLKIWRELNQLDFSSIYLEYLLINNILLNKSKDENSLGDNVWHALNELAKTQGNPLFARIVDPANSANILSDLLTSTEKNKIISQAQTAIRQTGWNQIVW

SEQ ID NO: 3889 - protein, 261 aa, Candidatus Berkelbacteria bacterium
MTEIDMYLYQILQKYSARDLTNYSGLLSQLKSTLQTWASSCYVNILDSGSRAKGTAISLASDVDYLVSLTSGCNDNNGGLKGCYDSLFTKLNNTYSSVRKQNVSVRINLSGLEVDITPARKQNGNTNYHNLYLSKSGSWTQTNIQKHITDISQSGRTNEIKVLKIWRELHQIDFPSIYLEYLLVNNILLNRSKDINSLGDNVWHAFNELAKTQGNPLSARIVDPANSANILSDLLTVAEKNTIINKAKIAIQQTNWNQIVW

SEQ ID NO: 3890 - protein, 261 aa, Elusimicrobia bacterium
MTEIDMYLNQILQKYSARNLLGYLAALSQLETTLKDWAATCYVELLISGSLAKGTAISLASDVDYLVSLKSNCNENSGGLKSIYDSLYTQLNSKYSSVSKQNVSIRINLNGLEVDVTPARKQTGNTNDHWLYVSKLDTWKQTNIQRHINDISQSGRINEIKLLKIWRELNHLDFSSIYLEYLLINNILLNKSKDVNNLGDNVLHVLKELAKTAGNPLYSQVIDPANTANILSDLLTNVEKNKIIGQAQISIKQTNWNQIVW

SEQ ID NO: 3891 - protein, 259 aa, Algoriphagus marincola
MDSNMYLQTILNKYAPRSIDSYTLNILLLKSDLQKWASTCYISILNSGSRAKGTAISLASDVDYLVSLTSDCNSNNGGLKSIYDGLYDHLRTKYNPVRKQNVSFRIKIGNLEVDITPARKQTGNTNDHWLYVSKQDTWKQTNIQKHINDVSGSGRLNEIKLLKIWRELNRLDFPSIYLEYLAINSLSGKSKDATKLSDNFIFLLRELAKDTSNPLNSRIVDPANSNNILSDLLTATEKKAIISKAKISSGQQYWEDIVW

SEQ ID NO: 3892 - protein, 259 aa, Flavobacterium psychrophilum
MDSNIYLQTILNKYAQRSLESYNLRILLLKSELKNWASTCFISTLNSGSRAKGTAISIASDVDYLISLTSGCNANNGGLKNIYDSLHTFLKGKYNSVRKQNVSFRIKIGDLEVDITPARKHTGNTNYHWLYVSKLNTWKQTNVQKHITDISNCGRLNEIKLLKIWRELNKIDIPSIYLEYLTINILSGKSKDASNLANNFLFVLKELSKDISNPLYSRIVDPANSTNILSDLLTLEEKKIIITKAKTDSIQQYWSGIIW

SEQ ID NO: 3893 - protein, 260 aa, Legionella maceachernii
MTSEQYLNLIITKYNPRNLLNSSQELIRLKTILKIWANSCYLDIIESGSRAKGTAISIASDVDYVVSLTSNCNESDGGLKSIYDSLFKRLSAEYPVVRKQNVSCRINLNNLQVDVTPAKKHNGNTNYHWIYRSESNQYHQTNMQQHINDILTSGRIQEIKIVKIWRELNKLDIPSIYLEYLIIKNILLNKPKDPNKLGSNAFHIFTELAKDTNNPLFSRVVDPANSNNILSDLITQNEKFNIIKVAKIAAQKQYWDQIVW

SEQ ID NO: 3894 - protein, 257 aa, Candidatus Roizmanbacteria bacterium
MAYLIQILQKYQARDLSPYSSSISLLKNTLYTWASSCYLDILDSGSRAKGTAISLASDVDYLVSLSSSCNENSGGLEGIYDSLNSKLSGIYTNVRKQNVSIRLNLGGLLVDVTPARKQLGNTNDHWLYVSKLKTRKQTNIKKHISDISASGRTNEIKILKVWRELHKLEFPSVYLEYLVVNNILRSYPTGIDKIGDNVWHVFNELAKYSSNPLDSRLVDPANSANILSDLLSQTEKNSVKNAARSAIQQTNWNQIVW

SEQ ID NO: 3895 - protein, 269 aa, Legionella pneumophila
MNSDDLYLIGVLNKYHPRDLSVFAYEINNLKSILRRWANTCYLDIFDAGSRAKGTAISMASDVDYVISLTNSCNRDSGGLNTIYQSLYDTLKQSYQEIRKQNVSVRIHLNQGFLQNNQLEIDVTPARKHTGNTNDHSIWISKRGTWQQTNIQKHINDVRNSGRINEIKLLKIWRELNQLDFPSIYLEYLVINHLLKYKPKGLDFLASNFNYLISELANTDTYPLWNLTVIDPANSNNVLSNLLTIEEKGKIVSAAIDAKYKYSLSSIVY

SEQ ID NO: 3896 - protein, 269 aa, Legionella pneumophila
MNNDDLYLIGILNKYQARDLSVFSHEITNLKNILQNWASIYYVGIVDSGSRAKGTAISLASDVDYVISLSNSCTRDSGGLKTIYQCLYDRLKQSYQEIRKQNVSVRIHLNQGFLQNNQLEIDVTPARRHTGNTNDHSIWISKQGSWKQTNIQKHISDVRNSGRDNEIKLLKIWRELNQLDFPSIYLEYLVINHLLKYKPKGLDFLASNFCYLISELANTDTYPLWNLTVIDPANSNNVLSDLLTIEEKGKIVSAAIDAKYKFNLSSVVY

SEQ ID NO: 3897 - protein, 261 aa, Hirschia maritima
MTSAADQYLTSVLQNHEVFDLSDYREELDFLFDVLKEWAHDCYDCIIISGSRAKNTAVFPSSDVDIVVSLSSKCNDGNGGLRGLNSSFVAEMKTHYPNLREQNVSVGLNLSGLAVDVTPARKVPNFTHKHWIYSTKKQSYVQTNVRRHIIDIAKSGRTKEIKLLKIWREKNSLDFPSVYMEYLLTFQILSGRSLSNLSDNLGHVFNELARDVSNPLLNCRIEDPSNTNNILSDLLTTVEKRRIIKSAKIAQAADYWESVFE

SEQ ID NO: 3898 - protein, 351 aa, Flavobacterium araucananum
MNKGKKYAQNGALIFGLGNAIINTFKQLNSNDPNSEFDWSQLCVAAGKGALVGGTGGLILGAIRDNKMNKVLLEFNSVPNYLHKTLNHYKDDNTLLLNKAEQLKSNFQSKFKSELALKPKITGSVIKGTSIYGSDVDIQLCFKKDYGSIASVYDTISDYIFDELKIKEIKEIREQKHSIGIGIQLENEVKRIDIIPTRLIENGKNDVQLFVNKIGFFEKPTYKKTNHEKQMLSLKLNYREQRIVRLLKIWKVENNLKIKSIFLEWLAKRSFDSKPITNKIEKDLTNVIYFIARNVEFIRIVDTANSNNVISNTLTFEEKSNISRFCFNMLDDWRVDKRNIIDYFPSLESTM

SEQ ID NO: 3899 - protein, 245 aa, Acidobacteria bacterium
MEAVLAKHELKPTLISGLATSAVVPRLKEWAGAWLNEISYVGSVAKGTGISGTTDIDIFISLKSNTPNTLEEIYNLLTQKATALNWTPRQQNVSVGIIYMGVKMDLVPGKLQEGYMPFHSLWKRKANTWTQTAPSIHITEVQKSLRTREIRAIKIWRKAHNLDFPSFYLELTVIKALSGCSQFNLSNNVQRALGYIADNLTTAAVEDPANTNNMISDDLTLAEKKVIAAQAKASHNQPRWEQTLW

SEQ ID NO: 3900 - protein, 356 aa, Lacinutrix sp.
MKKSSKENLQLGAIIGGILGLIINGSQQLDNKNPQQKFDYQSFVLAGTIGAIIGLTSASVLNLIMSIFSTRKEIIDEADEISYLVSAIGSYTPDEIDKEVLIKGRKVKSALKNKFAKDILGNVSYQGSVKQGTAISGLSDLDIRIQFKKTSFPSESKMYNTVYNFFKYHFKDSELKDVRKQKVSIGLIYKIDEHEEIIDVVPALRTDFVRGKNDYTLFKNPELCEGSWKLKMNPKKQEEFGTFQKDKIDIIKLLKLLKTEVQLPIKSILLKEFTKKAFEKNSFIPNGLNERLLMTLEFIRDNIETINIKAPDNVRISLTDNLTSKERKSIKVKIDRVICDLLDDRRNFTEYFPERV

SEQ ID NO: 3901 - protein, 358 aa, Tenacibaculum ovolyticum
MKKPKDNFTGTGAIVGGVLGLIMNIVGQSKEKKENPHKEFDFQSLILVGMIGAIIGSVSFEIIKLLLSVFTSKEEILDEADEISYLGSVLNSYQPDEIDKQVLQKGKQLKLAIKREFSNKLLGRGVTYQGSTVQGTAVSGLSDLDILVKFKRTSFSKEEDMHDALHNFLKYRFNDTDLIGIREQKHSLGLIYKLNGSKEIIDVVPTLRTDFIRGKNEYNLFRNPKLLTGSRKLKMNPNIQKDLGDNENEKIEIIRLLKILKSEKKLPLKSILITELTKKAFQEIRMPKKLNQKLVLILNFIKDNIKTIQVKSPDNLRISLTDSLSIKDKEEINIALDAVLDDLKNDKNYLLDYFPEKS

SEQ ID NO: 3902 - protein, 351 aa, Bacteroidetes bacterium
MTKAKKYAINGAIGGGILAAIINVIDQNSGSKKDKPFDWKEFFLWLIGGVTIGGGIGLATGAITDHVNSLEEPLDLEYLLHAHLNSIRLDKKDHQYNALRKKSDWLIEVLRNEFKDDLKLTPYRFGSTEQGTALKETFDIDICLSFKPKTFTSITAMMDEVFTFLKTFNGINGIRHIRKQKKSVGLLFHVNGEEMKIDILPYQCSKEYKNDHSGYMCVNKGMFEAPSRAKTDVQLLSNIRLSETQKKILVILKDWKQKAYIPISSHLLQYLILEAYKENEGHIPSGFAEKIIMTMCFIEENLVSIRLHGVENTNNVLTDIPLSKKEDIVLACGNVIDDFEYQPNSILQIIR

SEQ ID NO: 3903 - protein, 357 aa, Polaribacter vadi
MDKKLIKYSKNGIVIFGLSNALINAIQQLNSIKENPEQVFDWSKIFKSAGNGAILGGLGGAFLGGIVDSNNDKKQRLNTSAILSTVVSNIRLDKENPIYKKLSIKANRIINEIEKKFRYSLGGSPLKIGSTEDGTSLSDSFDIDISIPFSSNSFSSTSEMYESLYQFLDKSYSDKNLIEVRKQRKSIGLLYRINNEDYKIDVVPYKLSKTINNKTAGYLFVNNNSIFKNDSYTKTDIISLKSINLTNSQQKLLIVFKNWKKEFSIPISSHLLKMLIIDAFEFNKGNIPRDFTKKILLLLNYIEKNIMSKRIISIENTNNILTNFDESDKLYIKNECIKILNDYEYQPNSILKYFKNI

SEQ ID NO: 3904 - protein, 306 aa, Unknown
  Description of Unknown: bacterium sequence
MGGSGSGYGYRSISPEAERELDQQRAKENERLNTEVNQYLGELLAVLNSRDPKLVNDRLDALVDSLGDSVEIDKMLLGGSVAKHTAVDGLSDVDAVVVLDREDLKDKSPDEVRDEFYSELDKKLDRSDVKAVQVGDMAVTIEYRDGMEIQLIPAIQMGNKIKIGLGDHSDWVEVNPKKFQSALTNANKKMNNSLVPAIKLLKSINADMPQQKQLKSYHIEALAVDASKSYSGPTTTKEVLIHLVGHASNRVLRPIKDISGQSKNADEYLGAANDQSRRIMAQGLAGIKRRLEAASTLSQWKAMFSD

SEQ ID NO: 3905 - protein, 309 aa, Nitrosomonas nitrosa
MGGGGGSNWSNPQQIVREVREAEKKVSDEKFQTDLSGLLTRYLGCFNDRDIPLVRHRLDEILDSLGEAIDEKIDQVFGGSVAKHTYVDGLSDIDCLLVVNDTSLEEKGPKAALKAIEKALNRSLKGQAETSVGKLAVTVSYGDGMEIQLLPAVKSGTGLKIPSARNEARWSGINPKKFQAALTKYNAQCDGKLVPTIKLAKAIIGKLPEARQLSGYHVESLAIDAFKGYTGTKTPSAMLPHFFEHAKKRVLTPMSDSTGQSVHVDNYMGSANSVERKNASHLLGRIAKRMVNATASGSLEQWSDMFGED

SEQ ID NO: 3906 - protein, 311 aa, Devosia sp.
MGGSGGGGGYGGGLGSAAQQLKAALQEVQSLAFQTELSSKLSELLSKFNDRDVQLVRERLDQIEKVLGDKLDSDIEQRFGGSVAKHTYVDGLSDIDCLMVLRDQALIGKGPQATLAAFTDALKEKLGSQAEVTKGNLAVTVRYGDGMEIQLLPAVKQGEGMKIQSSRDQHSWSKINPGKFQEALTRRNAECEGKLVPVVKLAKAIISNFPEAHQLAGYHVESLGIDAFRGYTGAKTVSAMLPHFFQKAQDRVLKPMTDSTGQSVHVDGYMGNADSAVRTNASHLLGRIAKRMSNASASGSMEQWSNLFGEK

SEQ ID NO: 3907 - protein, 309 aa, Moorella thermoacetica
MSGGGWYYWSKHTDIEKVLRETESNEKRIEYEGEVNRYLQSLLTNYNNRKTDEIRQHLETIRGALDKNIEGAIELVFGGSLSKHTYVNGLSDIDMLVRINDTSLADASPADIKAYFAERLLKRLPNTEVEVGKLAVTVRFSSTGHEIQLLPALQTKTGVRIADPNGDGWSKVIRPIKFAEKLTNVNQSCNHKVIPVIKLFKGLNESLPENVRLSGYHIESLAIKAFEGYTGRKTYKDMLQHFCRQAIKLVLSPIVDSTGQSVHVDEYLGASNSLRRRQCSAALERLSNRLSRADAHMNIERWKEMFENE

SEQ ID NO: 3908 - protein, 313 aa, Thauera phenylacetica
MGGSGGGSTFRYRSPEELRDAVRKAEDDSSVKQFEVELAGTLSELLGAYNSRDAQAVRERLSDIRAALQDEIEGTFDSLFGGSVAKHTYVDGLSDIDSLILLNDSDLENHSPQRALEKMTTIIKAAMPASATVTHGQMAVTVDYGDGMVVQLLPAIRGADGHLHVPSSRRDAWSQINPMAFRDVLSARNAACGGKLVPTIKLAKAINGELPEGQRLSGYHMESLAIAAFRSYAGEKTTSAMLPTFFDRARDLVLSPMKDSTGQSVHVDSYLGPANSPERQAASHLLGRLARRMRNATAAGSVAQWKALFGLEP

SEQ ID NO: 3909 - protein, 313 aa, Bradyrhizobium sp.
MGGGGGGNVFQHRTPEQLAKQVRKAEDETAVKAFEADLSSLLGELLASANSRDVGLVQNRLSEIKDELSDALETSADLLFGGSVAKHTYVDGISDIDSLLVFSQSDFASDKPSVALKKVSDIIRGAVPSSAEVGAGRLAVTIEYDDAMQIQLLPAFHTNSGLKVPSFLRDDWSHIAPEKFQKALTARNEECGGKLVPTIKLAKAIIGTLPETQRLSGYHVESLAIAAFREYEGTKTTAAMLPVFFERARDLVLTPIRDSTGQSVHVDGYLGDANGPQRIASSHILGRIAKRMRNASAHMSHDQWKAIFGLADE

SEQ ID NO: 3910 - protein, 364 aa, Chloroflexi bacterium
MNSLIDHFTKFLSNIQPDGKRVELATDIPDKLREYLKDTDKIKTVDPHTRLSGSYSRYTTIKEIKDVDILLFINEEYKNGEDSVKKVINELVNALGGFPKYLKDESGKVNADLALKRQRRSVQVHITLDEQDFDIDVVPSIVEDGIEKPLLVPDRDLSKWVLSDPLGYSKLLSKINKENVNKVVPLIKMFKHWRDVQMKRKRPKSYWLECMIVKAANEEKLNIKDASWGELFLSLLSFIYNDFHDKWKNSKEVPLIKDPMLANNVAKSWTRDEFESFMKHVEESKRNAEKAINEKDEDESIRLWQSLFNDDDEKEYFPSKIEETLKNALVGGVSFVSSSGKVTSTKPQSEKSWQSPSHRNYGDS

SEQ ID NO: 3911 - protein, 355 aa, Cyanobacteria bacterium
MLNLSDHFDVLLQKIEPDGERAEFARDIPALVRDYLQQHEDIETVEPYSRLAGSYARCTAIKDIKDVDLLLTLDRSYRKKEPEEVLEKVFSVLGGLPEALGSSSKPVIRRRQRRSINVHVDEHDFDLDIVPAVVDRGIDKPLAIPDRDWSRWVETHPLGYADKLSELNGKHQDKVVPLIKLVKHWRDVQMCYRRPKSYWLECLVYHLIDNGKVTTKRRYYAELFQLVLASIAQDFRQDLEMEGKVPEILDPMLGNNVAHNWERAAFETFMRRIDESLGWAERAIAEDDEEKAVELWQKVFGEEGVPTEVEAQKAMRLRADALAGAVFVTSEGRVVTGKQERPAIQVPPQRFYGEP

SEQ ID NO: 3912 - protein, 362 aa, Nostoc sp.
MFPLITHFEELLKNIQPPQERLDAARDLPPVVREYIAKSKDFPTVYPHSRLAGSYAQDMTSGDVKDVDTLIRVSGDPKANKPEAKRLIQDMKKLLDGLPKALGFDGYAEAEIEVERARRSVHVYFKGKDFHLDFVPCIAPDGFEGVLYVPDRGFNKWIASHPIGYINLLNELQNKHDRKVKPLGKLLKHFRDCQMKSRKPKSYWLGALLVYHIQQNTLDMTQPLAVLFYELLNAIYRQYDHLLHTSNVATPNLPDPILGHNISWNWSRTHFETFMRRINEGRNWAAKALETNDREKAIKYWQKIFGEEYFPSEVETAASKLAKAGLPGKSYVSSTGLILPSQPASGLYTSTIATKFHGIDQG

SEQ ID NO: 3913 - protein, 362 aa, Tolypothrix campylonemoides
MFPLITHFEELLKNIQPPQERLDAARDLPPLVREYIAKSKDFPTVYPHSRLAGSYAQDMTSGDVKDVDTLIRVPGDPKANEPEAKRLIQDMKKLLDGLPKALGFEGYAEAEIEIERARRSVHVYFKGKDFHLDFVPCIAPDGFESVLYVPDRGFNKWIASHPIGYINLLNELQEKNDHKVKPLGKLLKHFRDCQMKSRKPKSYWLGALLVYHIQKNTLDMTQPLAVLFYELLDAIYRQYDHLLCTSNVATPNLPDPILGHNISWNWSRTHFETFMRRINEGRNWAAKALETDDREKAIKYWQKIFGEEYFPSEVETAASKLAKAGLPGKSYVSSTGLILPSQPASGLYTSTIATKFHGIDQG

SEQ ID NO: 3914 - protein, 362 aa, Unknown
  Description of Unknown: Nostocaceae sequence
MFPLITHFEELLKNIQPPQERLDAARDLPPLVREYIAKSKDFPTVYPHSRLAGSYAQKMAVGDVKDVDTLIRVPGDPKANEPEAKRLIQDMKKLLDGLPKALGFEGYAEAEIEVERARRSVHVYFKGKDFHLDFVPCIAPDGFESVLYVPDRGFNKWIASHPIGYLNLLNELQEKHDHKVKPLGKLLKHFRDCQMKSRKPKSYWLGALLVYHIQKNTLDMTQPLAVLFYELLDAIYRQYDHLLYTSNVATPNLPDPILGHNISWNWSRTHFETFMRRINEGRNWAAKALETDDREKAIKYWQKIFGEEYFPSEVETAASQLAKAGLPGKSYVSSTGLILPSQPASGLYTSTIATKFHGIDQG

SEQ ID NO: 3915 - protein, 362 aa, Cylindrospermum stagnale
MFPLITHFEELLKNIQPPQERLDAARDLPPLVREYIAKSKDFPTVYPHSRLAGSYAQKMAVGDVKDVDTLIRVPGDPKANEPEAKRLIQDMKKLLDGLPKALGFEGYAEAEIEVERARRSVHVYFKGKDFHLDFVPCIAPNGFESVLYVPDRGFNKWIASHPIGYINLLNELQEKHDHKVKPLGKLLKHFRDCQMKSRKPKSYWLGALLVNHIQKNTLDMTQPLAVLFYELLDAIYCQYDHLLYTSNVATPNLSDPILGHNISWNWSRTHFETFMRRINEGRDWAAKALETDDREKAIKYWQKIFKEEYFPSEVETAASQLAKVGLPGKSYVSSTGLILPSQPASGLYTSTIATKFHGIDQG

SEQ ID NO: 3916 - protein, 362 aa, Calothrix brevissima
MFPLITHFEELLKNIQPPQERLDAARDLPPLVREYIAKSKDFPTVYPHSRLAGSYAQKMAVGDVKDVDTLIRVPGDPKANEPEAKRLIQDMKKLLDALPKALGFEGYAEAEIEVERARRSVHVYFKGKDFHLDFVPCIAPDGFESVLYVPDRGFNKWIASHPIGYLNLLNELQEKHDRKVKPLGKLLKHFRDCQMKSRKPKSYWLGALLVYHIQQNTLDMTQPLAVLFYELLNAIYRQYDHLLHTSNVATPNLPDPILGHNISWNWSRTHFETFMRRINEGRNWADKALETDDREKAIKYWQKIFGEEYFPSEVETAASQLAKVGLPGKSYVSSTGLILPSQPASGLYTSTIATKFHGIDQG

SEQ ID NO: 3917 - protein, 365 aa, Nostoc flagelliforme
MAPHFPLTTHFEELLKNIQPPEDRIKMAQRLPRLVRSYIKASQTFLTVTPHTRLAGSYAQNMVVGEVKDVDTLVRVWGDPKANEPEAKQLIWNLKKLLDGLPAYLGYEGYAETQIEVERARRSIHVYFKDEDFHLDFVPCVAPDGFKNVLYVPDRGFNEWIASHPIGYITLLNKLNQQHGKKVKPLGKLLKHFRDHQMKNRKPKSYWLGALLLYHVQTHSLDTDACLGVLFRDLLDAIYCQYDHLLWTSDTATPNIPDPVLNHNISWNWSRTHFETFMCRIDEGRQWAAKALDADDRDEAIVYWQKIFGEGYFPSEVETAASSLAKAALPGKSLVSPTGMILSSQPASGLYTETQPTKFHGIEQV

SEQ ID NO: 3918 - protein, 352 aa, Bacteroidetes bacterium
MHILTTHFTELLKNIEPPQYRLEAAKELPDKVRDYLKNTDGFPTSSPYSALSGSYRRHTAIGDIKDVDIIVKVDVGLDENPGSIIRKLKDKLDDLPKELGLQGYTEIKQSRRSVHVYFVDKDFHLDVVPAIIPKEIDQKLYIPDKSWGKWIPSNPIGYCRYLSELNDKYNGKVVPLIKLVKYFRDYQMKIMKPKSYWLEALVVYHIKNGSLNMDQSLPEIFHDLMSAIYNKFAPILGREDGATPHIPDPMLENDISWNWDRSHFETFMNRVKEAENTTQKALQTEDQEEAITLWQNVFGEEHFPKDTKQAAHKLAEAAPGKASVSSAGIISSLQPAFGKYLASKPTRFYGEE

SEQ ID NO: 3919 - protein, 358 aa, Anaeromyxobacter dehalogenans
MATTRFHFAALLKKVNPSDERLEVAQDRPGEVRDWLKDHEFATKSPHSRLSGSYARDTAILDIKDVDVLVFLPDDQLDRTPNAVLLEVKKVLDGYPGANVETSGQRRSVRMDFPDENLRLDIVPVVAKDGLEKQLSVPDRPAAKWIKSDPLGYAERLSRVNQKNNGKLVPLVKLVKAWRDVQMKVRRPKSYVLEVMALYAVENGDITLNGESTARNLADFFSHIAAKYADLMENGKESPRIPDPMIPTNLITKHWDRSHFETFMRRIREADKAAQNALKTDDDDAASAEWAKVFGEYWPTADEAKAEAKKQAQVAAVAPGKTKVTNTGGVAGYGSAGTIATAATSFHGGHRSGDDSDA

SEQ ID NO: 3920 - protein, 320 aa, Melittangium boletus
MRNGETHMRDLTDLLNRILRSVEPSAEEKEGAQRSHHYLREILLTGKMESIIRYHFLSGSYPRATAIRPLDDVDIIFVVDPSHWKTPNFSDLPAPSAVLQTFERALARRYLETKLRVQRRSIRLQMQHLNVDVVPAVSADGEGSERLLIPDAENDTWIRSAPKIHGALATEINQRHGELFKPLVKLLKTWNLGVPEALRFKSFCVETIATRLFASAKLNSLQTGLVQFFDFVCYIGGDPCEFPWNDDRGMSLRLGNCVVPDTAEGMNVAASVTRQGRECFMRRAATSRDWILQAERARTWNSAESKIEKAFGSHLRELDW

SEQ ID NO: 3921 - protein, 313 aa, Melittangium boletus
MRDLTDLLNRILRSVEPSAEEKEGAQRSHHYLREILLTGKMESIIRYHFLSGSYPRATAIRPLDDVDIIFVVDPSHWKTPNFSDLPAPSAVLQTFERALARRYLETKLRVQRRSIRLQMQHLNVDVVPAVSADGEGSERLLIPDAENDTWIRSAPKIHGALATEINQRHGELFKPLVKLLKTWNLGVPEALRFKSFCVETIATRLFASAKLNSLQTGLVQFFDFVCYIGGDPCEFPWNDDRGMSLRLGNCVVPDTAEGMNVAASVTRQGRECFMRRAATSRDWILQAERARTWNSAESKIEKAFGSHLRELDW

SEQ ID NO: 3922 - protein, 320 aa, Cystobacter fuscus
MRNGETHMMDLTESLRRILRSVEPSQEEKEGAQRSHRYLRDILVTGNMESIIREHFLSGSYPRATAIRPLDDVDIIFVVDPGHWKTPSGGALPDPSAVLQTFKRALEWRYPETELRVQRRSIRLQMWHLNVDVVPAVSADGRGSERLLIPDAENDGWIRSAPKIHGALSTEINQRQGGLFKPLVKLLKTWNLGASEDLRLKSFCVETIAARLFASARLRSLQTGLVQFFDFVCYIGGGPCEYPWGDDRGMSLRLGNCVVPDTAECTNVAVSVTRQGRECFLRRAAASREWILQAEQARTWNEAERKIEQAFGSHLRELGW

SEQ ID NO: 3923 - protein, 313 aa, Cystobacter fuscus
MMDLTESLRRILRSVEPSQEEKEGAQRSHRYLRDILVTGNMESIIREHFLSGSYPRATAIRPLDDVDIIFVVDPGHWKTPSGGALPDPSAVLQTFKRALEWRYPETELRVQRRSIRLQMWHLNVDVVPAVSADGRGSERLLIPDAENDGWIRSAPKIHGALSTEINQRQGGLFKPLVKLLKTWNLGASEDLRLKSFCVETIAARLFASARLRSLQTGLVQFFDFVCYIGGGPCEYPWGDDRGMSLRLGNCVVPDTAECTNVAVSVTRQGRECFLRRAAASREWILQAEQARTWNEAERKIEQAFGSHLRELGW

(The sequence listing continues in the following parts.)

The invention claimed is:

1. A modified polypeptide that catalyzes production of cyclic di-purine nucleotides, wherein said polypeptide comprises an amino acid sequence having the cyclic dinucleotidyltransferase (CD-NTase) amino acid sequence of SEQ ID NO: 198 and further comprises amino acid residue S at the position corresponding to N166 of SEQ ID NO: 198.

2. The modified polypeptide of claim 1, wherein the cyclic di-purine nucleotides comprise cyclic-di-adenosine monophosphate (c-di-AMP).

3. The modified polypeptide of claim 1, further comprising a heterologous polypeptide.

4. The modified polypeptide of claim 3, wherein the heterologous polypeptide is selected from the group consisting of a signal peptide, a peptide tag, a dimerization domain, an oligomerization domain, an antibody, and an antibody fragment.

5. The modified polypeptide of claim 1, wherein the modified polypeptide is immobilized on an object selected from the group consisting of a cell, a metal, a resin, a polymer, a ceramic, a glass, a microelectrode, a graphitic particle, a bead, a gel, a plate, an array, and a capillary tube.

6. A composition comprising the modified polypeptide of claim 1 and a pharmaceutically acceptable excipient, diluent, or carrier.

7. An isolated nucleic acid molecule encoding the modified polypeptide of claim 1.

8. A vector comprising the nucleic acid molecule of claim 7.

9. The vector of claim 8, wherein the vector is an expression vector.

10. A host cell transfected with the vector of claim 9.

11. A method of producing a polypeptide comprising culturing the host cell of claim 10 in an appropriate culture medium to, thereby, produce the polypeptide.

12. The method of claim 11, wherein:

i) the host cell is a bacterial cell or a eukaryotic cell;

ii) the host cell is genetically engineered to express a selectable marker; and/or iii) further comprising the step of isolating the polypeptide from the medium or host cell.

* * * * *